(12) United States Patent
Papkoff et al.

(10) Patent No.: US 12,144,834 B2
(45) Date of Patent: Nov. 19, 2024

(54) METHODS AND COMPOSITIONS FOR TREATING GASTROINTESTINAL AND INFLAMMATORY DISORDERS

(71) Applicant: Xbiome Inc., New York, NY (US)

(72) Inventors: Jackie Papkoff, San Francisco, CA (US); Jun Ma, San Francisco, CA (US)

(73) Assignee: Xbiome Inc., New York, NY (US)

( * ) Notice: Subject to any disclaimer, the term of this patent is extended or adjusted under 35 U.S.C. 154(b) by 454 days.

(21) Appl. No.: 16/570,428

(22) Filed: Sep. 13, 2019

(65) Prior Publication Data

US 2020/0215129 A1 Jul. 9, 2020

Related U.S. Application Data

(60) Provisional application No. 62/782,666, filed on Dec. 20, 2018, provisional application No. 62/747,391, filed on Oct. 18, 2018, provisional application No. 62/734,495, filed on Sep. 21, 2018, provisional application No. 62/730,792, filed on Sep. 13, 2018.

(51) Int. Cl.
| | | |
|---|---|---|
| *A61K 35/742* | (2015.01) | |
| *A61K 35/00* | (2006.01) | |
| *A61K 35/741* | (2015.01) | |
| *A61K 47/26* | (2006.01) | |
| *A61P 1/04* | (2006.01) | |

(52) U.S. Cl.
CPC ............ *A61K 35/741* (2013.01); *A61K 47/26* (2013.01); *A61P 1/04* (2018.01); *A61K 2035/115* (2013.01)

(58) Field of Classification Search
None
See application file for complete search history.

(56) References Cited

U.S. PATENT DOCUMENTS

| | | | |
|---|---|---|---|
| 6,861,053 B1 | 3/2005 | Lin et al. | |
| 7,101,565 B2 | 9/2006 | Monte | |
| 7,115,200 B2 | 10/2006 | Ackermanns et al. | |
| 7,232,656 B2 | 6/2007 | Balasubramanian et al. | |
| 7,718,608 B2 | 5/2010 | Lin et al. | |
| 7,835,871 B2 | 11/2010 | Kain et al. | |
| 7,960,120 B2 | 6/2011 | Rigatti et al. | |
| 7,998,474 B2 | 8/2011 | Kelly | |
| 8,197,805 B2 | 6/2012 | Lin et al. | |
| 8,906,668 B2* | 12/2014 | Henn ................... | A61K 9/0053 435/252.4 |
| 9,066,962 B2 | 6/2015 | Pimentel et al. | |
| 9,314,489 B2 | 4/2016 | Kelly et al. | |
| 9,371,510 B2 | 6/2016 | Moore | |
| 9,415,079 B2 | 8/2016 | Honda et al. | |
| 9,421,230 B2 | 8/2016 | Honda et al. | |
| 9,433,652 B2 | 9/2016 | Honda et al. | |
| 9,494,587 B2 | 11/2016 | Goletz et al. | |
| 9,610,307 B2* | 4/2017 | Berry ................... | A61K 35/741 |
| 9,623,055 B2 | 4/2017 | Nieuwdorp et al. | |
| 9,642,882 B2 | 5/2017 | Honda et al. | |
| 9,827,276 B2 | 11/2017 | Honda et al. | |
| 9,907,755 B2 | 3/2018 | Kabadi et al. | |
| 9,937,211 B2 | 4/2018 | Kelly et al. | |
| 10,022,406 B2 | 7/2018 | Borody | |
| 10,028,980 B2 | 7/2018 | Sadowsky et al. | |
| 10,058,574 B2 | 8/2018 | Grant et al. | |
| 2005/0266069 A1* | 12/2005 | Simmons ............... | A23L 29/065 424/93.45 |
| 2005/0281775 A1* | 12/2005 | Carrington ............. | A61K 31/78 424/70.16 |
| 2006/0024681 A1 | 2/2006 | Smith et al. | |
| 2006/0292611 A1 | 12/2006 | Berka et al. | |
| 2007/0014362 A1 | 1/2007 | Cruz et al. | |
| 2009/0026082 A1 | 1/2009 | Rothberg et al. | |
| 2009/0127589 A1 | 5/2009 | Rothberg et al. | |
| 2010/0035252 A1 | 2/2010 | Rothberg et al. | |
| 2010/0137143 A1 | 6/2010 | Rothberg et al. | |
| 2010/0188073 A1 | 7/2010 | Rothberg et al. | |
| 2011/0009278 A1 | 1/2011 | Kain et al. | |
| 2011/0212079 A1* | 9/2011 | Mascarenhas ......... | A61P 29/00 514/17.7 |
| 2012/0178771 A1* | 7/2012 | Babul .................. | A61K 9/2054 514/282 |
| 2014/0335131 A1 | 11/2014 | Mazmanian et al. | |
| 2015/0037285 A1 | 2/2015 | Blaser et al. | |
| 2015/0037286 A1 | 2/2015 | Qin et al. | |
| 2015/0238545 A1 | 8/2015 | Borody | |
| 2016/0120915 A1 | 5/2016 | Blaser et al. | |

(Continued)

FOREIGN PATENT DOCUMENTS

| | | |
|---|---|---|
| WO | WO-2004085628 A1 | 10/2004 |
| WO | WO-2016033439 A2 | 3/2016 |

(Continued)

OTHER PUBLICATIONS

Assembly Biosciences, pp. 1-2, Jan. 27, 2016.*
Udayappan et al. NPJ Biofilms and Microbiomes, 2(1): 1-10, 2016.*
Bircher et al. Microb. Biotechnol. 11(4): 721-733, Epub Apr. 17, 2018.*
Arief et al., Benef Microbes. 6(4):603-13 (2015).
Baars et al., Microorganisms 3(4): 641-666 (2015).
Bisborough et al., Am J Gastroenterol Suppl 3:27-37 (2016).

(Continued)

*Primary Examiner* — S. Devi

(74) *Attorney, Agent, or Firm* — Barnes & Thornburg LLP; Aisha R. Hasan

(57) ABSTRACT

The disclosure relates generally to bacterial strains and bacterial strain mixtures, e.g., *Eubacterium, Bacteroides*, and *Roseburia* bacterial strains and mixtures thereof. The disclosure further relates to methods of using bacterial strains and bacterial strain mixtures for treating a gastrointestinal disorder, e.g., ulcerative colitis, an inflammatory disorder, and/or dysbiosis.

24 Claims, 19 Drawing Sheets

Specification includes a Sequence Listing.

(56) References Cited

U.S. PATENT DOCUMENTS

| | | |
|---|---|---|
| 2016/0199424 A1 | 7/2016 | Berry et al. |
| 2016/0243172 A1 | 8/2016 | Cook et al. |
| 2016/0271188 A1 | 9/2016 | Berry et al. |
| 2016/0271189 A1 | 9/2016 | Cutcliffe et al. |
| 2016/0310545 A1 | 10/2016 | Moore |
| 2016/0375065 A1 | 12/2016 | Mazmanian et al. |
| 2017/0020932 A1 | 1/2017 | Cutcliffe et al. |
| 2017/0027996 A1 | 2/2017 | Cutcliffe et al. |
| 2017/0100442 A1 | 4/2017 | Gamble et al. |
| 2017/0143774 A1 | 5/2017 | Mulder et al. |
| 2017/0151291 A1 | 6/2017 | Henn et al. |
| 2017/0224744 A1 | 8/2017 | Ning et al. |
| 2017/0246214 A1 | 8/2017 | Sadowsky et al. |
| 2017/0252378 A1 | 9/2017 | Sadowsky et al. |
| 2017/0252381 A1 | 9/2017 | Ning et al. |
| 2017/0296596 A1 | 10/2017 | Allen-Vercoe et al. |
| 2017/0319627 A1 | 11/2017 | Sadowsky et al. |
| 2017/0326184 A1 | 11/2017 | Patterson et al. |
| 2018/0015130 A1 | 1/2018 | Berry et al. |
| 2018/0071344 A1 | 3/2018 | Berry et al. |
| 2018/0087094 A1 | 3/2018 | Klumpp et al. |
| 2018/0092949 A1 | 4/2018 | Sokol et al. |
| 2018/0117097 A1 | 5/2018 | Chatila et al. |
| 2018/0117099 A1 | 5/2018 | Chatila et al. |
| 2018/0133265 A1 | 5/2018 | Stevenson |
| 2018/0140648 A1 | 5/2018 | Segal et al. |
| 2018/0146681 A1 | 5/2018 | Clube |
| 2018/0185421 A1 | 7/2018 | Kakihana et al. |
| 2018/0193391 A1 | 7/2018 | Sefik et al. |
| 2018/0243350 A1 | 8/2018 | Raa et al. |
| 2018/0250350 A1 | 9/2018 | Sokol et al. |
| 2018/0256652 A1 | 9/2018 | Borody |
| 2018/0274036 A1 | 9/2018 | Van Den Brink et al. |
| 2018/0353554 A1 | 12/2018 | Henn et al. |
| 2019/0247367 A1* | 8/2019 | Goldfeld ............... A61P 31/18 |
| 2020/0376044 A1* | 12/2020 | Han .................. A61K 35/741 |

FOREIGN PATENT DOCUMENTS

| | | |
|---|---|---|
| WO | WO-2017053544 A1 | 3/2017 |
| WO | WO-2017102816 A1 | 6/2017 |
| WO | WO-2017146580 A1 | 8/2017 |
| WO | WO-2017172894 A2 | 10/2017 |
| WO | WO-2017205302 A1 | 11/2017 |
| WO | WO-2017218889 A1 | 12/2017 |
| WO | WO-2018057914 A1 | 3/2018 |
| WO | WO-2018064165 A2 | 4/2018 |
| WO | WO-2018065132 A1 | 4/2018 |
| WO | WO-2018075886 A1 | 4/2018 |
| WO | WO-2018094190 A2 | 5/2018 |
| WO | WO-2018106844 A1 | 6/2018 |
| WO | WO-2018136884 A1 | 7/2018 |
| WO | WO-2018140931 A1 | 8/2018 |
| WO | WO-2018152306 A1 | 8/2018 |
| WO | WO-2019028402 A1 | 2/2019 |
| WO | WO-2019157566 A1 | 8/2019 |

OTHER PUBLICATIONS

Charrier et al., Microbiology, 152: 179-185 (2006).
Chassaing et al., Curr Protoc Immunol.;104:Unit 15.25 (2014).
Comstock et al., BioEssays, 25: 926-929 (2003).
Dolan et al., PLoS One. 7(10): e47300 (2012).
Doria et al., N Engl J Med 368(19):1845 (2013).
Duncan et al., Applied and Environmental Microbiology, 69(2): 1136-1142 (2003).
Duncan et al., Applied and Environmental Microbiology, 70(10): 5810-5817 (2004).
Duncan et al., Int. J. Syst. Evol. Microbiol., 56: 2437-2441 (2006).
Ellington et al., Clin Microbiol Infect. 23(1):2-22 (2017).
Engels et al., Front Microbiol. 7(713): 1-12 (2016).
Fiorucci et al., Br. J. Pharmacol. 150:996-1002 (2007).
Genin et al., BMC Cancer 15:577 (2015).
Hall et al., Journal of Pediatric Surgery 48:353-358 (2013).
Hiippala et al., Nutrients, 10(988): 1-23 (2018).
Hoeppli et al., Front Immunol 6:61 (2015).
Husain et al., Microb Genom. 3(11) (2017).
International Search Report for PCT/US2019/051064, mailed Jan. 22, 2020 (5 pages).
Kassinen et al., Gastroenterology, 133(1): 24-33 (2007).
Koh et al., Cell 165(6):1332-1345 (2016).
Kole et al., Curr Top Microbiol Immunol. 380:19-38 (2014).
Krause et al., Nature Communications 6: 7055 (2015).
Lee and Hase, Nat Chem Biol 10(6):416-424 (2014).
Li and He, World J Gastroenterol. 10(5):620-5 (2004).
Louis et al., FEMS Microbiology Letters, 294: 1-8 (2008).
Michielan et al., Mediators Inflamm. 2015:628157 (2015).
Nielsen et al., Gut, 38:414-420 (1996).
Nys et al., Nat Rev Gastroenterol Hepatol. (7):395-401 (2013).
Ostvik et al., Clin Exp Immunol. 173:502-511 (2013).
Patterson et al., Frontiers in Immunology, 8(1166): 1-14 (2017).
Pontier et al., J. Pharm. Sci., 90(10): 1608-19 (2001).
Poxton et al., J. Med. Microbiol., 46: 85-91 (1997).
Pryde et al., FEMS Microbiology Letters, 217: 133-139 (2002).
Puleston et al., Cold Spring Harb Protoc; doi:10.1101/pdb.top070391.
Pumbwe et al., Microb Pathog. 43(2-3):78-87 (2007).
Reeves et al., J. Bacteriol., 179(3): 643-649 (1997).
Renye Jr. et al., Biotechnol Lett. (11):1947-1954 (2016).
Rutgeerts et al., N Engl J Med. 353(23):2462-76 (2005).
Seo et al., Sci. Rep 7(1):851 (2017).
Seth and Taga, Front Microbiol. 5:350 (2014).
Shetty et al., Genome Announc., 5(43): e01167-17 (2017).
Shetty et al., Int J Syst Evol Microbiol. 68:3741-3746 (2018).
Siguier et al., FEMS Microbiology Reviews, 38(5): 865-891 (2013).
Sim et al., J. Vis. Exp. (112), e54128 (2016).
Spinler et al., Anaerobe. 14(3):166-71 (2008).
Stallhofer et al., Inflamm Bowel Dis 21(10):2327-2340 (2015).
Steinbach et al., Inflamm Bowel Dis. 20(1):166-175 (2014).
Sudhakaran et al., Genes Nutr., 8(6): 637-48 (2013).
Tilg et al., Gut, 0: 1-2 (2013).
Travis et al., Genome Announc., 3(6): 01286-15 (2015).
Ungaro et al., Lancet 389(10080):1756-1770 (2017).
Wilson et al., PLoS Pathog. (8): e1002171 (2011).
Written Opinion for PCT/US2019/051064, mailed Jan. 22, 2020 (9 pages).
Wu et al., PLoS ONE 7:e37572 (2012).
Wu et al., Science, 350(6256): 1-21 (2015).
Xu et al., Science, 299(5616): 2074-2076 (2003).
Yin et al., Front Immunol. 2018; 9: 1512 (2018).

* cited by examiner

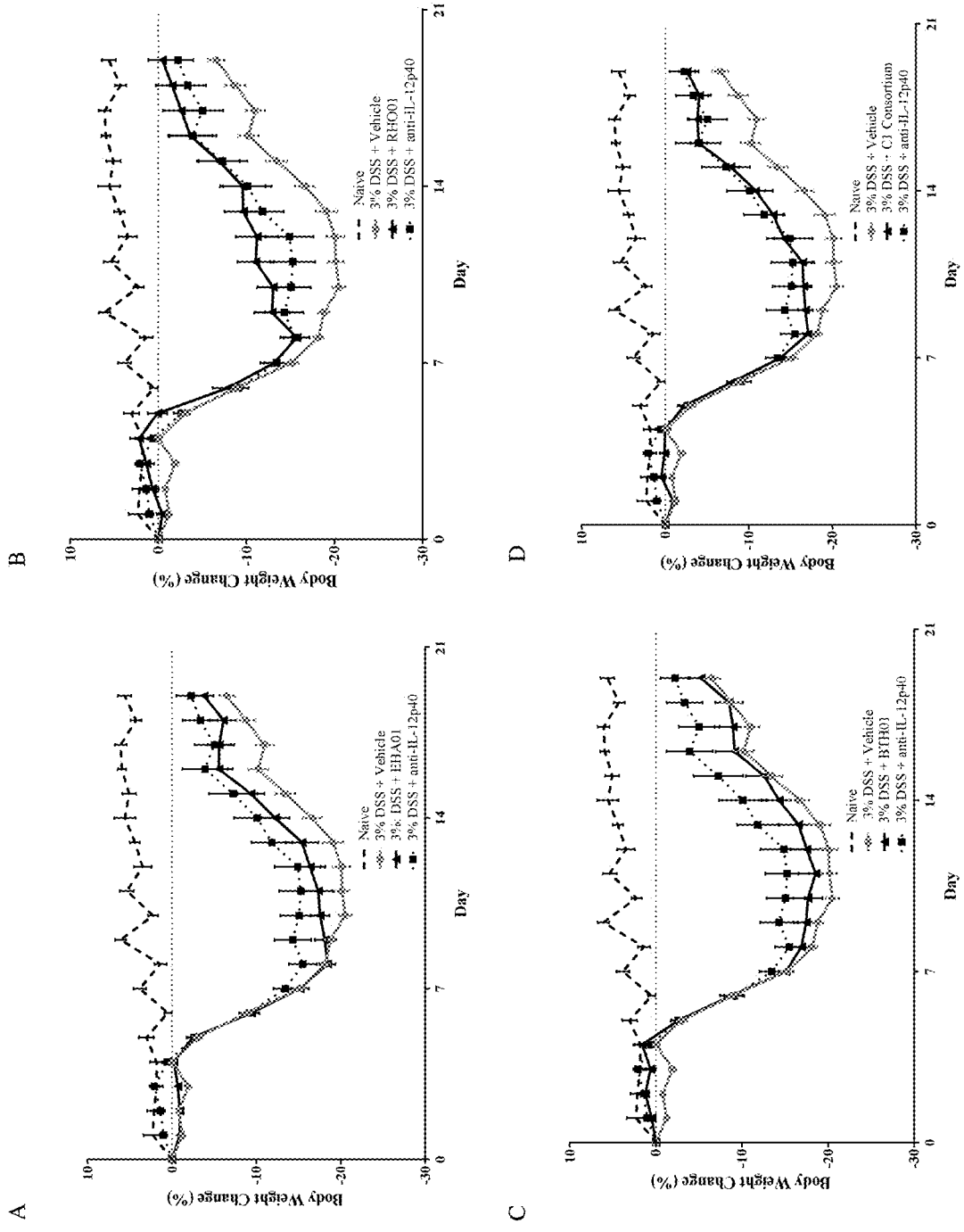
FIG. 13A-D

FIG. 13E-F
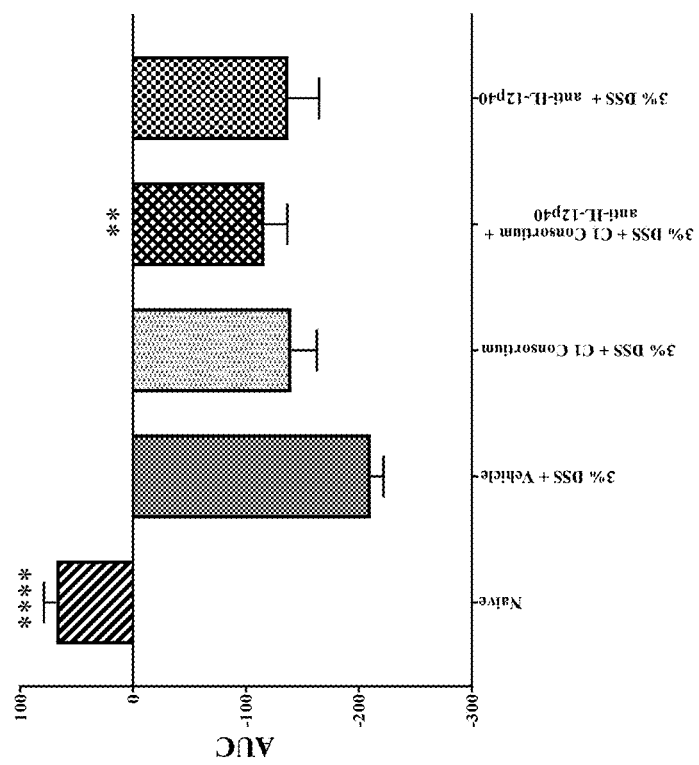
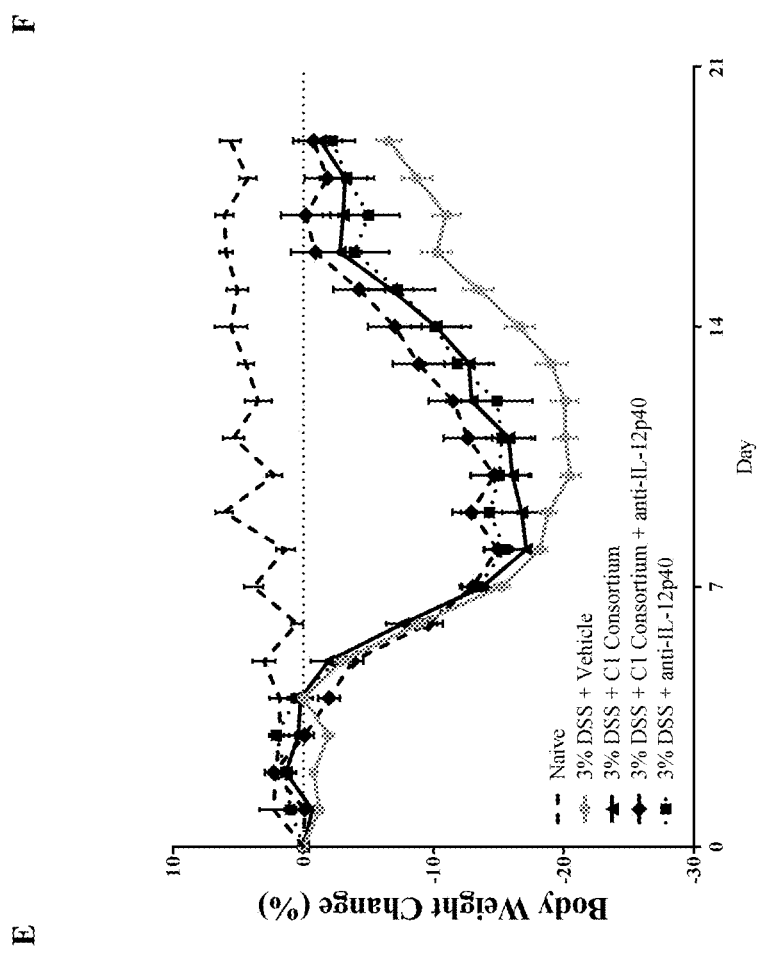

Figure 14
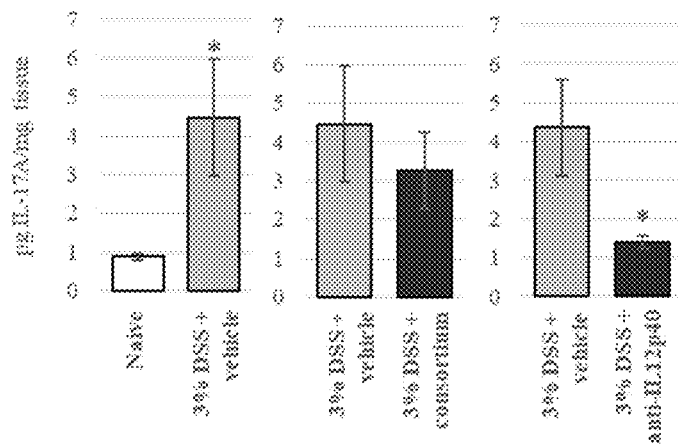
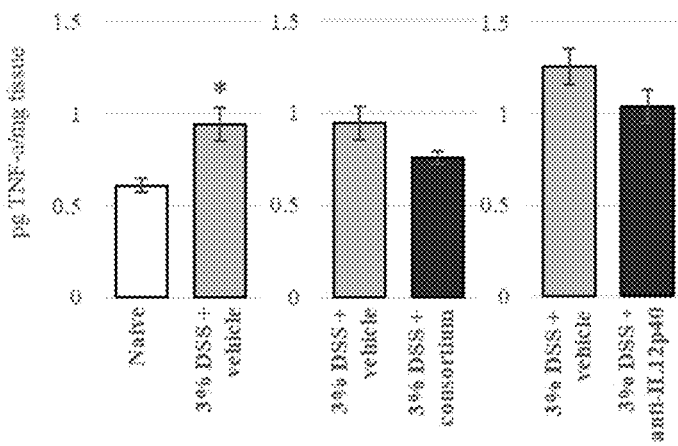
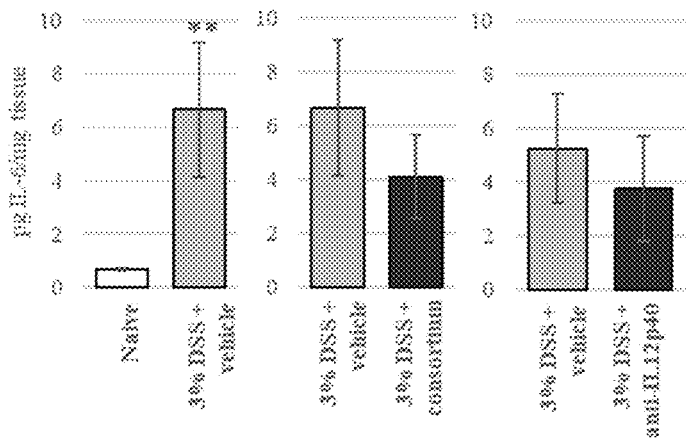

Figure 15
A
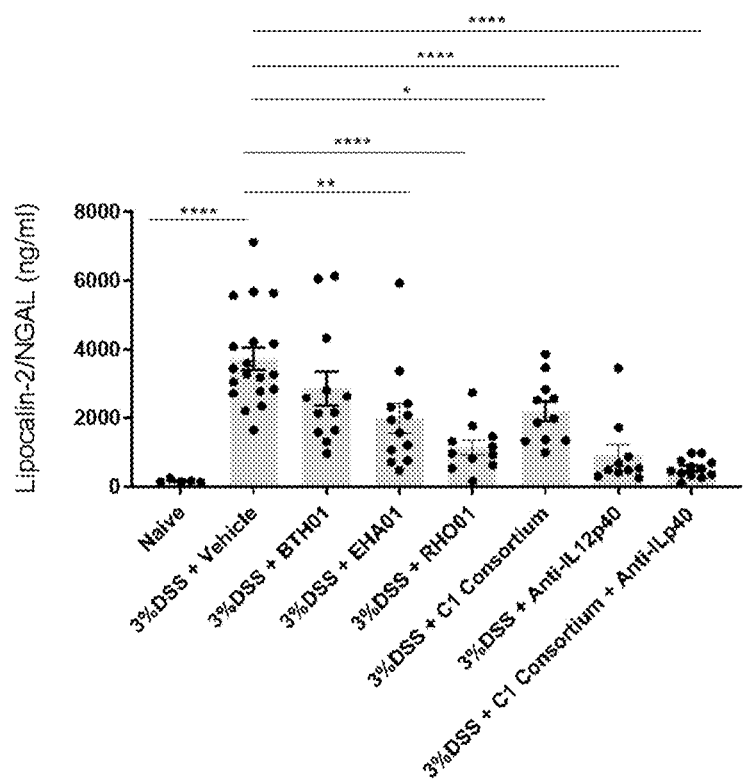
B
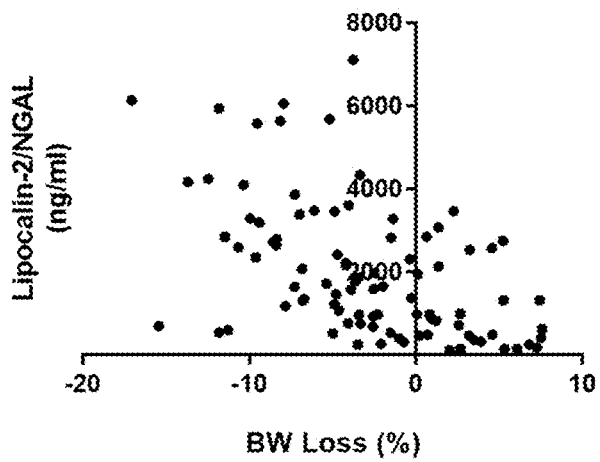

METHODS AND COMPOSITIONS FOR TREATING GASTROINTESTINAL AND INFLAMMATORY DISORDERS

CROSS REFERENCE TO RELATED APPLICATIONS

This application claims the benefit of, and priority to, U.S. provisional patent application Ser. No. 62/730,792, filed Sep. 13, 2018, U.S. provisional patent application Ser. No. 62/734,495, filed Sep. 21, 2018, U.S. provisional patent application Ser. No. 62/747,391, filed Oct. 18, 2018, and U.S. provisional patent application Ser. No. 62/782,666 filed Dec. 20, 2018, each of which are hereby incorporated by reference herein in their entirety.

SEQUENCE LISTING

The instant application contains a Sequence Listing which has been filed electronically in ASCII format and is hereby incorporated by reference in its entirety. Said ASCII copy, created on Dec. 19, 2018, is named ASP-056_SL.txt and is 17,078,089 bytes in size.

BACKGROUND

The gastrointestinal tract (GI), as well as other organ systems, is a complex biological system that includes a community of many different organisms, including diverse strains of bacteria. Hundreds of different species may form a commensal community in the gastrointestinal tract and other organs in a healthy person. Moreover, microorganisms present in the gut not only play a crucial role in digestive health, but also influence the immune system.

A disturbance or imbalance in a biological system, e.g., the gastrointestinal tract, may include changes in the types and numbers of bacteria in the gut which may lead to the development of, or may be an indicator of, a disease state. Patients who suffer from certain diseases (e.g., gastrointestinal diseases) may have a microbiota spectrum that is different to that of healthy people. For example, ulcerative colitis (UC) is associated with an altered and imbalanced colonic microbial community structure (dysbiosis) with reduced bacterial species diversity and stability over time. In settings of such dysbiosis, microbiota functions can change, resulting in increased susceptibility to pathogens, altered metabolic profiles, or induction of proinflammatory signals that can result in local or systemic inflammation or autoimmunity.

Ulcerative colitis (UC), a form of inflammatory bowel disease (IBD), is an idiopathic, chronic, inflammatory disease that affects the colon. It is characterized by relapsing and remitting mucosal inflammation that starts in the rectum and reaches various extents of the proximal colon. Drugs that are used to treat UC include mesalamine, corticosteroids, oral immunosuppressive drugs, and monoclonal antibodies directed against TNF-α and α$\beta$7 lymphocyte integrin. Aminosalicylates (mesalamine, 5-ASA) are the standard-of-care in the treatment of mildly-to-moderately active UC. However, a significant number of mildly-to-moderately active patients with UC do not adequately respond to first-line treatment with mesalamine alone, necessitating the introduction of more toxic immunosuppressive medications. For example, systemic immune-suppressants, including biological drugs, are often used to treat patients suffering from moderate-to-severe UC who fail to adequately respond to mesalamine (5-ASA) therapy alone. Colectomy is needed in up to 15% of patients with UC (Ungaro et al., Lancet 389 (10080): 1756-1770 (2017)).

The inability of a significant number of patients suffering from gastrointestinal disorders to adequately respond to first-line treatment underscores the need in the art for pharmaceutical compositions and methods that can effectively treat this patient segment.

BRIEF SUMMARY

The disclosure relates generally to bacterial strains and bacterial strain mixtures, e.g., *Eubacterium, Bacteroides*, and *Roseburia* bacterial strains and mixtures thereof. Disclosed bacterial strains or bacterial strain mixtures are useful for treating gastrointestinal disorders and/or inflammatory disorders, including, for example, dysbiosis and/or immune mediated inflammatory disorders, such as ulcerative colitis, Crohn's disease, and other forms of inflammatory bowel disease (IBD).

For example, in one aspect, provided herein is a pharmaceutical composition comprising: a bacterial mixture comprising at least 2 bacterial species, each selected from the group consisting of: a *Bacteroides* species, a *Eubacterium* species, and a *Roseburia* species; and a pharmaceutically acceptable excipient. In certain embodiments, a contemplated bacterial mixture comprises a *Bacteroides* species, a *Eubacterium* species, and a *Roseburia* species. In certain embodiments, a contemplated bacterial mixture consists essentially of a *Bacteroides* species, a *Eubacterium* species, and a *Roseburia* species. In certain embodiments, the *Bacteroides* species of the bacterial mixture is *Bacteroides* thetaiotaomicron. In certain embodiments, the *Eubacterium* species of the bacterial mixture is *Eubacterium hallii*. In certain embodiments, the *Roseburia* species of the bacterial mixture is *Roseburia hominis*. In certain embodiments, a contemplated bacterial mixture is in lyophilized powder form. In certain embodiments, a disclosed bacterial mixture is capable of increasing production of at least one anti-inflammatory gene product, e.g., IL-10 and/or CCL-18 in a human cell, e.g., a THP-1 macrophage or a PBMC. In certain embodiments, a disclosed bacterial mixture is capable of reducing or attenuating production of at least one pro-inflammatory gene product, e.g., IL-6, IL-12, IL-17 and/or TNF-α in a human cell, e.g., a THP-1 macrophage or a PBMC. In certain embodiments, a disclosed bacterial mixture is capable of reducing or preventing disruption of, or increasing, barrier integrity of a human cell (e.g., an epithelial cell) monolayer, e.g., a HT29MTX-E12 cell monolayer treated with TNF-α. In certain embodiments, a disclosed bacterial mixture is capable of inducing or increasing autophagy in a human cell, e.g., a THP-1 macrophage. In certain embodiments, a disclosed bacterial mixture is capable of reducing or attenuating production of Lipocalin-2/NGAL in a cell, tissue or subject.

In another aspect, provided herein is a method of treating a gastrointestinal disorder in a subject in need thereof. A contemplated method comprises administering to the subject an effective amount of a disclosed pharmaceutical composition, pharmaceutical unit, or bacterial strain.

In some embodiments, the method comprises administering to the subject at least 2 bacterial strains, each selected from the group consisting of: a *Bacteroides* species strain, a *Eubacterium* species strain, and a *Roseburia* species strain. In certain embodiments, each bacterial strain is in lyophilized powder form.

Contemplated gastrointestinal disorders include, for example, dysbiosis and/or immune mediated inflammatory disorders, such as ulcerative colitis, Crohn's disease, and other forms of inflammatory bowel disease (IBD).

In another aspect, provided herein is a method of treating ulcerative colitis (UC) in a subject in need thereof. A contemplated method comprises administering to the subject an effective amount of a disclosed pharmaceutical composition, pharmaceutical unit, or bacterial strain. A contemplated subject may have had an inadequate response to an administration of a previous treatment for UC, e.g., mesalamine. For example, a contemplated subject may have previously been administered ≥2.4 g/day mesalamine orally for at least 8 weeks.

In another aspect, provided herein is a method of treating a dysbiosis in a subject in need thereof. A contemplated method comprises administering to the subject an effective amount of a disclosed pharmaceutical composition, pharmaceutical unit, or bacterial strain. In certain embodiments, the subject also has a gastrointestinal disorder.

In another aspect, provided herein is a method of modifying the gut microbiome of a subject in need thereof. A contemplated method comprises administering to the subject an effective amount of a disclosed pharmaceutical composition, pharmaceutical unit, or bacterial strain. In certain embodiments, the subject also has a gastrointestinal disorder.

In another aspect, provided herein is a method of treating an inflammatory disorder in a subject in need thereof. A contemplated method comprises administering to the subject an effective amount of a disclosed pharmaceutical composition, pharmaceutical unit, or one or more bacterial strains.

Contemplated methods may further comprise, e.g., administering a corticosteroid to a subject, pretreating a subject with an antibiotic, administering an antibiotic to a subject, or administering a prebiotic to a subject.

These and other aspects and features of the disclosure are described in the following detailed description and claims.

DESCRIPTION OF THE DRAWINGS

The disclosure can be more completely understood with reference to the following drawings.

FIG. 1A depicts the profile of strain BTH01. FIG. 1B depicts the profile of strain EHA01. FIG. 1C depicts the profile of strain RHO01. FIG. 1D depicts the profile of the consortium of strains BTH01+EHA01+RHO01. Levels of lactate, acetate, propionate and butyrate in batch culture supernatants of individual C1 strains as well a consortium of all three strains were analyzed by HPLC (ABPDU Berkeley CA). The average amounts of the SCFAs detected from two independent experiments are shown for individual strains BTH01 (A), EHA01 (B) and RHO01 (C) as well as a consortium of all three strains (D).

FIG. 2A depicts the profile of strains BTH01, EHA01 and RHO01 individually. FIG. 2B depicts the profile of the consortium of strains BTH01+EHA01+RHO01. At the indicated timepoints, samples were taken followed by transfer of portions of cultures to fresh medium for fed-batch culturing. Abundance represented as copy number/ml of sample for each strain was determined by species-specific qPCR for strains grown individually (2A) and in consortium (2B).

FIGS. 13A-13F depicts the effect of C1 bacterial consortium and individual strains on percent body weight change in a DSS-induced colitis mouse model. Groups of mice for naïve (N=5), individual test articles (N=12), consortium (N=24), consortium plus anti-IL-12p40 antibody (N=12) and vehicle control (N=20) were used in a standard DSS-induced colitis model. Mice were treated with 3% DSS in drinking water from days 0-5. Groups of mice were treated from days-1-19 daily with an oral dose of 3×10$^9$ VCC of each individual C1 bacterial strain, the C1 consortium containing each strain at 1×10$^9$ VCC or the C1 consortium containing each strain at 1×10$^9$ VCC plus anti-IL-12p40 antibody (at 10 mg/kg in PBS, dosed Q3D starting on Day 6 by IP). Groups of mice were administered PBS as a vehicle negative control or an antibody against IL-12p40 (Q3D IP) alone as a positive control for efficacy. A plot of daily body weight change over time (d0-19) for each test group is shown alongside naïve mice (dashed black), vehicle control (grey, circle) and anti-IL-12p40 (dotted black, square). (13A) EHA01, (13B) RHO01, (13C) BTH01, (13D) C1, and (13E) C1+anti-IL-12p40. (13F) AUC analysis of C1+anti-IL-12p40. Error bars are shown as SEM.

FIGS. 14A-14C depicts cytokine levels in colon tissue on day 19 of DSS-induced colitis. Cytokine levels were evaluated by ELISA after colon tissue homogenization in lysis buffer. Levels were normalized to mg of tissue analyzed. *p value≤0.05; **p value≤0.001; Mann-Whitney non-parametric test.

FIGS. 15A-15B depicts Lipocalin-2/NGAL levels in plasma on day 19 of DSS-induced colitis. Lipocalin-2/NGAL was evaluated by ELISA and levels were normalized to ml of plasma analyzed. Differences between groups of experiments were statistically determined by using one-factor ANOVA with a Tukey post hoc test. (A) Lipocalin-2/NGAL plasma levels; (B) Lipocalin-2/NGAL plasma levels versus body weight (BW) loss (%). (r=−0.5129; 95% confidence interval=−0.6502 to −0.3432; R2=0.2631; P value: P (two-tailed)=<0.0001; significant (alpha=0.05)).

DETAILED DESCRIPTION

Figure 1:
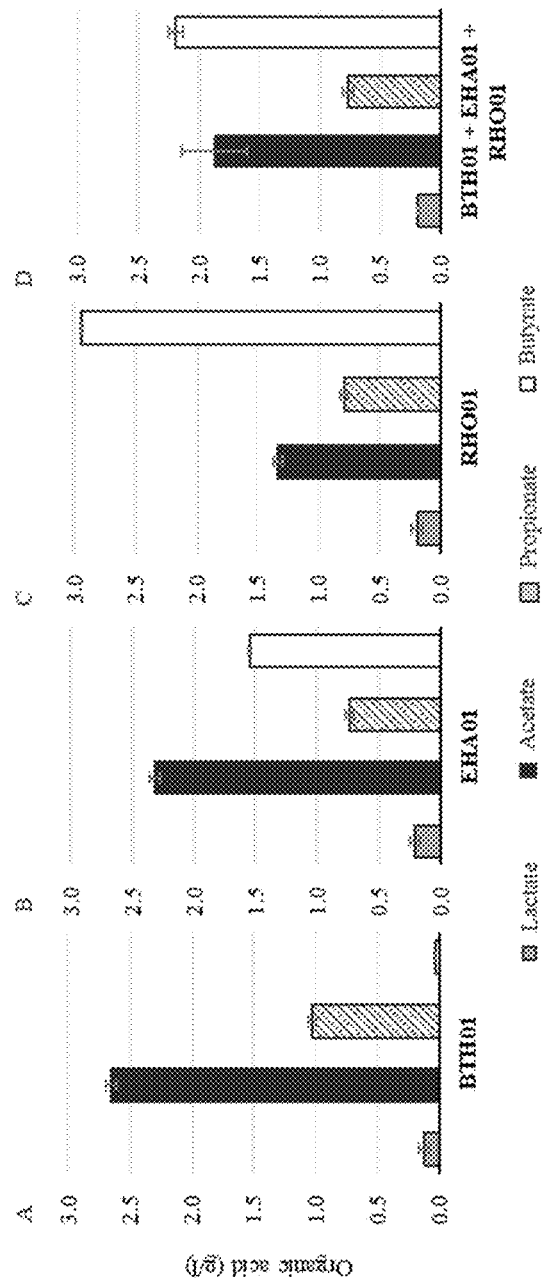
FIGS. 1A-1D depict the short-chain fatty acid (SCFA) production profile of Consortium 1 (C1) bacterial strains in individual as well as consortium batch cultures.

The disclosure relates generally to bacterial strains and bacterial strain mixtures, e.g., *Eubacterium*, *Bacteroides*, and *Roseburia* bacterial strains and mixtures thereof. For example, in one aspect, provided herein is a pharmaceutical composition comprising: a bacterial mixture comprising at least 2 bacterial species, each selected from the group consisting of: a *Bacteroides* species, a *Eubacterium* species, and a *Roseburia* species; and a pharmaceutically acceptable excipient. In certain embodiments, a contemplated bacterial mixture comprises a *Bacteroides* species, a *Eubacterium* species, and a *Roseburia* species. In certain embodiments, a contemplated bacterial mixture consists essentially of a *Bacteroides* species, a *Eubacterium* species, and a *Roseburia* species. In certain embodiments, the *Bacteroides* species of the bacterial mixture is *Bacteroides thetaiotaomicron*. In certain embodiments, the *Eubacterium* species of the bacterial mixture is *Eubacterium hallii*. In certain embodiments, the *Roseburia* species of the bacterial mixture is *Roseburia hominis*.

In another aspect, provided herein is a pharmaceutical composition comprising: a bacterial mixture comprising at least 2 bacteria species each selected from the group consisting of: a *Bacteroides* species, a *Eubacterium* species, and a *Roseburia* species, wherein the bacterial mixture is capable of: (i) increasing production of at least one anti-inflammatory gene product, e.g., IL-10 and/or CCL-18 in a human cell, e.g., a THP-1 monocyte or macrophage or a peripheral blood mononuclear cell (PBMC); (ii) reducing or attenuating production of at least one pro-inflammatory gene product, e.g., IL-6, IL-12, IL-17 and/or TNF-α in a human cell, e.g., a THP-1 macrophage or a PBMC; (iii) reducing or preventing disruption of, or increasing, barrier integrity of a human cell (e.g., an epithelial cell) monolayer, e.g., a HT29MTX-E12 cell monolayer treated with TNF-α, for example, as measured by trans epithelial electrical resistance (TEER); (iv) inducing or increasing autophagy in a human cell, e.g. a THP-1 monocyte or macrophage; and/or (v) reducing or attenuating production of Lipocalin-2/NGAL in a cell, tissue or subject; and a pharmaceutically acceptable excipient. In another aspect, provided herein is a pharmaceutical unit comprising: a bacterial strain mixture comprising at least 2 bacteria species each selected from the group consisting of a *Bacteroides* species strain, a *Eubacterium* species strain, and a *Roseburia* species strain, and wherein the pharmaceutical unit has, e.g., at least $1 \times 10^6$, at least $1 \times 10^7$, at least $1 \times 10^8$, at least $1 \times 10^9$, at least $1 \times 10^{10}$, at least $1 \times 10^{11}$, or at least $1 \times 10^{12}$ viable organisms (e.g., cfus) of bacteria; and a pharmaceutically acceptable excipient. In certain embodiments, a contemplated bacterial strain mixture comprises at least about $1 \times 10^9$ viable organisms (e.g., cfus) of a *Bacteroides* species strain, at least about $1 \times 10^9$ viable organisms (e.g., cfus) of a *Eubacterium* species strain, and/or at least about $1 \times 10^9$ viable organisms (e.g., cfus) of a *Roseburia* species strain, or any combination thereof.

The disclosure further provides a pharmaceutical composition comprising a *Eubacterium* species strain and a pharmaceutically acceptable excipient. In certain embodiments, a contemplated composition further comprises a *Bacteroides* species strain and/or a *Roseburia* species strain. In some embodiments, the *Eubacterium* species strain is a strain of *Eubacterium hallii*.

The disclosure further provides a pharmaceutical composition comprising a *Bacteroides* species strain and a pharmaceutically acceptable excipient. In certain embodiments, a contemplated composition further comprises a *Eubacterium* species strain and/or a *Roseburia* species strain. In some embodiments, the *Bacteroides* species strain is a strain of *Bacteroides thetaiotaomicron*.

The disclosure further provides a pharmaceutical composition comprising a *Roseburia* species strain and a pharmaceutically acceptable excipient. In certain embodiments, a contemplated composition further comprises a *Bacteroides* species strain and/or a *Eubacterium* species strain. In some embodiments, the *Roseburia* species strain is a strain of *Roseburia hominis*.

In another aspect, provided herein is a bacterial strain of *Roseburia hominis* capable of: (i) increasing production of at least one anti-inflammatory gene product, e.g., IL-10 and/or CCL-18, in a human cell, e.g., a THP-1 macrophage or monocyte or a PBMC; (ii) reducing or attenuating production of at least one pro-inflammatory gene product, e.g., IL-6, IL-12, IL-17 and/or TNF-α, in a human cell, e.g., a THP-1 macrophage or monocyte or a PBMC; (iii) reducing or preventing disruption of, or increasing, barrier integrity of a human cell (e.g., an epithelial cell) monolayer, e.g., a HT29MTX-E12 cell monolayer treated with TNF-α; (iv) inducing or increasing autophagy in a human cell, e.g., a THP-1 macrophage; and/or (v) reducing or attenuating production of Lipocalin-2/NGAL in a cell, tissue or subject. In another aspect, provided herein is a bacterial strain of *Bacteroides thetaiotaomicron* capable of: (i) increasing production of at least one anti-inflammatory gene product, e.g., IL-10 and/or CCL-18, in a human cell, e.g., a THP-1 macrophage or monocyte or a PBMC; (ii) reducing or attenuating production of at least one pro-inflammatory gene product, e.g., IL-6, IL-12, IL-17 and/or TNF-α, in a human cell, e.g., a THP-1 macrophage or monocyte or a PBMC; (iii) reducing or preventing disruption of, or increasing, barrier integrity of a human cell (e.g., an epithelial cell) monolayer, e.g., a HT29MTX-E12 cell monolayer treated with TNF-α; (iv) inducing or increasing autophagy in a human cell, e.g., a THP-1 macrophage; and/or (v) reducing or attenuating production of Lipocalin-2/NGAL in a cell, tissue or subject. In another aspect, provided herein is a bacterial strain of *Eubacterium hallii* capable of: (i) increasing production of at least one anti-inflammatory gene product, e.g., IL-10 and/or CCL-18, in a human cell, e.g., a THP-1 macrophage or monocyte or a PBMC; (ii) reducing or attenuating production of at least one pro-inflammatory gene product, e.g., IL-6, IL-12, IL-17 and/or TNF-α, in a human cell, e.g., a THP-1 macrophage or monocyte or a PBMC; (iii) reducing or preventing disruption of, or increasing, barrier integrity of a human cell (e.g., an epithelial cell) monolayer, e.g., a HT29MTX-E12 cell monolayer treated with TNF-α; (iv) inducing or increasing autophagy in a human cell, e.g., a THP-1 macrophage; and/or (v) reducing or attenuating production of Lipocalin-2/NGAL in a cell, tissue or subject.

The disclosure further relates to pharmaceutical compositions or units and methods of using disclosed bacterial strains and/or bacterial strain mixtures to treat gastrointestinal disorders and inflammatory disorders, including, for example, dysbiosis and/or immune mediated inflammatory disorders, such as ulcerative colitis, Crohn's disease, and other forms of inflammatory bowel disease (IBD).

I. Bacterial Strains and Bacterial Strain Mixtures

As used herein, the term "species" refers to a taxonomic entity as conventionally defined by genomic sequence and phenotypic characteristics. A "strain" is a particular instance of a species that has been isolated and purified according to conventional microbiological techniques. Contemplated bacterial species and/or strains include those that are live and/or viable, as well as those that are killed, inactivated or attenuated. Additionally, contemplated bacterial strains include vegetative forms and non-spore-forming forms of bacteria.

The present disclosure encompasses derivatives of the disclosed bacterial strains. The term "derivative" includes daughter strains (progeny) or stains cultured (sub-cloned)

from the original but modified in some way (including at the genetic level), without altering negatively a biological activity of the strain.

rRNA, 16S rDNA, 16S rRNA, 16S, 18S, 18S rRNA, and 18S rDNA refer to nucleic acids that are components of, or encode for, components of the ribosome. There are two subunits in the ribosome termed the small subunit (SSU) and large subunit (LSU). Ribosomal RNA genes (rDNA) and their complementary RNA sequences are widely used for determination of the evolutionary relationships among organisms as they are variable, yet sufficiently conserved to allow cross-organism molecular comparisons.

16S rDNA sequence of the 30S SSU can be used, in embodiments, for molecular-based taxonomic assignments of prokaryotes. For example, 16S sequences may be used for phylogenetic reconstruction as they are general highly conserved but contain specific hypervariable regions that harbor sufficient nucleotide diversity to differentiate genera and species of most bacteria. Although 16S rDNA sequence data has been used to provide taxonomic classification, closely related bacterial strains that are classified within the same genus and species, may exhibit distinct biological phenotypes.

The identity of contemplated bacterial strains may be characterized by 16S rRNA, 16S rDNA or full genome sequence analysis. For example, in certain embodiments, contemplated bacterial strains may comprise a 16S rRNA, 16S rDNA and/or genomic sequence having a certain % identity to a reference sequence. A sequence of a bacterial strain described herein, for example, the 16s rRNA gene sequence or a genomic sequence (e.g., a whole genome sequence, or fragments or contigs thereof) of the bacterial strain, can be obtained using any sequencing methods known in the art, including, for example, Sanger sequencing. An example of a sequencing technology useful for identifying bacterial strains is the Illumina™ platform. The Illumina platform is based on amplification of DNA on a solid surface (e.g., flow cell) using fold-back PCR and anchored primers (e.g., capture oligonucleotides). For sequencing with the Illumina platform, bacterial DNA is fragmented, and adapters are added to terminal ends of the fragments. DNA fragments are attached to the surface of flow cell channels by capturing oligonucleotides which are capable of hybridizing to the adapter ends of the fragments. The DNA fragments are then extended and bridge amplified. After multiple cycles of solid-phase amplification followed by denaturation, an array of millions of spatially immobilized nucleic acid clusters or colonies of single-stranded nucleic acids are generated. Each cluster may include approximately hundreds to a thousand copies of single-stranded DNA molecules of the same template. The Illumina platform uses a sequencing-by-synthesis method where sequencing nucleotides comprising detectable labels (e.g., fluorophores) are added successively to a free 3' hydroxyl group. After nucleotide incorporation, a laser light of a wavelength specific for the labeled nucleotides can be used to excite the labels. An image is captured and the identity of the nucleotide base is recorded. These steps can be repeated to sequence the rest of the bases. Sequencing according to this technology is described in, for example, U.S. Patent Publication Application Nos. 2011/0009278, 2007/0014362, 2006/0024681, 2006/0292611, and U.S. Pat. Nos. 7,960,120, 7,835,871, 7,232,656, and 7,115,200. Another example of a sequencing technology useful for identifying bacterial strains is SOLiD™ technology by Applied Biosystems from Life Technologies Corporation (Carlsbad, Calif.). In SOLiD™ sequencing, bacterial DNA may be sheared into fragments, and adapters may be attached to the terminal ends of the fragments to generate a library. Clonal bead populations may be prepared in microreactors containing template, PCR reaction components, beads, and primers. After PCR, the templates can be denatured, and bead enrichment can be performed to separate beads with extended primers. Templates on the selected beads undergo a 3' modification to allow covalent attachment to the slide. The sequence can be determined by sequential hybridization and ligation with several primers. A set of four fluorescently labeled di-base probes compete for ligation to the sequencing primer. Multiple cycles of ligation, detection, and cleavage are performed with the number of cycles determining the eventual read length. Another example of a sequencing technology useful for identifying bacterial strains is Ion Torrent sequencing. In this technology, bacterial DNA is sheared into fragments, and oligonucleotide adapters are then ligated to the terminal ends of the fragments. The fragments are then attached to a surface, and each base in the fragments is resolvable by measuring the $H^+$ ions released during base incorporation. This technology is described in, for example, U.S. Patent Publication Application Nos. 2009/0026082, 2009/0127589, 2010/0035252, 2010/0137143, and 2010/0188073.

Upon obtaining a polynucleotide sequence of a bacterial strain (e.g., 16s rRNA gene sequence or genomic sequence), sequence identity may be determined in various ways that are within the skill in the art, e.g., using publicly available computer software such as BLAST, BLAST-2, BLAT (BLAST-like alignment tool), ALIGN or Megalign (DNASTAR) software. BLAST (Basic Local Alignment Search Tool) analysis using the algorithm employed by the programs blastp, blastn, blastx, tblastn and tblastx (Karlin et al., PROC. NATL. ACAD. SCI. USA 87:2264-2268 (1990); Altschul, J. MOL. EVOL. 36, 290-300 (1993); Altschul et al., NUCLEIC ACIDS RES. 25:3389-3402 (1997)) are tailored for sequence similarity searching. For a discussion of basic issues in searching sequence databases see Altschul et al., NATURE GENETICS 6:119-129 (1994). Those skilled in the art can determine appropriate parameters for measuring alignment, including any algorithms needed to achieve maximal alignment over the full length of the sequences being compared. The search parameters for histogram, descriptions, alignments, expect (i.e., the statistical significance threshold for reporting matches against database sequences), cutoff, matrix and filter are at the default settings. The default scoring matrix used by blastp, blastx, tblastn, and tblastx is the BLOSUM62 matrix (Henikoff et al., (1992) PROC. NATL. ACAD. SCI. USA 89:10915-10919). Four blastn parameters may be adjusted as follows: Q=10 (gap creation penalty); R=10 (gap extension penalty); wink=1 (generates word hits at every winkth position along the query); and gapw=16 (sets the window width within which gapped alignments are generated). The equivalent Blastp parameter settings may be Q=9; R=2; wink=1; and gapw=32. Searches may also be conducted using the NCBI (National Center for Biotechnology Information) BLAST Advanced Option parameter (e.g.:—G, Cost to open gap [Integer]: default=5 for nucleotides/11 for proteins;—E, Cost to extend gap [Integer]: default=2 for nucleotides/1 for proteins;—q. Penalty for nucleotide mismatch [Integer]: default=−3;—r, reward for nucleotide match [Integer]: default=1;—e, expect value [Real]: default=10;—W, wordsize [Integer]: default=11 for nucleotides/28 for megablast/3 for proteins;—y, Dropoff (X) for blast extensions in bits: default=20 for blastn/7 for others;—X. X dropoff value for gapped alignment (in bits): default=15 for all programs, not applicable to blastn; and—

Z, final X dropoff value for gapped alignment (in bits): 50 for blastn, 25 for others). A Bestfit comparison between sequences, available in the GCG package version 10.0, uses DNA parameters GAP=50 (gap creation penalty) and LEN=3 (gap extension penalty) and the equivalent settings in protein comparisons are GAP=8 and LEN=2.

In certain embodiments, contemplated bacterial strains may comprise a DNA-DNA hybridization (DDH)) value relative to a reference bacterial strain. Any method for determining DNA-DNA hybridization values known in the art may be used to assess the degree of DNA-DNA hybridization, including but not limited to the spectrophotometric method for determining renaturation rates described by De Ley et al. (*J Biochem* 12 133-142 (1970)), slightly modified in hybridization temperature (Gavini et al., *Ecology in Health and Disease* 12 40-45 (2001)); and those described by Grimont et al., *Curr Microbiol* 4, 325-330 (1980) and Rossello-Mora, *Molecular Identification, Systematics and Population Structure of Prokaryotes* pp. 23-50 (2006). In some embodiments, the degree of DNA-DNA hybridization is determined by digital DNA-DNA hybridization (dDDH) analysis, for example, using the Genome-to-Genome Distance Calculator online tool (see Meier-Kolthoff et al., *BMC Bioinformatics* 14:60 (2013)).

In certain embodiments, contemplated bacterial strains may comprise an average nucleotide identity (ANI) relative to a reference bacterial strain. The average nucleotide identity (ANI) of the shared genes between two strains is known to be a robust means to compare genetic relatedness among strains, and that ANI values of ~95% correspond to the 70% DNA-DNA hybridization standard for defining a species. See, e.g., Konstantinidis and Tiedje, *Proc Natl Acad Sci USA*, 102 (7): 2567-72 (2005); and Goris et al., *Int J Syst Evol Microbiol.* 57 (Pt 1): 81-91 (2007). The ANI between two bacterial genomes is calculated from pair-wise comparisons of all sequences shared between any two strains and can be determined, for example, using any of a number of publicly available ANI tools, including but not limited to OrthoANI with usearch (Yoon et al. *Antonie van Leeuwenhoek* 110:1281-1286 (2017)); ANI Calculator, JSpecies (Richter and Rossello-Mora, *Proc Natl Acad Sci USA* 106: 19126-19131 (2009)); and JSpeciesWS (Richter et al., *Bioinformatics* 32:929-931 (2016)). Other methods for determining the ANI of two genomes are known in the art. See, e.g., Konstantinidis, K. T. and Tiedje, J. M., *Proc. Natl. Acad. Sci. U.S.A.*, 102:2567-2572 (2005); and Varghese et al., *Nucleic Acids Research,* 43 (14): 6761-6771 (2015). In a particular embodiment, the ANI between two bacterial genomes can be determined, for example, by averaging the nucleotide identity of orthologous genes identified as bidirectional best hits (BBHs). Protein-coding genes of a first genome (Genome A) and second genome (Genome B) are compared at the nucleotide level using a similarity search tool, for example, NSimScan (Novichkov et al., *Bioinformatics* 32 (15): 2380-23811 (2016). The results are then filtered to retain only the BBHs that display at least 70% sequence identity over at least 70% of the length of the shorter sequence in each BBH pair. The ANI of Genome A to Genome B is defined as the sum of the percent identity times the alignment length for all BBHs, divided by the sum of the lengths of the BBH genes.

In certain embodiments, contemplated bacterial strains may comprise an alignment fraction (AF) relative to a reference bacterial strain. In some embodiments, the AF is computed by dividing the sum of the lengths of all BBH genes by the sum of the length of all the genes in Genome A. This computation is performed separately in both directions: from Genome A to genome B and from Genome B to Genome A.

In some embodiments, a contemplated bacterial strain or bacterial strain mixture (i) reduces or attenuates, or is capable of reducing or attenuating, production of at least one pro-inflammatory gene product, e.g., a pro-inflammatory cytokine or chemokine, in a cell, tissue, or subject; and/or (ii) increases, or is capable of increasing, production of at least one anti-inflammatory gene product, e.g., an anti-inflammatory cytokine or chemokine, in a cell, tissue, or subject. Exemplary pro-inflammatory gene products include IL-1-β, IL-4, IL-5, IL-6, IL-8, IL-12, IL-13, IL-17, IL-21, IL-22, IL-23, IL-27, IFN, CCL-2, CCL-3, CCL-5, CCL-20, CXCL-5, CXCL-10, CXCL-12, CXCL-13, and TNF-α. For example, in some embodiments, a bacterial strain or bacterial strain mixture reduces or attenuates production of IL-12, e.g., IL-12 subunit p40, in a cell, tissue, or subject. Exemplary anti-inflammatory gene products include CCL-18, IL-1Ra, IL-4, IL-6, IL-10, IL-11, IL-13, and TGF-β. For example, a contemplated bacterial strain or bacterial strain mixture increases production of IL-10 and/or CCL-18, in a cell, tissue, or subject. It is understood that a gene product may have both pro- and/or anti-inflammatory activity.

A contemplated bacterial strain or bacterial strain mixture may be characterized as having an effect on gene product production, e.g., IL-10, IL-12, or CCL-18 production, in an immune cell, e.g., a macrophage (e.g., a THP-1 macrophage) or PBMC (including lymphocytes (T cells, B cells, NK cells) and monocytes). In vivo, major sources of IL-10 include T helper cells, monocytes, macrophages and dendritic cells, however myriad immune effector cell types are capable of producing IL-10 in certain contexts including B cells, cytotoxic T cells, NK cells, mast cells, and granulocytes like neutrophils and eosinophils. Gene product production, e.g., IL-10. IL-12, or CCL-18, in a macrophage may, for example, be assayed as follows. THP-1 human macrophages are made by culturing the THP-1 human monocyte cell line with phorbol 12-myristate 13-acetate (PMA) for 24 hours, optionally followed by IL-4 and IL-13 as described previously (Genin et al., *BMC Cancer* 15:577 (2015)). A bacterial strain or bacterial strain mixture is incubated with THP-1 macrophages in the presence of lipopolysaccharide (LPS) for 24 hours. Gene product production is assessed by measuring the concentration of the gene product, e.g., IL-10, IL-12, or CCL-18, in the cell culture supernatant by ELISA. Gene product production may also be assayed as described in Sudhakaran et al., *Genes Nutr.,* 8 (6): 637-48 (2013). Gene product production, e.g., IL-10, IL-12, or CCL-18 production, in a PBMC may, for example, be assayed as follows. Primary PBMCs are isolated from blood samples of donors using a percoll gradient (Sim et al., *J. Vis. Exp.* (112), e54128 (2016)). A bacterial strain or bacterial strain mixture is incubated with PBMCs for 24 hours. Gene product production is assessed by measuring the concentration of the gene product, e.g., IL-10, IL-12, or CCL-18, in the cell culture supernatant by ELISA.

A contemplated bacterial strain or bacterial strain mixture may (i) reduce or prevent disruption to, or increase, or be capable of reducing or preventing disruption to, or increasing, the integrity of an epithelial barrier (e.g., an epithelial cell monolayer); and/or (ii) increase, or be capable of increasing, production of at least one pro-barrier integrity gene (e.g., ZO-1) in a cell, tissue, or subject. In some embodiments, the epithelial barrier is an intestinal barrier, e.g., an intestinal mucosal barrier. The intestinal epithelium is organized in a single layer of 20 μm, and includes 5 different cell types: enterocytes, endocrine cells, M cells, goblet (mucous) cells and Paneth cells. The enterocytes are the most represented cell type, acting as a physical barrier, inhibiting the translocation of luminal contents in the inner tissues. They are connected by intercellular junctions, characterized by transmembrane proteins that interact with near cells and with intracellular proteins associated with the cytoskeleton. Contemplated bacterial strains or bacterial strain mixtures may be characterized by an effect on the integrity of an epithelial barrier, e.g., a HT29MTX-E12 cell monolayer or a Caco-2 monolayer, or any intestinal epithelial cell or cell line monolayer. In certain embodiments, contemplated bacterial strains or bacterial strain mixtures may be characterized by an effect on barrier integrity of a human epithelial cell monolayer, e.g., a HT29MTX-E12 cell monolayer or a Caco-2 monolayer, treated with TNF-α. Barrier integrity of a HT29MTX-E12 cell monolayer treated with TNF-α may, for example, be assayed as follows. HT29MTX-E12 cells are seeded into a transwell plate system for 18-21 days to form polarized monolayers as described previously (Hall et al., *Journal of Pediatric Surgery* 48:353-358 (2013)). A bacterial strain or bacterial strain mixture is added to the apical layer of the transwell followed by the addition of TNF-α to the basal layer of the transwell, thus modeling an inflamed gut. The monolayer integrity is assessed by measuring the trans-epithelial electrical resistance (TEER) across the cell barrier at 0 and 24 hours after TNF-α addition. Barrier integrity may also be assayed as described in Pontier et al., J. Pharm. Sci., 90 (10): 1608-19 (2001).

In a particular embodiment, identification of a bacterial strain or bacterial strain mixture that reduces or prevents the disruption of the integrity of an epithelial barrier (e.g., an epithelial cell monolayer), or increases its integrity, identifies the bacterial strain or bacterial strain mixture as capable of reducing or preventing the disruption of, or increasing, the integrity of an intestinal barrier, e.g., an intestinal mucosal barrier. Thus, in another aspect, provided herein are methods of selecting a bacterial strain or bacterial strain mixture having gut barrier protective properties. Also provided herein are methods of selecting a bacterial strain or bacterial strain mixture for use in the treatment of gastrointestinal disorders, dysbiosis, and/or inflammatory disorders described herein. In some embodiments, the methods comprise the steps of: (a) contacting in vitro an epithelial cell monolayer with a bacterial strain or bacterial strain mixture; (b) contacting the epithelial cell monolayer with a pro-inflammatory compound in the presence of the bacterial strain or bacterial strain mixture; and (c) measuring the trans-epithelial electrical resistance (TEER) across the cell monolayer; wherein an increase in TEER across the cell monolayer compared to a cell monolayer (e.g., of the same cell type) contacted with the pro-inflammatory compound but not contacted with the bacterial strain or bacterial strain mixture identifies the bacterial strain or bacterial strain mixture as having gut barrier protective properties, and/or useful for the treatment of a gastrointestinal disorders, dysbiosis, and/or an inflammatory disorder. In some embodiments, the epithelial cell monolayer is a human epithelial cell monolayer. In some embodiments, the epithelial cell monolayer is a mucosal epithelial cell monolayer. In some embodiments, the epithelial cell monolayer is a HT29MTX-E12 cell monolayer or a Caco-2 cell monolayer. In some embodiments, the bacterial strain or bacterial strain mixture contacts the apical side of the epithelial cell monolayer. In some embodiments, the contacting of the epithelial cell monolayer with the bacterial strain or bacterial strain mixture occurs for at least 10, 20, 30, 40, 50, 60, 80, 100, 120, 140, 160, 180, 200, 220, 240 or greater than 240 minutes prior to the contacting of the epithelial cell layer with the pro-inflammatory compound. In some embodiments, the pro-inflammatory compound is selected from the group consisting of IL-1-β, IL-4, IL-5, IL-6, IL-8, IL-12, IL-13, IL-17, IL-21, IL-22, IL-23, IL-27, IFN, CCL-2, CCL-3, CCL-5, CCL-20, CXCL-5, CXCL-10, CXCL-12, CXCL-13, and TNF-α. In some embodiments, the measuring of the TEER across the cell monolayer occurs at 0, 1, 2, 3, 4, 5, 6, 7, 8, 9, 10, 11, 12, 13, 14, 15, 16, 17, 18, 19, 20, 21, 22, 23, 24 and/or greater than 24 hours after contacting the epithelial cell monolayer with the pro-inflammatory compound. In some embodiments, the increase in TEER across the cell monolayer is at least 5%, 10%, 20%, 25%, 30%, 35%, 40%, 45%, 50%, 55%, 60%, 65%, 70%, 75%, 80%, 85%, 90%, 95%, 100% or greater than 100% compared to a cell monolayer contacted with the pro-inflammatory compound but not contacted with the bacterial strain or bacterial strain mixture.

Contemplated bacterial strains or bacterial strain mixtures may induce or increase, or be capable of inducing or increasing, autophagy in a cell, e.g., an antigen presenting cell, epithelial cell, myeloid cell, enterocyte, macrophage (e.g., a THP-1 macrophage), PBMC (including lymphocytes (T cells, B cells, NK cells) and monocytes), dendritic cells, mast cells, and granulocytes like neutrophils and/or an eosinophils. Autophagy is an intracellular degradation system, where dysfunctional proteins and organelles are degraded. In this process, aggregated dysfunctional proteins are surrounded by a double membrane to form an autophagosome. Induction of autophagy in a cell, e.g., a THP-1 macrophage, may be assayed as follows. THP-1 human macrophages are made by culturing the THP-1 human monocyte cell line with phorbol 12-myristate 13-acetate (PMA) for 24 hours, optionally followed by IL-4 and IL-13 as described previously (Genin et al., *BMC Cancer* 15:577 (2015)). A bacterial strain or bacterial strain mixture is incubated with THP-1 macrophages in the presence of lipopolysaccharide (LPS) for at least 1, 2, 3 or more hours (for example, up to 24 hours). Autophagy can be assayed by detection of autophagosome formation, for example by staining cells with a fluorescent dye that accumulates in membranes specific to autophagosomes, such as the Cyto-ID® (Enzo Life Sciences) or DAPGreen (Dojindo Molecular Technologies, Inc.). Autophagy may also be detected by any method described by Puleston et al., Cold *Spring Harb Protoc*; doi: 10.1101/pdb.top070391.

Thus, in another aspect, provided herein are methods of selecting a bacterial strain or bacterial strain mixture for use in the treatment of gastrointestinal disorders, dysbiosis, and/or inflammatory disorders, the methods comprising the steps of: (a) contacting in vitro a cell with a bacterial strain or bacterial strain mixture; and (b) measuring autophagy in the cell; wherein an increase in autophagy in the cell compared to a cell (e.g., of the same cell type) not contacted with the bacterial strain or bacterial strain mixture identifies the bacterial strain or bacterial strain mixture as useful for the treatment of a gastrointestinal disorders, dysbiosis, and/or an inflammatory disorder. In some embodiments, the cell is a human cell. In some embodiments, the cell is an antigen presenting cell, epithelial cell, myeloid cell, enterocyte, macrophage (e.g., a THP-1 macrophage), PBMC (including lymphocytes (T cells, B cells, NK cells) and monocytes), dendritic cell, mast cell, or granulocyte (e.g., neutrophil or eosinophil). In some embodiments, the monocyte or macrophage is a THP-1 monocyte or macrophage. In some embodiments, the gastrointestinal disorder is inflammatory bowel disease, including ulcerative colitis and Crohn's disease. In some embodiments, the contacting occurs in the presence of lipopolysaccharide (LPS). In some embodiments, the contacting occurs for at least 1, 2, 3, 4, 5, 6, 7, 8, 9, 10, 11, 12, 13, 14, 15, 16, 17, 18, 19, 20, 21, 22, 23, 24 or greater than 24 hours prior to measuring autophagy.

Contemplated bacterial strains or bacterial strain mixtures may reduce or attenuate, or be capable of reducing or attenuating, production of Lipocalin-2/NGAL in a cell, tissue or subject. Lipocalin-2 (LCN2), also referred to as neutrophil gelatinase-associated lipocalin (NGAL) or siderocalin, is a potent bacteriostatic protein stored in neutrophil granules and released at sites of inflammation. High LCN2 expression by gut epithelial cells has been demonstrated in colonic biopsies from inflamed areas of patients with IBD (Nielsen et al., Gut, 38:414-420 (1996)), and LCN2 has been reported to be among the 10 most upregulated genes in both active ulcerative colitis and Crohn's disease (Ostvik et al., *Clin Exp Immunol.* 173:502-511 (2013)). Ostvik reported that although LCN2 protein was found in both epithelial cells and infiltrating neutrophils, LCN2 mRNA synthesis solely took place in epithelial cells indicating that the excessive de novo synthesis of LCN2 in IBD is localized in the colonic epithelium. Serum levels of LCN2 has been demonstrated to be a reliable biomarker of disease activity in UC, distinguishing active disease from disease in remission with a greater sensitivity than CRP or white blood cell count (Stallhofer et al., *Inflamm Bowel Dis* 21 (10): 2327-2340 (2015)). Levels of LCN2/NGAL can be assessed in a cell, tissue or subject contacted with a contemplated bacterial strain or bacterial strain mixture by measuring the expression and/or concentration of the LCN2/NGAL gene product in a sample, e.g., plasma, serum, stool and/or tissue (e.g., colonic tissue), by any method known in the art, including qPCR, ELISA, immunohistochemistry or the like.

As described below, cell bank preparation/vegetative bacterial strains contemplated herein may, e.g., be prepared for example without animal-derived components in the media used in the isolation and preparation of master cell banks.

A contemplated bacterial strain, for example, for use in a disclosed bacterial strain mixture, pharmaceutical composition or unit, or method, includes a *Bacteroides* species strain. Exemplary *Bacteroides* species include *B. acidifaciens, B. barnesiaes, B. caccae, B. caecicola, B. caecigallinarum, B. cellulosilyticus, B. cellulosolvens, B. clarus, B. coagulans, B. coprocola, B. coprophilus, B. coprosuis, B. distasonis, B. dorei, B. eggerthii, B. gracilis, B. faecichinchillae, B. faecis, B. finegoldii, B. fluxus, B. fragilis, B. galacturonicus, B. gallinaceum, B. gallinarum, B. goldsteinii, B. graminisolvens, B. helcogene, B. intestinalis, B. luti, B. massiliensis, B. melaninogenicus, B. nordii, B. oleiciplenus, B. oris, B. ovatus, B. paurosaccharolyticus, B. pectinophilus, B. plebeius, B. polypragmatus, B. propionicifaciens, B. putredinis, B. pyogenes, B. reticulotermitis, B. rodentium, B. salanitronis, B. salyersiae, B. sartorii, B. sediment B. stercoris, B. suis, B. tectus, B. thetaiotaomicron, B. uniformis, B. vulgatus, B. xylanisolvens*, and *B. xylanolyticusxylanolyticus*. Those of skill in the art will recognize that the genus *Bacteroides* may undergo taxonomical reorganization. Thus, it is intended that contemplated *Bacteroides* species include *Bacteroides* species that have been renamed and/or reclassified, as well as those that may be later renamed and/or reclassified.

In certain embodiments, a contemplated *Bacteroides* species strain is a *Bacteroides thetaiotaomicron* strain. For example, a contemplated *Bacteroides thetaiotaomicron* strain genome may comprise a 16s rRNA gene sequence having the nucleotide sequence of SEQ ID NO: 2, or a 16s rRNA gene sequence having at least about 70.0%, about 80.0%, about 90.0%, about 91.0%, about 92.0%, about 93.0%, about 94.0%, about 95.0%, about 96.0%, about 97.0%, about 98.0%, about 98.1%, about 98.2%, about 98.3%, about 98.4%, about 98.5%, about 98.6%. about 98.7%, about 98.8%, about 98.9%, about 99.0%, about 99.1%, about 99.2%, about 99.3%. about 99.4%, about 99.5%, about 99.6%, about 99.7%, about 99.8%, or about 99.9% identity to the nucleotide sequence of SEQ ID NO: 2. In some embodiments, the sequence identity referred to above is across at least about 70% of SEQ ID NO: 2. In other embodiments, the sequence identity referred to above is across at least about 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of SEQ ID NO: 2.

In some embodiments, a contemplated *Bacteroides thetaiotaomicron* strain comprises a genomic sequence (e.g., a whole genome sequence, or fragments or contigs thereof) having a certain % identity to one or more of SEQ ID NOs: 33-390. A contemplated *Bacteroides thetaiotaomicron* strain genome may comprise the nucleotide sequence of any one of SEQ ID NOs: 33-390, or a nucleotide sequence having at least about 65%, about 70%, about 75%, about 80%, about 85%, about 90%, about 91%, about 92%, about 93%, about 94%, about 95%, about 96%, about 97%, about 98%, or about 99% identity to the nucleotide sequence of any one of SEQ ID NOs: 33-390. A contemplated *Bacteroides thetaiotaomicron* strain genome may comprise the nucleotide sequence of each of SEQ ID NOs: 33-390, or each of a nucleotide sequence having at least about 65%, about 70%, about 75%, about 80%, about 85%, about 90%, about 91%, about 92%, about 93%, about 94%, about 95%, about 96%, about 97%, about 98%, or about 99% identity to the nucleotide sequence of each of SEQ ID NOs: 33-390.

In some embodiments, a contemplated *Bacteroides thetaiotaomicron* strain comprises a whole genomic sequence having at least about 70% identity across at least 70% of its genome to the sum of all genomic contigs represented by SEQ ID NOs: 33-390. In some embodiments, the whole genomic sequence has at least about 75%, 80%, 85%, 90%, 95% or greater than 95% identity to the sum of all genomic contigs represented by SEQ ID NOs: 33-390. In some embodiments, the sequence identity referred to above is across at least 75%, 80%, 85%, 90%, 95% or greater than 95% of the whole genomic sequence of the bacterial strain. In some embodiments, a contemplated *Bacteroides thetaiotaomicron* strain comprises a whole genomic sequence comprising coding regions having at least about 70% identity across at least 70% of the total coding regions in its genome to the coding regions within the sum of all genomic contigs represented by SEQ ID NOs: 33-390. In some embodiments, the coding regions within the whole genomic sequence have at least about 75%, 80%, 85%, 90%, 95% or greater than 95% identity to the coding regions within the sum of all genomic contigs represented by SEQ ID NOs: 33-390. In some embodiments, the sequence identity referred to above is across at least 75%, 80%, 85%, 90%, 95% or greater than 95% of the coding regions within the whole genomic sequence of the bacterial strain.

In certain embodiments, a contemplated *Bacteroides* species strain, e.g., a *Bacteroides thetaiotaomicron* strain, increases, or is capable of increasing, production of at least one anti-inflammatory gene product in a cell, tissue, or subject. For example, a contemplated *Bacteroides* species strain, e.g., a *Bacteroides thetaiotaomicron* strain, increases production of IL-10 and/or CCL-18 in a human cell, e.g., a THP-1 macrophage or monocyte or a PBMC. For example, contacting a human cell, e.g., a THP-1 macrophage or PBMC, with the *Bacteroides* species strain, e.g., a *Bacteroides thetaiotaomicron* strain, may increase production of IL-10 and/or CCL-18 in the cell by at least about 10%, at least about 20%, at least about 30%, at least about 40%, at least about 50%, at least about 75%, at least about 100%, at least about 200%, at least about 300%, at least about 400%, at least about 500%, at least about 750%, at least about 1000%, from about 10% to about 20%, from about 10% to about 50%, from about 10% to about 100%, from about 10% to about 200%, from about 10% to about 500%, from about 10% to about 1000%, from about 20% to about 50%, from about 20% to about 100%, from about 20% to about 200%, from about 20% to about 500%, from about 20% to about 1000%, from about 50% to about 100%, from about 50% to about 200%, from about 50% to about 500%, from about 50% to about 1000%, from about 100% to about 200%, from about 100% to about 500%, from about 100% to about 1000%, from about 200% to about 500%, from about 200% to about 1000%, or from about 500% to about 1000%, relative to a cell (e.g., of the same cell type) that was not contacted with the strain. In some embodiments, the contacting of the human cell with the *Bacteroides* species strain occurs in vitro, e.g., the human cell is incubated with the *Bacteroides* species strain. In some embodiments, the contacting of the human cell with the *Bacteroides* species strain occurs in vivo.

In certain embodiments, a contemplated *Bacteroides* species strain, e.g., a *Bacteroides thetaiotaomicron* strain, reduces or attenuates, or is capable of reducing or attenuating, production of at least one pro-inflammatory gene product in a cell, tissue, or subject. For example, a contemplated *Bacteroides* species strain, e.g., a *Bacteroides thetaiotaomicron* strain, reduces or attenuates production of IL-6, IL-12, IL-17 and/or TNF-α in a human cell, e.g., a THP-1 macrophage or monocyte or a PBMC. For example, contacting a human cell, e.g., a THP-1 macrophage or PBMC, with the *Bacteroides* species strain, e.g., a *Bacteroides thetaiotaomicron* strain, may reduce or attenuate production of IL-6, IL-12, IL-17 and/or TNF-α in the cell by at least about 10%, at least about 20%, at least about 30%, at least about 40%, at least about 50%, at least about 75%, from about 10% to about 20%, from about 10% to about 50%, from about 10% to about 100%, from about 20% to about 50%, from about 20% to about 100%, or from about 50% to about 100%, relative to a cell (e.g., of the same cell type) that was not contacted with the strain. In some embodiments, the contacting of the human cell with the *Bacteroides* species strain occurs in vitro, e.g., the human cell is incubated with the *Bacteroides* species strain. In some embodiments, the contacting of the human cell with the *Bacteroides* species strain occurs in vivo.

In certain embodiments, a contemplated *Bacteroides* species strain, e.g., a *Bacteroides thetaiotaomicron* strain, reduces or prevents disruption to, or increases, or is capable of reducing or preventing disruption to, or increasing, barrier integrity of a mucosal epithelium. For example, a contemplated *Bacteroides* species strain, e.g., a *Bacteroides thetaiotaomicron* strain, may reduce or prevent disruption of, or increase, barrier integrity of a HT29MTX-E12 cell monolayer, e.g., a HT29MTX-E12 cell monolayer treated with TNF-α. For example, incubation of a contemplated *Bacteroides* species strain, e.g., a *Bacteroides thetaiotaomicron* strain, with a HT29MTX-E12 cell monolayer, e.g., a HT29MTX-E12 cell monolayer treated with TNF-α, may reduce or prevent disruption of, or increase, barrier integrity, e.g., as measured by trans-epithelial electrical resistance (TEER), by at least about 10%, at least about 20%, at least about 30%, at least about 40%, at least about 50%, at least about 60%, at least about 70%, at least about 80%, at least about 90%, at least about 100%, from about 20% to about 100%, from about 40% to about 100%, from about 60% to about 100%, from about 80% to about 100%, from about 20% to about 80%, from about 40% to about 80%, from about 60% to about 80%, from about 20% to about 60%, from about 40% to about 60%, or from about 20% to about 40%, relative to a HT29MTX-E12 cell monolayer that was not incubated with a contemplated strain.

In certain embodiments, a contemplated *Bacteroides* species strain, e.g., a *Bacteroides thetaiotaomicron* strain, induces or increases, or is capable of inducing or increasing, autophagy in a cell, tissue, or subject. For example, a contemplated *Bacteroides* species strain, e.g., a *Bacteroides thetaiotaomicron* strain, induces or increases autophagy in a human cell, e.g., a THP-1 macrophage. For example, contacting a human cell, e.g., a THP-1 macrophage, with the *Bacteroides* species strain, e.g., a *Bacteroides thetaiotaomicron* strain, may induce or increase autophagy in the cell by at least about 10%, at least about 20%, at least about 30%, at least about 40%, at least about 50%, at least about 60%, at least about 70%, at least about 80%, at least about 90%, at least about 100%, from about 10% to about 20%, from about 10% to about 50%, from about 10% to about 100%, from about 20% to about 50%, from about 20% to about 100%, from about 20% to about 200%, from about 50% to about 100%, or from about 50% to about 200%, relative to a cell (e.g., of the same cell type) that was not contacted with the strain. In some embodiments, the contacting of the human cell with the *Bacteroides* species strain occurs in vitro, e.g., the human cell is incubated with the *Bacteroides* species strain. In some embodiments, the contacting of the human cell with the *Bacteroides* species strain occurs in vivo.

In certain embodiments, a contemplated *Bacteroides* species strain, e.g., a *Bacteroides thetaiotaomicron* strain, reduces or attenuates, or is capable of reducing or attenuating, production of Lipocalin-2/NGAL in a cell, tissue, or subject. For example, contacting a human cell with a *Bacteroides* species strain, e.g., a *Bacteroides thetaiotaomicron* strain may reduce or attenuate production of Lipocalin-2/NGAL in the cell by at least about 10%, at least about 20%, at least about 30%, at least about 40%, at least about 50%, at least about 75%, from about 10% to about 20%, from about 10% to about 50%, from about 10% to about 100%, from about 20% to about 50%, from about 20% to about 100%, or from about 50% to about 100%, relative to a cell (e.g., of the same cell type) that was not contacted with the strain. In some embodiments, the contacting of the human cell with the *Bacteroides* species strain occurs in vitro, e.g., the human cell is incubated with the *Bacteroides* species strain. In some embodiments, the contacting of the human cell with the *Bacteroides* species strain occurs in vivo.

In certain embodiments, a contemplated *Bacteroides thetaiotaomicron* strain is the strain identified herein as BTH01. A deposit of *Bacteroides thetaiotaomicron* strain BTH01 (P118-A12a) was made to DSMZ (Deutsche Sammlung von Mikroorganismen and Zellkulturen GmbH, Inhoffenstraße 7B, 38124 Brunswick, Germany) under the Budapest Treaty on the International Recognition of the Deposit of Microorganisms for the Purposes of Patent Procedure on Sep. 14, 2018. This deposit was accorded accession number DSM-32919. The 16s rRNA gene sequence of *Bacteroides thetaiotaomicron* strain BTH01 is provided herein as SEQ ID NO: 2, and genomic sequences of *Bacteroides thetaiotaomicron* strain BTH01 are provided herein as SEQ ID NOs: 33-390.

In certain embodiments, a contemplated *Bacteroides thetaiotaomicron* strain has a DNA-DNA hybridization (DDH) value of equal to or greater than about 70% with *Bacteroides thetaiotaomicron* strain BTH01 (P118-A12a). In certain embodiments, the *Bacteroides thetaiotaomicron* strain is one having greater than about 70%, about 75%, about 80%, about 85%, about 90%, about 95%, about 98% or about 99% DNA-DNA hybridization with *Bacteroides thetaiotaomicron* strain BTH01 (P118-A12a). In certain embodiments, a contemplated *Bacteroides thetaiotaomicron* strain has equal to or greater than 95% average nucleotide identity (ANI) with *Bacteroides thetaiotaomicron* strain BTH01 (P118-A12a). In certain embodiments, the ANI is equal to or greater than about 95%, about 95.5%, about 96%, about 96.5%, about 97%, about 97.5%, about 98%, about 98.5%, about 99%, about 99.5%, or 100%. In certain embodiments, a contemplated *Bacteroides thetaiotaomicron* strain has equal to or greater than 60% alignment fraction (AF) with *Bacteroides thetaiotaomicron* strain BTH01 (P118-A12a). In certain embodiments, the AF is equal to or greater than about 65%, about 70%, about 75%, about 80%, about 85%, about 90%, about 95%, or 100%.

A contemplated bacterial strain, for example, for use in a disclosed bacterial strain mixture, pharmaceutical composition or unit, or method, includes a *Eubacterium* species strain. Exemplary *Eubacterium* species include *E. aggregans, E. angustum, E. barkeri, E. brachy, E. budayi, E. callanderi, E. cellulosolvens, E. combesii, E. coprostanoligenes, E. dolichum, E. eligens, E. hallii, E. infirmum, E. limosum, E. minutum, E. multiforme, E. nitritogenes, E. nodatum, E. oxidoreducens, E. plexicaudatum, E. pyruvativorans, E. ramulus, E. rectale, E. ruminantium, E. saphenum, E. siraeum, E. sulci, E. tarantellae, E. tenue, E. tortuosum, E. uniforme, E. ventriosum, E. xylanophilum*, and *E. yurii*. Those of skill in the art will recognize that the genus *Eubacterium* may undergo taxonomical reorganization. Thus, it is intended that a contemplated *Eubacterium* species include *Eubacterium* species that have been renamed and/or reclassified, as well as those that may be later renamed and/or reclassified. For example, contemplated strains of *Eubacterium hallii* includes those reclassified as *Anaerobutyricum hallii* (Shetty et al., *Int J Syst Evol Microbiol.* 68:3741-3746 (2018)).

In certain embodiments, a contemplated *Eubacterium* species strain is a *Eubacterium hallii* strain. For example, a contemplated *Eubacterium hallii* strain genome may comprise a 16s rRNA gene sequence having the nucleotide sequence of SEQ ID NO: 3, or a 16s rRNA gene sequence having at least about 70.0%, about 80.0%, about 90.0%, about 91.0%, about 92.0%, about 93.0%, about 94.0%, about 95.0%, about 96.0%, about 97.0%, about 98.0%, about 98.1%, about 98.2%, about 98.3%, about 98.4%, about 98.5%, about 98.6%, about 98.7%, about 98.8%, about 98.9%, about 99.0%, about 99.1%, about 99.2%, about 99.3%, about 99.4%, about 99.5%, about 99.6%, about 99.7%, about 99.8%, or about 99.9% identity to the nucleotide sequence of SEQ ID NO: 3. In some embodiments, the sequence identity referred to above is across at least about 70% of SEQ ID NO: 3. In other embodiments, the sequence identity referred to above is across at least about 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of SEQ ID NO: 3.

In some embodiments, a contemplated *Eubacterium hallii* strain comprises a genomic sequence (e.g., a whole genome sequence, or fragments or contigs thereof) having a certain % identity to one or more of SEQ ID NOs: 391-523. A contemplated *Eubacterium hallii* strain genome may comprise the nucleotide sequence of any one of SEQ ID NOs: 391-523, or a nucleotide sequence having at least about 65%, about 70%, about 75%, about 80%, about 85%, about 90%, about 91%, about 92%, about 93%, about 94%, about 95%, about 96%, about 97%, about 98%, or about 99% identity to the nucleotide sequence of any one of SEQ ID NOs: 391-523. A contemplated *Eubacterium hallii* strain genome may comprise the nucleotide sequence of each of SEQ ID NOs: 391-523, or each of a nucleotide sequence having at least about 65%, about 70%, about 75%, about 80%, about 85%, about 90%, about 91%, about 92%, about 93%, about 94%, about 95%, about 96%, about 97%, about 98%, or about 99% identity to the nucleotide sequence of each of SEQ ID NOs: 391-523.

In some embodiments, a contemplated *Eubacterium hallii* strain comprises a whole genomic sequence having at least about 70% identity across at least 70% of its genome to the sum of all genomic contigs represented by SEQ ID NOs: 391-523. In some embodiments, the whole genomic sequence has at least about 75%, 80%, 85%, 90%, 95% or greater than 95% identity to the sum of all genomic contigs represented by SEQ ID NOs: 391-523. In some embodiments, the sequence identity referred to above is across at least 75%, 80%, 85%, 90%, 95% or greater than 95% of the whole genomic sequence of the bacterial strain. In some embodiments, a contemplated *Eubacterium hallii* strain comprises a whole genomic sequence comprising coding regions having at least about 70% identity across at least 70% of the total coding regions in its genome to the coding regions within the sum of all genomic contigs represented by SEQ ID NOs: 391-523. In some embodiments, the coding regions within the whole genomic sequence have at least about 75%, 80%, 85%, 90%, 95% or greater than 95% identity to the coding regions within the sum of all genomic contigs represented by SEQ ID NOS: 391-523. In some embodiments, the sequence identity referred to above is across at least 75%, 80%, 85%, 90%, 95% or greater than 95% of the coding regions within the whole genomic sequence of the bacterial strain.

In certain embodiments, a contemplated *Eubacterium* species strain, e.g., a *Eubacterium hallii* strain, increases, or is capable of increasing, production of at least one anti-inflammatory gene product in a cell, tissue, or subject. For example, a contemplated *Eubacterium* species strain, e.g., a *Eubacterium hallii* strain, increases production of IL-10 and/or CCL-18 in a human cell, e.g., a THP-1 macrophage or monocyte or a PBMC. For example, contacting a human cell, e.g., a THP-1 macrophage or a PBMC, with the *Eubacterium* species strain, e.g., a *Eubacterium hallii* strain, may increase production of IL-10 and/or CCL-18 in the cell by at least about 10%, at least about 20%, at least about 30%, at least about 40%, at least about 50%, at least about 75%, at least about 100%, at least about 200%, at least about 300%, at least about 400%, at least about 500%, at least about 750%, at least about 1000%, from about 10% to about 20%, from about 10% to about 50%, from about 10% to about 100%, from about 10% to about 200%, from about 10% to about 500%, from about 10% to about 1000%, from about 20% to about 50%, from about 20% to about 100%, from about 20% to about 200%, from about 20% to about 500%, from about 20% to about 1000%, from about 50% to about 100%, from about 50% to about 200%, from about 50% to about 500%, from about 50% to about 1000%, from about 100% to about 200%, from about 100% to about 500%, from about 100% to about 1000%, from about 200% to about 500%, from about 200% to about 1000%, or from about 500% to about 1000%, relative to a cell (e.g., of the same cell type) that was not contacted with the strain. In some embodiments, the contacting of the human cell with the *Eubacterium* species strain occurs in vitro, e.g., the human cell is incubated with the *Eubacterium* species strain. In some embodiments, the contacting of the human cell with the *Eubacterium* species strain occurs in vivo.

In certain embodiments, a contemplated *Eubacterium* species strain, e.g., a *Eubacterium hallii* strain, reduces or attenuates, or is capable of reducing or attenuating, production of at least one pro-inflammatory gene product in a cell, tissue, or subject. For example, a contemplated *Eubacterium* species strain, e.g., a *Eubacterium hallii* strain, reduces or attenuates production of IL-6, IL-12, IL-17 and/or TNF-α in a human cell, e.g., a THP-1 macrophage or monocyte or a PBMC. For example, contacting a human cell, e.g., a THP-1 macrophage or PBMC, with the *Eubacterium* species strain, e.g., a *Eubacterium hallii* strain, may reduce or attenuate production of IL-6, IL-12, IL-17 and/or TNF-α in the cell by at least about 10%, at least about 20%, at least about 30%, at least about 40%, at least about 50%, at least about 75%, from about 10% to about 20%, from about 10% to about 50%, from about 10% to about 100%, from about 20% to about 50%, from about 20% to about 100%, or from about 50% to about 100%, relative to a cell (e.g. of the same cell type) that was not contacted with the strain. In some embodiments, the contacting of the human cell with the *Eubacterium* species strain occurs in vitro, e.g., the human cell is incubated with the *Eubacterium* species strain. In some embodiments, the contacting of the human cell with the *Eubacterium* species strain occurs in vivo.

In certain embodiments, a contemplated *Eubacterium* species strain, e.g., a *Eubacterium hallii* strain, reduces or prevents disruption to, or increases, or is capable of reducing or preventing disruption to, or increasing, barrier integrity of a mucosal epithelium. For example, a contemplated *Eubacterium* species strain, e.g., a *Eubacterium hallii* strain, reduces or prevents disruption of, or increases, barrier integrity of a HT29MTX-E12 cell monolayer, e.g., a HT29MTX-E12 cell monolayer treated with TNF-α. For example, incubation of a *Eubacterium* species strain, e.g., a *Eubacterium hallii* strain, with a HT29MTX-E12 cell monolayer, e.g., a HT29MTX-E12 cell monolayer treated with TNF-α, may reduce or prevent disruption of, or increase, barrier integrity, e.g., as measured by trans-epithelial electrical resistance (TEER), by at least about 10%, at least about 20%, at least about 30%, at least about 40%, at least about 50%, at least about 60%, at least about 70%, at least about 80%, at least about 90%, at least about 100%, from about 20% to about 100%, from about 40% to about 100%, from about 60% to about 100%, from about 80% to about 100%, from about 20% to about 80%, from about 40% to about 80%, from about 60% to about 80%, from about 20% to about 60%, from about 40% to about 60%, or from about 20% to about 40%, relative to a HT29MTX-E12 cell monolayer that was not incubated with the strain.

In certain embodiments, a contemplated *Eubacterium* species strain, e.g., a *Eubacterium hallii* strain, induces or increases, or is capable of inducing or increasing, autophagy in a cell, tissue, or subject. For example, a contemplated *Eubacterium* species strain, e.g., a *Eubacterium hallii* strain, induces or increases autophagy in a human cell, e.g., a THP-1 macrophage. For example, contacting a human cell, e.g., a THP-1 macrophage, with the *Eubacterium* species strain, e.g., a *Eubacterium hallii* strain, may induce or increase autophagy in the cell by at least about 10%, at least about 20%, at least about 30%, at least about 40%, at least about 50%, at least about 60%, at least about 70%, at least about 80%, at least about 90%, at least about 100%, from about 10% to about 20%, from about 10% to about 50%, from about 10% to about 100%, from about 20% to about 50%, from about 20% to about 100%, from about 20% to about 200%, from about 50% to about 100%, or from about 50% to about 200%, relative to a cell (e.g., of the same cell type) that was not contacted with the strain. In some embodiments, the contacting of the human cell with the *Eubacterium* species strain occurs in vitro, e.g., the human cell is incubated with the *Eubacterium* species strain. In some embodiments, the contacting of the human cell with the *Eubacterium* species strain occurs in vivo.

In certain embodiments, a contemplated *Eubacterium* species strain, e.g., a *Eubacterium hallii* strain, reduces or attenuates, or is capable of reducing or attenuating, production of Lipocalin-2/NGAL in a cell, tissue, or subject. For example, contacting a human cell with a *Eubacterium* species, e.g., a *Eubacterium hallii* strain may reduce or attenuate production of Lipocalin-2/NGAL in the cell by at least about 10%, at least about 20%, at least about 30%, at least about 40%, at least about 50%, at least about 75%, from about 10% to about 20%, from about 10% to about 50%, from about 10% to about 100%, from about 20% to about 50%, from about 20% to about 100%, or from about 50% to about 100%, relative to a cell (e.g., of the same cell type) that was not contacted with the strain. In some embodiments, the contacting of the human cell with the *Eubacterium* species strain occurs in vitro, e.g., the human cell is incubated with the *Eubacterium* species strain. In some embodiments, the contacting of the human cell with the *Bacteroides* species strain occurs in vivo.

In certain embodiments, a contemplated *Eubacterium hallii* strain is the strain identified herein as EHA01. A deposit of *Eubacterium hallii* strain EHA01 (P168-Fla) was made to DSMZ (Deutsche Sammlung von Mikroorganismen and Zellkulturen GmbH, Inhoffenstraße 7B, 38124 Brunswick, Germany) under the Budapest Treaty on the International Recognition of the Deposit of Microorganisms for the Purposes of Patent Procedure on Sep. 14, 2018. This deposit was accorded accession number DSM-32920. The 16s rRNA gene sequence of *Eubacterium hallii* strain EHA01 is provided herein as SEQ ID NO: 3, and genomic sequences of *Eubacterium hallii* strain EHA01 are provided herein as SEQ ID NOs: 391-523.

In certain embodiments, a contemplated *Eubacterium hallii* strain has a DNA-DNA hybridization (DDH) value of equal to or greater than about 70% with *Eubacterium hallii* strain EHA01 (P168-Fla). In certain embodiments, the *Eubacterium hallii* strain is one having greater than about 70%, about 75%, about 80%, about 85%, about 90%, about 95%, about 98% or about 99% DNA-DNA hybridization with *Eubacterium hallii* strain EHA01 (P168-Fla). In certain embodiments, a contemplated *Eubacterium hallii* strain has equal to or greater than 95% average nucleotide identity (ANI) with *Eubacterium hallii* strain EHA01 (P168-Fla). In certain embodiments, the ANI is equal to or greater than about 95%, about 95.5%, about 96%, about 96.5%, about 97%, about 97.5%, about 98%, about 98.5%, about 99%, about 99.5%, or 100%. In certain embodiments, a contemplated *Eubacterium hallii* strain has equal to or greater than 60% alignment fraction (AF) with *Eubacterium hallii* strain EHA01 (P168-Fla). In certain embodiments, the AF is equal to or greater than about 65%, about 70%, about 75%, about 80%, about 85%, about 90%, about 95%, or 100%.

A contemplated bacterial strain, for example, for use in a disclosed bacterial strain mixture, pharmaceutical composition or unit, or method, includes a *Roseburia* species strain. Exemplary *Roseburia* species include *R. cecicola, R. faecis, R. hominis, R. intestinalis,* and *R. inulinivorans*. Those of skill in the art will recognize that the genus *Roseburia* may undergo taxonomical reorganization. Thus, it is intended that a contemplated *Roseburia* species include *Roseburia* species that have been renamed and/or reclassified, as well as those that may be later renamed and/or reclassified.

In certain embodiments, a contemplated *Roseburia* species strain is a *Roseburia hominis* strain. For example, a contemplated *Roseburia hominis* strain genome may comprise a 16s rRNA gene sequence having the nucleotide sequence of SEQ ID NO: 1, or a 16s rRNA gene sequence having at least about 70.0%, about 80.0%, about 90.0%, about 91.0%, about 92.0%, about 93.0%, about 94.0%, about 95.0%, about 96.0%, about 97.0%, about 98.0%, about 98.1%, about 98.2%, about 98.3%, about 98.4%, about 98.5%, about 98.6%, about 98.7%, about 98.8%, about 98.9%, about 99.0%, about 99.1%, about 99.2%, about 99.3%, about 99.4%, about 99.5%, about 99.6%, about 99.7%, about 99.8%, or about 99.9% identity to the nucleotide sequence of SEQ ID NO: 1. In some embodiments, the sequence identity referred to above is across at least about 70% of SEQ ID NO: 1. In other embodiments, the sequence identity referred to above is across at least about 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of SEQ ID NO: 1.

In some embodiments, a contemplated *Roseburia hominis* strain comprises a genomic sequence (e.g., a whole genome sequence, or fragments or contigs thereof) having a certain % identity to one or more of SEQ ID NOs: 4-32. A contemplated *Roseburia hominis* strain genome may comprise the nucleotide sequence of any one of SEQ ID NOs: 4-32, or a nucleotide sequence having at least about 65%, about 70%, about 75%, about 80%, about 85%, about 90%, about 91%, about 92%, about 93%, about 94%, about 95%, about 96%, about 97%, about 98%, or about 99% identity to the nucleotide sequence of any one of SEQ ID NOs: 4-32. A contemplated *Roseburia hominis* strain genome may comprise the nucleotide sequence of each of SEQ ID NOs: 4-32, or each of a nucleotide sequence having at least about 65%, about 70%, about 75%, about 80%, about 85%, about 90%, about 91%, about 92%, about 93%, about 94%, about 95%, about 96%, about 97%, about 98%, or about 99% identity to the nucleotide sequence of each of SEQ ID NOs: 4-32.

In some embodiments, a contemplated *Roseburia hominis* strain comprises a whole genomic sequence having at least about 70% identity across at least 70% of its genome to the sum of all genomic contigs represented by SEQ ID NOs: 4-32. In some embodiments, the whole genomic sequence has at least about 75%, 80%, 85%, 90%, 95% or greater than 95% identity to the sum of all genomic contigs represented by SEQ ID NOs: 4-32. In some embodiments, the sequence identity referred to above is across at least 75%, 80%, 85%, 90%, 95% or greater than 95% of the whole genomic sequence of the bacterial strain. In some embodiments, a contemplated *Roseburia hominis* strain comprises a whole genomic sequence comprising coding regions having at least about 70% identity across at least 70% of the total coding regions in its genome to the coding regions within the sum of all genomic contigs represented by SEQ ID NOs: 4-32. In some embodiments, the coding regions within the whole genomic sequence have at least about 75%, 80%, 85%, 90%, 95% or greater than 95% identity to the coding regions within the sum of all genomic contigs represented by SEQ ID NOs: 4-32. In some embodiments, the sequence identity referred to above is across at least 75%, 80%, 85%, 90%, 95% or greater than 95% of the coding regions within the whole genomic sequence of the bacterial strain.

In certain embodiments, a contemplated *Roseburia* species strain, e.g., a *Roseburia hominis* strain, increases, or is capable of increasing, production of at least one anti-inflammatory gene product in a cell, tissue, or subject. For example, a contemplated *Roseburia* species strain, e.g., a *Roseburia hominis* strain, increases production of IL-10 and/or CCL-18 in a human cell, e.g., a THP-1 macrophage or monocyte or a PBMC. For example, contacting a human cell, e.g., a THP-1 macrophage or PBMC, with the *Roseburia* species strain, e.g., a *Roseburia hominis* strain, may increase production of IL-10 and/or CCL-18 in the cell by at least about 10%, at least about 20%, at least about 30%, at least about 40%, at least about 50%, at least about 75%, at least about 100%, at least about 200%, at least about 300%, at least about 400%, at least about 500%, at least about 750%, at least about 1000%, from about 10% to about 20%, from about 10% to about 50%, from about 10% to about 100%, from about 10% to about 200%, from about 10% to about 500%, from about 10% to about 1000%, from about 20% to about 50%, from about 20% to about 100%, from about 20% to about 200%, from about 20% to about 500%, from about 20% to about 1000%, from about 50% to about 100%, from about 50% to about 200%, from about 50% to about 500%, from about 50% to about 1000%, from about 100% to about 200%, from about 100% to about 500%, from about 100% to about 1000%, from about 200% to about 500%, from about 200% to about 1000%, or from about 500% to about 1000%, relative to a cell (e.g., of the same cell type) that was not contacted with the strain. In some embodiments, the contacting of the human cell with the *Roseburia* species strain occurs in vitro, e.g., the human cell is incubated with the *Roseburia* species strain. In some embodiments, the contacting of the human cell with the *Roseburia* species strain occurs in vivo.

In certain embodiments, a contemplated *Roseburia* species strain, e.g., a *Roseburia hominis* strain, reduces or attenuates, or is capable of reducing or attenuating, production of at least one pro-inflammatory gene product in a cell, tissue, or subject. For example, a contemplated *Roseburia* species strain, e.g., a *Roseburia hominis* strain, reduces or attenuates production of IL-6, IL-12, IL-17 and/or TNF-α in a human cell, e.g., a THP-1 macrophage or monocyte or a PBMC. For example, contacting a human cell, e.g., a THP-1 macrophage or PBMC, with the *Roseburia* species strain, e.g., a *Roseburia hominis* strain, may reduce or attenuate production of IL-6, IL-12, IL-17 and/or TNF-α in the cell by at least about 10%, at least about 20%, at least about 30%, at least about 40%, at least about 50%, at least about 75%, from about 10% to about 20%, from about 10% to about 50%, from about 10% to about 100%, from about 20% to about 50%, from about 20% to about 100%, or from about 50% to about 100%, relative to a cell (e.g., of the same cell type) that was not contacted with the strain. In some embodiments, the contacting of the human cell with the *Roseburia* species strain occurs in vitro, e.g., the human cell is incubated with the *Roseburia* species strain. In some embodiments, the contacting of the human cell with the *Roseburia* species strain occurs in vivo.

In certain embodiments, a contemplated *Roseburia* species strain, e.g., a *Roseburia hominis* strain, reduces or prevents disruption to, or increases, or is capable of reducing or preventing disruption to, or increasing, barrier integrity of a mucosal epithelium. For example, a contemplated *Roseburia* species strain, e.g., a *Roseburia hominis* strain, reduces or prevents disruption to, or increases, barrier integrity of a HT29MTX-E12 cell monolayer, e.g., a HT29MTX-E12 cell monolayer treated with TNF-α. For example, incubation of a *Roseburia* species strain, e.g., a *Roseburia hominis* strain, with a HT29MTX-E12 cell monolayer, e.g., a HT29MTX-E12 cell monolayer treated with TNF-α, may reduce or prevent disruption to, or increase, barrier integrity, e.g., as measured by trans-epithelial electrical resistance (TEER), by at least about 10%, at least about 20%, at least about 30%, at least about 40%, at least about 50%, at least about 60%, at least about 70%, at least about 80%, at least about 90%, at least about 100%, from about 20% to about 100%, from about 40% to about 100%, from about 60% to about 100%, from about 80% to about 100%, from about 20% to about 80%, from about 40% to about 80%, from about 60% to about 80%, from about 20% to about 60%, from about 40% to about 60%, or from about 20% to about 40%, relative to a HT29MTX-E12 cell monolayer that was not incubated with the strain.

In certain embodiments, a contemplated *Roseburia* species strain, e.g., a *Roseburia hominis* strain, induces or increases, or is capable of inducing or increasing, autophagy in a cell, tissue, or subject. For example, a contemplated *Roseburia* species strain, e.g., a *Roseburia hominis* strain, induces or increases autophagy in a human cell, e.g., a THP-1 macrophage. For example, contacting a human cell, e.g., a THP-1 macrophage, with the *Roseburia* species strain, e.g., a *Roseburia hominis* strain, may induce or increase autophagy in the cell by at least about 10%, at least about 20%, at least about 30%, at least about 40%, at least about 50%, at least about 60%, at least about 70%, at least about 80%, at least about 90%, at least about 100%, from about 10% to about 20%, from about 10% to about 50%, from about 10% to about 100%, from about 20% to about 50%, from about 20% to about 100%, from about 20% to about 200%, from about 50% to about 100%, or from about 50% to about 200%, relative to a cell (e.g., of the same cell type) that was not contacted with the strain. In some embodiments, the contacting of the human cell with the *Roseburia* species strain occurs in vitro, e.g., the human cell is incubated with the *Roseburia* species strain. In some embodiments, the contacting of the human cell with the *Roseburia* species strain occurs in vivo.

In certain embodiments, a contemplated *Roseburia* species strain, e.g., a *Roseburia hominis* strain, reduces or attenuates, or is capable of reducing or attenuating, production of Lipocalin-2/NGAL in a cell, tissue, or subject. For example, contacting a human cell with a *Roseburia* species strain, e.g., a *Roseburia hominis* strain may reduce or attenuate production of Lipocalin-2/NGAL in the cell by at least about 10%, at least about 20%, at least about 30%, at least about 40%, at least about 50%, at least about 75%, from about 10% to about 20%, from about 10% to about 50%, from about 10% to about 100%, from about 20% to about 50%, from about 20% to about 100%, or from about 50% to about 100%, relative to a cell (e.g., of the same cell type) that was not contacted with the strain. In some embodiments, the contacting of the human cell with the *Roseburia* species strain occurs in vitro, e.g., the human cell is incubated with the *Roseburia* species strain. In some embodiments, the contacting of the human cell with the *Bacteroides* species strain occurs in vivo.

In certain embodiments, a contemplated *Roseburia hominis* strain is the strain identified herein as RHO01. A deposit of *Roseburia hominis* strain RHO01 (P127-H9a) was made to DSMZ (Deutsche Sammlung von Mikroorganismen and Zellkulturen GmbH, Inhoffenstraße 7B, 38124 Brunswick, Germany) under the Budapest Treaty on the International Recognition of the Deposit of Microorganisms for the Purposes of Patent Procedure on Sep. 14, 2018. This deposit was accorded accession number DSM-32921. The 16s rRNA gene sequence of *Roseburia hominis* strain RHO01 is provided herein as SEQ ID NO: 1, and genomic sequences of *Roseburia hominis* strain RHO01 are provided herein as SEQ ID NOs: 4-32.

In certain embodiments, a contemplated *Roseburia hominis* strain has a DNA-DNA hybridization (DDH) value of equal to or greater than about 70% with *Roseburia hominis* strain RHO01 (P127-H9a). In certain embodiments, the *Roseburia hominis* strain is one having greater than about 70%, about 75%, about 80%, about 85%, about 90%, about 95%, about 98% or about 99% DNA-DNA hybridization with *Roseburia hominis* strain RHO01 (P127-H9a). In certain embodiments, a contemplated *Roseburia hominis* strain has equal to or greater than 95% average nucleotide identity (ANI) with *Roseburia hominis* strain RHO01 (P127-H9a). In certain embodiments, the ANI is equal to or greater than about 95%, about 95.5%, about 96%, about 96.5%, about 97%, about 97.5%, about 98%, about 98.5%, about 99%, about 99.5%, or 100%. In certain embodiments, a contemplated *Roseburia hominis* strain has equal to or greater than 60% alignment fraction (AF) with *Roseburia hominis* strain RHO01 (P127-H9a). In certain embodiments, the AF is equal to or greater than about 65%, about 70%, about 75%, about 80%, about 85%, about 90%, about 95%, or 100%.

In some embodiments, a contemplated bacterial strain mixture may, e.g., include at least 2, e.g., 2 or 3, bacterial strains disclosed herein.

For example, a contemplated bacterial strain mixture may comprise: (i) a *Bacteroides* species strain, e.g., a *Bacteroides thetaiotaomicron* strain, e.g., the BTH01 strain; and (ii) a *Eubacterium* species strain, e.g., a *Eubacterium hallii* strain, e.g., the EHA01 strain. For example, in certain embodiments, a contemplated bacterial strain mixture comprises: (i) a *Bacteroides* species strain and a *Eubacterium* species strain; (ii) a *Bacteroides* species strain and a *Eubacterium hallii* strain; (iii) a *Bacteroides* species strain and the EHA01 strain; (iv) a *Bacteroides thetaiotaomicron* strain and a *Eubacterium* species strain; (v) a *Bacteroides thetaiotaomicron* strain and a *Eubacterium hallii* strain; (vi) a *Bacteroides thetaiotaomicron* strain and the EHA01 strain; (vii) the BTH01 strain and a *Eubacterium* species strain; (viii) the BTH01 strain and a *Eubacterium hallii* strain; or (ix) the BTH01 strain and the EHA01 strain. In certain embodiments, a contemplated bacterial strain mixture: (i) increases, or is capable of increasing, production of at least one anti-inflammatory gene product, e.g., IL-10 and/or CCL-18, in a human cell, e.g., a THP-1 macrophage or monocyte or a PBMC; (ii) reduces or attenuates, or is capable of reducing or attenuating, production of at least one pro-inflammatory gene product, e.g., IL-6, IL-12, IL-17 and/or TNF-α, in a human cell, e.g., a THP-1 macrophage or monocyte or a PBMC; (iii) reduces or prevents disruption of, or increases, or is capable of reducing or preventing disruption of, or increasing, barrier integrity of an epithelial cell monolayer, e.g., a HT29MTX-E12 cell monolayer treated with TNF-α; (iv) induces or increases, or is capable of inducing or increasing, autophagy in a human cell e.g., a THP-1 macrophage; and/or (v) reduces or attenuates, or is capable of reducing or attenuating, production of Lipocalin-2/NGAL in a cell, tissue or subject.

For example, a contemplated bacterial strain mixture may comprise: (i) a *Bacteroides* species strain, e.g., a *Bacteroides thetaiotaomicron* strain, e.g., the BTH01 strain; and (ii) a *Roseburia* species strain, e.g., a *Roseburia hominis* strain, e.g., the RHO01 strain. For example, in certain embodiments, a contemplated bacterial strain mixture comprises: (i) a *Bacteroides* species strain and a *Roseburia* species strain; (ii) a *Bacteroides* species strain and a *Roseburia hominis* strain; (iii) a *Bacteroides* species strain and the RHO01 strain; (iv) a *Bacteroides thetaiotaomicron* strain and a *Roseburia* species strain; (v) a *Bacteroides thetaiotaomicron* strain and a *Roseburia hominis* strain; (vi) a *Bacteroides thetaiotaomicron* strain and the RHO01 strain; (vii) the BTH01 strain and a *Roseburia* species strain; (viii) the BTH01 strain and a *Roseburia hominis* strain; or (ix) the BTH01 strain and the RHO01 strain. In certain embodiments, a contemplated bacterial strain mixture: (i) increases, or is capable of increasing, production of at least one anti-inflammatory gene product, e.g., IL-10 and/or CCL-18, in a human cell, e.g., a THP-1 macrophage or monocyte or a PBMC; (ii) reduces or attenuates, or is capable of reducing or attenuating, production of at least one pro-inflammatory gene product, e.g., IL-6, IL-12, IL-17 and/or TNF-α, in a human cell, e.g., a THP-1 macrophage or monocyte or a PBMC; (iii) reduces or prevents disruption of, or increases, or is capable of reducing or preventing disruption of, or increasing, barrier integrity of an epithelial cell monolayer, e.g., a HT29MTX-E12 cell monolayer treated with TNF-α; (iv) induces or increases, or is capable of inducing or increasing, autophagy in a human cell e.g., a THP-1 macrophage; and/or (v) reduces or attenuates, or is capable of reducing or attenuating, production of Lipocalin-2/NGAL in a cell, tissue or subject.

For example, a contemplated bacterial strain mixture may comprise: (i) a *Eubacterium* species strain, e.g., a *Eubacterium hallii* strain, e.g., the EHA01 strain; and (ii) a *Roseburia* species strain, e.g., a *Roseburia hominis* strain, e.g., the RHO01 strain. For example, in certain embodiments, a contemplated bacterial strain mixture comprises: (i) a *Eubacterium* species strain and a *Roseburia* species strain; (ii) a *Eubacterium* species strain and a *Roseburia hominis* strain; (iii) a *Eubacterium* species strain and the RHO01 strain; (iv) a *Eubacterium hallii* strain and a *Roseburia* species strain; (v) a *Eubacterium hallii* strain and a *Roseburia hominis* strain; (vi) a *Eubacterium hallii* strain and the RHO01 strain; (vii) the EHA01 strain and a *Roseburia* species strain; (viii) the EHA01 strain and a *Roseburia hominis* strain; or (ix) the EHA01 strain and the RHO01 strain. In certain embodiments, a contemplated bacterial strain mixture: (i) increases, or is capable of increasing, production of at least one anti-inflammatory gene product, e.g., IL-10 and/or CCL-18, in a human cell, e.g., a THP-1 macrophage or monocyte or a PBMC; (ii) reduces or attenuates, or is capable of reducing or attenuating, production of at least one pro-inflammatory gene product, e.g., IL-6, IL-12, IL-17 and/or TNF-α, in a human cell, e.g., a THP-1 macrophage or monocyte or a PBMC; (iii) reduces or prevents disruption of, or increases, or is capable of reducing or preventing disruption of, or increasing, barrier integrity of an epithelial cell monolayer, e.g., a HT29MTX-E12 cell monolayer treated with TNF-α; (iv) induces or increases, or is capable of inducing or increasing, autophagy in a human cell e.g., a THP-1 macrophage; and/or (v) reduces or attenuates, or is capable of reducing or attenuating, production of Lipocalin-2/NGAL in a cell, tissue or subject.

For example, a contemplated bacterial strain mixture may comprise: (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and (iii) a *Roseburia* species strain, e.g., a *Roseburia hominis* strain, e.g., the RHO01 strain. For example, in certain embodiments, a contemplated bacterial strain mixture comprises: (i) a *Bacteroides* species strain, a *Eubacterium* species strain, and a *Roseburia* species strain; (ii) a *Bacteroides* species strain, a *Eubacterium* species strain, and a *Roseburia hominis* strain; (iii) a *Bacteroides* species strain, a *Eubacterium* species strain, and the RHO01 strain; (iv) a *Bacteroides* species strain, a *Eubacterium hallii* strain, and a *Roseburia* species strain; (v) a *Bacteroides* species strain, a *Eubacterium hallii* strain, and a *Roseburia hominis* strain; (vi) a *Bacteroides* species strain, a *Eubacterium hallii* strain, and the RHO01 strain; (vii) a *Bacteroides* species strain, the EHA01 strain, and a *Roseburia* species strain; (viii) a *Bacteroides* species strain, the EHA01 strain, and a *Roseburia hominis* strain; (ix) a *Bacteroides* species strain, the EHA01 strain, and the RHO01 strain; (x) a *Bacteroides thetaiotaomicron* strain, a *Eubacterium* species strain, and a *Roseburia* species strain; (xi) a *Bacteroides thetaiotaomicron* strain, a *Eubacterium* species strain, and a *Roseburia hominis* strain; (xii) a *Bacteroides thetaiotaomicron* strain, a *Eubacterium* species strain, and the RHO01 strain; (xiii) a *Bacteroides thetaiotaomicron* strain, a *Eubacterium hallii* strain, and a *Roseburia* species strain; (xiv) a *Bacteroides thetaiotaomicron* strain, a *Eubacterium hallii* strain, and a *Roseburia hominis* strain; (xv) a *Bacteroides thetaiotaomicron* strain, a *Eubacterium hallii* strain, and the RHO01 strain; (xvi) a *Bacteroides thetaiotaomicron* strain, the EHA01 strain, and a *Roseburia* species strain; (xvii) a *Bacteroides thetaiotaomicron* strain, the EHA01 strain, and a *Roseburia hominis* strain; (xviii) a *Bacteroides thetaiotaomicron* strain, the EHA01 strain, and the RHO01 strain; (xix) the BTH01 strain, a *Eubacterium* species strain, and a *Roseburia* species strain; (xx) the BTH01 strain, a *Eubacterium* species strain, and a *Roseburia hominis* strain; (xxi) the BTH01 strain, a *Eubacterium* species strain, and the RHO01 strain; (xxii) the BTH01 strain, a *Eubacterium hallii* strain, and a *Roseburia* species strain; (xxiii) the BTH01 strain, a *Eubacterium hallii* strain, and a *Roseburia hominis* strain; (xxiv) the BTH01 strain, a *Eubacterium hallii* strain, and the RHO01 strain; (xxv) the BTH01 strain, the EHA01 strain, and a *Roseburia* species strain; (xxvi) the BTH01 strain, the EHA01 strain, and a *Roseburia hominis* strain; or (xxvii) the BTH01 strain, the EHA01 strain, and the RHO01 strain. In certain embodiments, a contemplated bacterial strain mixture: (i) increases, or is capable of increasing, production of at least one anti-inflammatory gene product, e.g., IL-10 and/or CCL-18, in a human cell, e.g., a THP-1 macrophage or monocyte or a PBMC; (ii) reduces or attenuates, or is capable of reducing or attenuating, production of at least one pro-inflammatory gene product, e.g., IL-6, IL-12, IL-17 and/or TNF-α, in a human cell, e.g., a THP-1 macrophage or monocyte or a PBMC; (iii) reduces or prevents disruption of, or increases, or is capable of reducing or preventing disruption of, or increasing, barrier integrity of an epithelial cell monolayer, e.g., a HT29MTX-E12 cell monolayer treated with TNF-α; (iv) induces or increases, or is capable of inducing or increasing, autophagy in a human cell e.g., a THP-1 macrophage; and/or (v) reduces or attenuates, or is capable of reducing or attenuating, production of Lipocalin-2/NGAL in a cell, tissue or subject.

For example, a contemplated bacterial strain mixture may consist essentially of: (i) a *Bacteroides* species strain, e.g., a *Bacteroides thetaiotaomicron* strain, e.g., the BTH01 strain; and (ii) a *Eubacterium* species strain, e.g., a *Eubacterium hallii* strain, e.g., the EHA01 strain. For example, in certain embodiments, a contemplated bacterial strain mixture consists essentially of: (i) a *Bacteroides* species strain and a *Eubacterium* species strain; (ii) a *Bacteroides* species strain and a *Eubacterium hallii* strain; (iii) a *Bacteroides* species strain and the EHA01 strain; (iv) a *Bacteroides thetaiotaomicron* strain and a *Eubacterium* species strain; (v) a *Bacteroides thetaiotaomicron* strain and a *Eubacterium hallii* strain; (vi) a *Bacteroides thetaiotaomicron* strain and the EHA01 strain; (vii) the BTH01 strain and a *Eubacterium* species strain; (viii) the BTH01 strain and a *Eubacterium hallii* strain; or (ix) the BTH01 strain and the EHA01 strain. In certain embodiments, a contemplated bacterial strain mixture: (i) increases, or is capable of increasing, production of at least one anti-inflammatory gene product, e.g., IL-10 and/or CCL-18, in a human cell, e.g., a THP-1 macrophage or monocyte or a PBMC; (ii) reduces or attenuates, or is capable of reducing or attenuating, production of at least one pro-inflammatory gene product, e.g., IL-6, IL-12, IL-17 and/or TNF-α, in a human cell, e.g., a THP-1 macrophage or monocyte or a PBMC; (iii) reduces or prevents disruption of, or increases, or is capable of reducing or preventing disruption of, or increasing, barrier integrity of an epithelial cell monolayer, e.g., a HT29MTX-E12 cell monolayer treated with TNF-α; (iv) induces or increases, or is capable of inducing or increasing, autophagy in a human cell e.g., a THP-1 macrophage; and/or (v) reduces or attenuates, or is capable of reducing or attenuating, production of Lipocalin-2/NGAL in a cell, tissue or subject.

For example, a contemplated bacterial strain mixture may consist essentially of: (i) a *Bacteroides* species strain, e.g., a *Bacteroides thetaiotaomicron* strain, e.g., the BTH01 strain; and (ii) a *Roseburia* species strain, e.g., a *Roseburia hominis* strain, e.g., the RHO01 strain. For example, in certain embodiments, a contemplated bacterial strain mixture consists essentially of: (i) a *Bacteroides* species strain and a *Roseburia* species strain; (ii) a *Bacteroides* species strain and a *Roseburia hominis* strain; (iii) a *Bacteroides* species strain and the RHO01 strain; (iv) a *Bacteroides thetaiotaomicron* strain and a *Roseburia* species strain; (v) a *Bacteroides thetaiotaomicron* strain and a *Roseburia hominis* strain; (vi) a *Bacteroides thetaiotaomicron* strain and the RHO01 strain; (vii) the BTH01 strain and a *Roseburia* species strain; (viii) the BTH01 strain and a *Roseburia hominis* strain; or (ix) the BTH01 strain and the RHO01 strain. In certain embodiments, a contemplated bacterial strain mixture: (i) increases, or is capable of increasing, production of at least one anti-inflammatory gene product, e.g., IL-10 and/or CCL-18, in a human cell, e.g., a THP-1 macrophage or monocyte or a PBMC; (ii) reduces or attenuates, or is capable of reducing or attenuating, production of at least one pro-inflammatory gene product, e.g., IL-6, IL-12, IL-17 and/or TNF-α, in a human cell, e.g., a THP-1 macrophage or monocyte or a PBMC; (iii) reduces or prevents disruption of, or increases, or is capable of reducing or preventing disruption of, or increasing, barrier integrity of an epithelial cell monolayer, e.g., a HT29MTX-E12 cell monolayer treated with TNF-α; (iv) induces or increases, or is capable of inducing or increasing, autophagy in a human cell e.g., a THP-1 macrophage; and/or (v) reduces or attenuates, or is capable of reducing or attenuating, production of Lipocalin-2/NGAL in a cell, tissue or subject.

For example, a contemplated bacterial strain mixture may consist essentially of: (i) a *Eubacterium* species strain, e.g., a *Eubacterium hallii* strain, e.g., the EHA01 strain; and (ii) a *Roseburia* species strain, e.g., a *Roseburia hominis* strain, e.g., the RHO01 strain. For example, in certain embodiments, a contemplated bacterial strain mixture consists essentially of: (i) a *Eubacterium* species strain and a *Roseburia* species strain; (ii) a *Eubacterium* species strain and a *Roseburia hominis* strain; (iii) a *Eubacterium* species strain and the RHO01 strain; (iv) a *Eubacterium hallii* strain and a *Roseburia* species strain; (v) a *Eubacterium hallii* strain and a *Roseburia hominis* strain; (vi) a *Eubacterium hallii* strain and the RHO01 strain; (vii) the EHA01 strain and a *Roseburia* species strain; (viii) the EHA01 strain and a *Roseburia hominis* strain; or (ix) the EHA01 strain and the RHO01 strain. In certain embodiments, a contemplated bacterial strain mixture: (i) increases, or is capable of increasing, production of at least one anti-inflammatory gene product, e.g., IL-10 and/or CCL-18, in a human cell, e.g., a THP-1 macrophage or monocyte or a PBMC; (ii) reduces or attenuates, or is capable of reducing or attenuating, production of at least one pro-inflammatory gene product, e.g., IL-6, IL-12, IL-17 and/or TNF-α, in a human cell, e.g., a THP-1 macrophage or monocyte or a PBMC; (iii) reduces or prevents disruption of, or increases, or is capable of reducing or preventing disruption of, or increasing, barrier integrity of an epithelial cell monolayer, e.g., a HT29MTX-E12 cell monolayer treated with TNF-α; (iv) induces or increases, or is capable of inducing or increasing, autophagy in a human cell e.g., a THP-1 macrophage; and/or (v) reduces or attenuates, or is capable of reducing or attenuating, production of Lipocalin-2/NGAL in a cell, tissue or subject.

For example, a contemplated bacterial strain mixture may consist essentially of: (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and (iii) a *Roseburia* species strain, e.g., a *Roseburia hominis* strain, e.g., the RHO01 strain. For example, in certain embodiments, a contemplated bacterial strain mixture consists essentially of: (i) a *Bacteroides* species strain, a *Eubacterium* species strain, and a *Roseburia* species strain; (ii) a *Bacteroides* species strain, a *Eubacterium* species strain, and a *Roseburia hominis* strain; (iii) a *Bacteroides* species strain, a *Eubacterium* species strain, and the RHO01 strain; (iv) a *Bacteroides* species strain, a *Eubacterium hallii* strain, and a *Roseburia* species strain; (v) a *Bacteroides* species strain, a *Eubacterium hallii* strain, and a *Roseburia hominis* strain; (vi) a *Bacteroides* species strain, a *Eubacterium hallii* strain, and the RHO01 strain; (vii) a *Bacteroides* species strain, the EHA01 strain, and a *Roseburia* species strain; (viii) a *Bacteroides* species strain, the EHA01 strain, and a *Roseburia hominis* strain; (ix) a *Bacteroides* species strain, the EHA01 strain, and the RHO01 strain; (x) a *Bacteroides thetaiotaomicron* strain, a *Eubacterium* species strain, and a *Roseburia* species strain; (xi) a *Bacteroides thetaiotaomicron* strain, a *Eubacterium* species strain, and a *Roseburia hominis* strain; (xii) a *Bacteroides thetaiotaomicron* strain, a *Eubacterium* species strain, and the RHO01 strain; (xiii) a *Bacteroides thetaiotaomicron* strain, a *Eubacterium hallii* strain, and a *Roseburia* species strain; (xiv) a *Bacteroides thetaiotaomicron* strain, a *Eubacterium hallii* strain, and a *Roseburia hominis* strain; (xv) a *Bacteroides thetaiotaomicron* strain, a *Eubacterium hallii* strain, and the RHO01 strain; (xvi) a *Bacteroides thetaiotao-*

*micron* strain, the EHA01 strain, and a *Roseburia* species strain; (xvii) a *Bacteroides thetaiotaomicron* strain, the EHA01 strain, and a *Roseburia hominis* strain; (xviii) a *Bacteroides thetaiotaomicron* strain, the EHA01 strain, and the RHO01 strain; (xix) the BTH01 strain, a *Eubacterium* species strain, and a *Roseburia* species strain; (xx) the BTH01 strain, a *Eubacterium* species strain, and a *Roseburia hominis* strain; (xxi) the BTH01 strain, a *Eubacterium* species strain, and the RHO01 strain; (xxii) the BTH01 strain, a *Eubacterium hallii* strain, and a *Roseburia* species strain; (xxiii) the BTH01 strain, a *Eubacterium hallii* strain, and a *Roseburia hominis* strain; (xxiv) the BTH01 strain, a *Eubacterium hallii* strain, and the RHO01 strain; (xxv) the BTH01 strain, the EHA01 strain, and a *Roseburia* species strain; (xxvi) the BTH01 strain, the EHA01 strain, and a *Roseburia hominis* strain; or (xxvii) the BTH01 strain, the EHA01 strain, and the RHO01 strain. In certain embodiments, a contemplated bacterial strain mixture: (i) increases, or is capable of increasing, production of at least one anti-inflammatory gene product, e.g., IL-10 and/or CCL-18, in a human cell, e.g., a THP-1 macrophage or monocyte or a PBMC; (ii) reduces or attenuates, or is capable of reducing or attenuating, production of at least one pro-inflammatory gene product, e.g., IL-6, IL-12, IL-17 and/or TNF-α, in a human cell, e.g., a THP-1 macrophage or monocyte or a PBMC; (iii) reduces or prevents disruption of, or increases, or is capable of reducing or preventing disruption of, or increasing, barrier integrity of an epithelial cell monolayer, e.g., a HT29MTX-E12 cell monolayer treated with TNF-α; (iv) induces or increases, or is capable of inducing or increasing, autophagy in a human cell e.g., a THP-1 macrophage; and/or (v) reduces or attenuates, or is capable of reducing or attenuating, production of Lipocalin-2/NGAL in a cell, tissue or subject.

A contemplated bacterial strain mixture may, e.g., comprise or consist essentially of 2, 3, 4, 5, 6, 7, 8, 9, 10, or more than 10 bacterial strains. In some embodiments, one or more strains of the bacterial strain mixture are vegetative. In some embodiments, all the strains of the bacterial strain mixture are vegetative. For example, in certain embodiments, a disclosed bacterial strain mixture comprises or consists essentially of 2 to 10, 2 to 9, 2 to 8, 2 to 7, 2 to 6, 2 to 5, 2 to 4, or 2 to 3 bacterial strains; or, for example, may comprise or consist essentially of 3 to 10, 3 to 9, 3 to 8, 3 to 7, 3 to 6, 3 to 5 or 3 to 4 bacterial strains; or, for example, may comprise or consist essentially of 4 to 10, 4 to 9, 4 to 8, 4 to 7, 4 to 6 or 4 to 5 bacterial strains; or, for example, may comprise or consist essentially of 5 to 10, 5 to 9, 5 to 8, 5 to 7, 5 to 6, 6 to 10, 6 to 9, 6 to 8, 6 to 7, 7 to 10, 7 to 9, or 7 to 8 bacterial strains; or, for example, may comprise or consist essentially of 8 to 10 or 8 to 9 bacterial strains. In some embodiments, a disclosed bacterial strain mixture comprises or consists essentially of 2 or 3 bacterial strains. In some of the above embodiments, the bacterial strain mixture comprises at least two bacterial strains each selected from the group consisting of: a *Bacteroides* species strain (e.g., a *Bacteroides thetaiotaomicron* strain), a *Eubacterium* species (e.g., a *Eubacterium hallii* strain), and a *Roseburia* species (e.g., a *Roseburia hominis* strain); and further comprises or consists essentially of an additional 1, 2, 3, 4, 5, 6, 7, 8, 9, 10, or more than 10 bacterial strains. In some embodiments, the additional bacterial strains include a *Bacteroides* species strain, a *Eubacterium* species strain, and/or a *Roseburia* species strain, and/or strains other than a *Bacteroides* species strain, a *Eubacterium* species strain, and/or a *Roseburia* species strain. In some embodiments, the additional bacterial strains are selected based on their ability to independently: (i) increase production of at least one anti-inflammatory gene product, e.g., IL-10 and/or CCL-18, in a human cell, e.g., a THP-1 macrophage or monocyte or a PBMC; (ii) reduce or attenuate production of at least one pro-inflammatory gene product, e.g., IL-6, IL-12, IL-17 and/or TNF-α, in a human cell, e.g., a THP-1 macrophage or monocyte or a PBMC; (iii) reduce or prevent disruption of, or increase, barrier integrity of an epithelial cell monolayer, e.g., a HT29MTX-E12 cell monolayer treated with TNF-α; (iv) induce or increase autophagy in a human cell e.g., a THP-1 macrophage; and/or (v) reduces or attenuates, or is capable of reducing or attenuating, production of Lipocalin-2/NGAL in a cell, tissue or subject.

In some embodiments, a contemplated bacterial strain mixture increases, or is capable of increasing, production of at least one anti-inflammatory gene product in a cell, tissue, or subject. For example, a contemplated bacterial strain mixture, e.g., increases production of IL-10 and/or CCL-18 in a human cell, e.g., a THP-1 macrophage or monocyte or a PBMC. For example, contacting a human cell, e.g., a THP-1 macrophage or a PBMC, with the bacterial strain mixture may increase production of IL-10 and/or CCL-18 in the cell by at least about 10%, at least about 20%, at least about 30%, at least about 40%, at least about 50%, at least about 75%, at least about 100%, at least about 200%, at least about 300%, at least about 400%, at least about 500%, at least about 750%, at least about 1000%, from about 10% to about 20%, from about 10% to about 50%, from about 10% to about 100%, from about 10% to about 200%, from about 10% to about 500%, from about 10% to about 1000%, from about 20% to about 50%, from about 20% to about 100%, from about 20% to about 200%, from about 20% to about 500%, from about 20% to about 1000%, from about 50% to about 100%, from about 50% to about 200%, from about 50% to about 500%, from about 50% to about 1000%, from about 100% to about 200%, from about 100% to about 500%, from about 100% to about 1000%, from about 200% to about 500%, from about 200% to about 1000%, or from about 500% to about 1000%, relative to a cell (e.g., of the same cell type) that was not contacted with the bacterial strain mixture. In some embodiments, the contacting of the human cell with the bacterial strain mixture occurs in vitro, e.g., the human cell is incubated with the bacterial strain mixture. In some embodiments, the contacting of the human cell with the bacterial strain mixture occurs in vivo. In some embodiments, the bacterial strains of the bacterial strain mixture increase, or are capable of increasing, production of the at least one anti-inflammatory gene product in a synergistic manner. For example, the production of the at least one anti-inflammatory gene product induced by the bacterial strain mixture is greater than the production induced by each bacterial strain in the mixture individually, and/or the production induced by each individual bacterial strain added together. In some embodiments, the production of the at least one anti-inflammatory gene product induced by the bacterial strain mixture is at least 5%, 10%, 15%, 20%, 25%, 30%, 35%, 40%, 45%, 50%, 60%, 65%, 70%, 75%, 80%, 85%, 90%, 95%, 100%, or more than 100% greater than the production induced by each bacterial strain in the mixture individually, and/or the production induced by each individual bacterial strain added together.

In some embodiments, a contemplated bacterial strain mixture reduces or attenuates, or is capable of reducing or attenuating, production of at least one pro-inflammatory gene product in a cell, tissue, or subject. For example, a contemplated bacterial strain mixture reduces or attenuates production of IL-6, IL-12, IL-17 and/or TNF-α in a human cell, e.g., a THP-1 macrophage or monocyte or a PBMC. For example, contacting a human cell, e.g., a THP-1 macrophage or a PBMC, with the bacterial strain mixture may reduce or attenuate production of IL-6, IL-12, IL-17 and/or TNF-α in the cell by at least about 10%, at least about 20%, at least about 30%, at least about 40%, at least about 50%, at least about 75%, from about 10% to about 20%, from about 10% to about 50%, from about 10% to about 100%, from about 20% to about 50%, from about 20% to about 100%, or from about 50% to about 100%, relative to a cell (e.g., of the same cell type) that was not contacted with the bacterial strain mixture. In some embodiments, the contacting of the human cell with the bacterial strain mixture occurs in vitro, e.g., the human cell is incubated with the bacterial strain mixture. In some embodiments, the contacting of the human cell with the bacterial strain mixture occurs in vivo. In some embodiments, the bacterial strains of the bacterial strain mixture reduce or attenuate production of the at least one pro-inflammatory gene product in a synergistic manner. For example, the reduction or attenuation of production of the at least one pro-inflammatory gene product induced by the bacterial strain mixture is greater than that induced by each bacterial strain in the mixture individually, and/or the attenuation or reduction induced by each individual bacterial strain added together. In some embodiments, the reduction or attenuation of production of the at least one pro-inflammatory gene product induced by the bacterial strain mixture is at least 5%, 10%, 15%, 20%, 25%, 30%, 35%, 40%, 45%, 50%, 60%, 65%, 70%, 75%, 80%, 85%, 90%, 95%, 100%, or more than 100% greater than the reduction or attenuation of production induced by each bacterial strain in the mixture individually, and/or the attenuation or reduction induced by each individual bacterial strain added together.

In some embodiments, a contemplated bacterial strain mixture reduces or prevents disruption, or increases, or is capable of reducing or preventing disruption, or increasing, barrier integrity of a mucosal epithelium. For example, a contemplated bacterial strain mixture reduces or prevents disruption of, or increases, barrier integrity of a HT29MTX-E12 cell monolayer, e.g., a HT29MTX-E12 cell monolayer treated with TNF-α. For example, incubation of a contemplated bacterial strain mixture with a HT29MTX-E12 cell monolayer, e.g., a HT29MTX-E12 cell monolayer treated with TNF-α, may reduce or prevent disruption of, or increase, barrier integrity, e.g., as measured by trans-epithelial electrical resistance (TEER), by at least about 10%, at least about 20%, at least about 30%, at least about 40%, at least about 50%, at least about 60%, at least about 70%, at least about 80%, at least about 90%, at least about 100%, from about 20% to about 100%, from about 40% to about 100%, from about 60% to about 100%, from about 80% to about 100%, from about 20% to about 80%, from about 40% to about 80%, from about 60% to about 80%, from about 20% to about 60%, from about 40% to about 60%, or from about 20% to about 40%, relative to a HT29MTX-E12 cell monolayer that was not incubated with the bacterial strain mixture.

In some embodiments, a contemplated bacterial strain mixture induces or increases, or is capable of inducing or increasing, autophagy in a cell, tissue, or subject. For example, a contemplated bacterial strain mixture induces or increases autophagy in a human cell, e.g., a THP-1 macrophage. For example, contacting a human cell, e.g., a THP-1 macrophage, with the bacterial strain mixture may induce or increase autophagy in the cell by at least about 10%, at least about 20%, at least about 30%, at least about 40%, at least about 50%, at least about 60%, at least about 70%, at least about 80%, at least about 90%, at least about 100%, from about 10% to about 20%, from about 10% to about 50%, from about 10% to about 100%, from about 20% to about 50%, from about 20% to about 100%, from about 20% to about 200%, from about 50% to about 100%, or from about 50% to about 200%, relative to a cell (e.g., of the same cell type) that was not contacted with the bacterial strain mixture. In some embodiments, the contacting of the human cell with the bacterial strain mixture occurs in vitro, e.g., the human cell is incubated with the bacterial strain mixture. In some embodiments, the contacting of the human cell with the bacterial strain mixture occurs in vivo. In some embodiments, the bacterial strains of the bacterial strain mixture increase autophagy in a synergistic manner. For example, the autophagy induced by the bacterial strain mixture is greater than the autophagy induced by each bacterial strain in the mixture individually, and/or the autophagy induced by each individual bacterial strain added together. In some embodiments, the autophagy induced by the bacterial strain mixture is at least 5%, 10%, 15%, 20%, 25%, 30%, 35%, 40%, 45%, 50%, 60%, 65%, 70%, 75%, 80%, 85%, 90%, 95%, 100%, or more than 100% greater than the autophagy induced by each bacterial strain in the mixture individually, and/or the autophagy induced by each individual bacterial strain added together.

In some embodiments, a contemplated bacterial strain mixture reduces or attenuates, or is capable of reducing or attenuating, production of Lipocalin-2/NGAL in a cell, tissue, or subject. For example, contacting a human cell with bacterial strain mixture may reduce or attenuate production of Lipocalin-2/NGAL in the cell by at least about 10%, at least about 20%, at least about 30%, at least about 40%, at least about 50%, at least about 75%, from about 10% to about 20%, from about 10% to about 50%, from about 10% to about 100%, from about 20% to about 50%, from about 20% to about 100%, or from about 50% to about 100%, relative to a cell (e.g., of the same cell type) that was not contacted with the bacterial strain mixture. In some embodiments, the contacting of the human cell with the bacterial strain mixture occurs in vitro, e.g., the human cell is incubated with the bacterial strain mixture strain. In some embodiments, the contacting of the human cell with the bacterial strain mixture occurs in vivo.

II. Pharmaceutical Compositions/Units

A bacteria disclosed herein may be combined with pharmaceutically acceptable excipients to form a pharmaceutical composition, which can be administered to a patient by any means known in the art. As used herein, the term "pharmaceutically acceptable excipient" is understood to mean one or more of a buffer, carrier, or excipient suitable for administration to a subject, for example, a human subject, without excessive toxicity, irritation, allergic response, or other problem or complication, commensurate with a reasonable benefit/risk ratio. The excipient(s) should be "acceptable" in the sense of being compatible with the other ingredients of the formulations and not deleterious to the recipient.

Pharmaceutically acceptable excipients include buffers, solvents, dispersion media, coatings, isotonic and absorption delaying agents, and the like, that are compatible with pharmaceutical administration. Pharmaceutically acceptable excipients also include fillers, binders, disintegrants, glidants, lubricants, and any combination(s) thereof. For example, a contemplated composition may comprise a pharmaceutical excipient selected from the group consisting of cellulose, polyvinyl pyrrolidone, silicon dioxide, stearyl fumarate or a pharmaceutically acceptable salt thereof, lactose, starch, glucose, methyl cellulose, ethyl cellulose, hydroxypropyl methyl cellulose, magnesium stearate, mannitol, sorbitol, and any combination(s) thereof. For further examples of excipients, carriers, stabilizers and adjuvants, see, e.g., Handbook of Pharmaceutical Excipients, $8^{th}$ Ed., Edited by P. J. Sheskey, W. G. Cook, and C.G. Cable, Pharmaceutical Press, London, UK [2017]. The use of such media and agents for pharmaceutically active substances is known in the art.

In certain embodiments, bacterial strains described herein may be used in any composition in stabilized form, including, for example, in a lyophilized state (with optionally one or more appropriate cryoprotectants), frozen (e.g., in a standard or super-cooled freezer), spray dried, and/or freeze dried. Stabilized bacteria (e.g., via lyophilization, freezing, spray drying or freeze drying), and in particular, stabilized anaerobic bacteria, may, in certain embodiments, possess advantageous properties over bacteria in culture with respect to administration, e.g., administration of a pharmaceutical composition provided herein. For example, lyophilizing bacteria involves a freeze-drying process that removes water from the bacterial cells. The resulting lyophilized bacteria may, in certain embodiments, have enhanced stability as compared to bacterial cultures, and thus may be stored for longer periods of time (i.e. extending shelf-life). In addition, in certain embodiments, in stabilized form, dehydrated bacterial cells do not grow or reproduce, but remain viable and may grow and reproduce when rehydrated. In certain embodiments, viability of stabilized anaerobic bacteria is maintained even when exposed to oxygen, thus facilitating their formulation (for example, into oral dosage forms) and use as a live biotherapeutic product that retains biological activity. Thus, in particular embodiments, the bacterial strains described herein are stabilized (e.g., via lyophilization, freezing, freeze-drying or spray-drying), live and viable, and retain some, most, or all of their chemical stability, and/or biological activity upon storage. Stability can be measured at a selected temperature and humidity conditions for a selected time period. Trend analysis can be used to estimate an expected shelf life before a material has actually been in storage for that time period. For live bacteria, for example, stability may be measured as the time it takes to lose 0.5 or 1 log of cfu/g dry formulation under predefined conditions of temperature and/or humidity. Alternatively, stability may be defined in terms of biological function as the time required to measure a decrease in a particular biological function per unit of dry formulation.

In certain embodiments, a contemplated pharmaceutical composition or pharmaceutical unit loses at most 0.5 log cfus, 1 log cfus, 1.5 log cfus, 2 log cfus, 2.5 log cfus, 3 log cfus, 3.5 log cfus, 4 log cfus, 4.5 log cfus, 5 log cfus, 5.5 log cfus, 6 log cfus, 6.5 log cfus, 7 log cfus, 7.5 log cfus, 8 log cfus, 8.5 log cfus, 9 log cfus, 9,5 log cfus, or 10 log cfus (total, or per gram of dry formulation) of each bacterial strain present in the pharmaceutical composition or unit upon storage for 1 month, 2 months, 3 months, 4 months, 5 months, 6 months, 7 months, 8 months, 9 months, 10 months 11, months, 12 months, 1 year, 1.5 years, 2 years, 2.5 years, 3 years, 3.5 years, 4 years, 4.5 years, or 5 years at 4° C. or −20° C. For example, a contemplated pharmaceutical composition or pharmaceutical unit may lose at most 3 log cfus of each bacterial strain present in the pharmaceutical composition or unit upon storage for 6 months, 1 year, or 2 years at 4° C.

A bacteria disclosed herein may be combined with one or more cryoprotectants. Exemplary cryoprotectants include fructoligosaccharides (e.g., raftilose®), trehalose, maltodextrin, sodium alginate, proline, glutamic acid, glycine (e.g., glycine betaine), mono-, di-, or polysaccharides (such as glucose, sucrose, maltose, lactose), polyols (such as mannitol, sorbitol, or glycerol), dextran, DMSO, methylcellulose, propylene glycol, polyvinylpyrrolidone, non-ionic surfactants such as TWEEN 80 Tween 80, and/or any combinations thereof.

In certain embodiments, a contemplated cryoprotectant comprises raftilose®, maltodextrin, alignate, trehalose, and sucrose, or any combinations thereof. An exemplary contemplated pharmaceutical composition includes sucrose as a cryoprotectant, and includes one or more strains selected from (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain. An exemplary contemplated pharmaceutical composition includes raftilose®, maltodextrin, alignate, trehalose, and sucrose as cryoprotectants, and includes one or more strains selected from (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain. An exemplary contemplated pharmaceutical composition includes raftilose®, maltodextrin, alignate, and trehalose as cryoprotectants, and includes one or more strains selected from (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain.

For example, a lyophilized powder form of a bacterial strain, as contemplated herein, may include about 10% to about 80% (by weight) of one or more bacterial strains (e.g., one bacterial strain) and about 20% to about 90% (by weight) of cryoprotectant and/or excipients, such as cryoprotectant and/or excipient selected from the group consisting of raftilose®, maltodextrin, sodium alginate, trehalose, sucrose, water, and/or combinations thereof. For example, 5 mg of contemplated lyophilized powder form of a bacterial strain may include about 0.5 mg to about 1.5 mg of the bacterial strain, about 1.5 mg to about 2.5 mg of the bacterial strain, about 2.5 to about 3.5 mg of the bacterial strain, or about 3.5 mg to about 4.5 mg of the bacterial strain. It can be appreciated that each lyophilized powder form of bacterial strain that may form a component of a disclosed composition may each have different excipients and/or amounts of excipients, as well as a discrete bacterial strain.

A pharmaceutical composition should be formulated to be compatible with its intended route of administration. Contemplated bacterial compositions disclosed herein can be prepared by any suitable method and can be formulated into a variety of forms and administered by a number of different means. Contemplated compositions can be administered orally, rectally, or enterally, in formulations containing conventionally acceptable carriers, adjuvants, and vehicles as desired. As used herein, "rectal administration" is understood to include administration by enema, suppository, or colonoscopy. A disclosed pharmaceutical composition may, e.g., be suitable for bolus administration or bolus release. In an exemplary embodiment, a disclosed bacterial composition is administered orally.

Solid dosage forms for oral administration include capsules, tablets, caplets, pills, troches, lozenges, powders, and granules. A capsule typically comprises a core material comprising a bacterial composition and a shell wall that encapsulates the core material. In some embodiments the core material comprises at least one of a solid, a liquid, and an emulsion. In some embodiments the shell wall material comprises at least one of a soft gelatin, a hard gelatin, and a polymer. Suitable polymers include, but are not limited to: cellulosic polymers such as hydroxypropyl cellulose, hydroxyethyl cellulose, hydroxypropyl methyl cellulose (HPMC), methyl cellulose, ethyl cellulose, cellulose acetate, cellulose acetate phthalate, cellulose acetate trimellitate, hydroxypropylmethyl cellulose phthalate, hydroxypropylmethyl cellulose succinate and carboxymethylcellulose sodium; acrylic acid polymers and copolymers, such as those formed from acrylic acid, methacrylic acid, methyl acrylate, ammonio methylacrylate, ethyl acrylate, methyl methacrylate and/or ethyl methacrylate (e.g., those copolymers sold under the trade name "Eudragit®"); vinyl polymers and copolymers such as polyvinyl pyrrolidone, polyvinyl acetate, polyvinylacetate phthalate, vinylacetate crotonic acid copolymer, and ethylene-vinyl acetate copolymers; and shellac (purified lac). In some embodiments at least one polymer functions as a taste-masking agent.

Tablets, pills, and the like can be compressed, multiply compressed, multiply layered, and/or coated. A contemplated coating can be single or multiple. In one embodiment, a contemplated coating material comprises at least one of a saccharide, a polysaccharide, and glycoproteins extracted from at least one of a plant, a fungus, and a microbe. Non-limiting examples include corn starch, wheat starch, potato starch, tapioca starch, cellulose, hemicellulose, dextrans, maltodextrin, cyclodextrins, inulins, pectin, mannans, gum arabic, locust bean gum, mesquite gum, guar gum, gum karaya, gum ghatti, tragacanth gum, funori, carrageenans, agar, alginates, chitosans, or gellan gum. In some embodiments a contemplated coating material comprises a protein. In some embodiments a contemplated coating material comprises at least one of a fat and an oil. In some embodiments the at least one of a fat and an oil is high temperature melting. In some embodiments the at least one of a fat and an oil is hydrogenated or partially hydrogenated. In some embodiments the at least one of a fat and an oil is derived from a plant. In some embodiments the at least one of a fat and an oil comprises at least one of glycerides, free fatty acids, and fatty acid esters. In some embodiments a contemplated coating material comprises at least one edible wax. A contemplated edible wax can be derived from animals, insects, or plants. Non-limiting examples include beeswax, lanolin, bayberry wax, carnauba wax, and rice bran wax. Tablets and pills can additionally be prepared with enteric or reverse-enteric coatings.

Alternatively, powders or granules embodying a bacterial composition disclosed herein can be incorporated into a food product. In some embodiments a contemplated food product is a drink for oral administration. Non-limiting examples of a suitable drink include water, fruit juice, a fruit drink, an artificially flavored drink, an artificially sweetened drink, a carbonated beverage, a sports drink, a liquid diary product, a shake, an alcoholic beverage, a caffeinated beverage, infant formula and so forth. Other suitable means for oral administration include aqueous and nonaqueous solutions, emulsions, suspensions and solutions and/or suspensions reconstituted from non-effervescent granules, containing at least one of suitable solvents, preservatives, emulsifying agents, suspending agents, diluents, sweeteners, coloring agents, and flavoring agents.

In certain embodiments, a contemplated pharmaceutical composition includes: (a) a mixture of lyophilized bacterial strains (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain; and (b) a filler (e.g., microcrystalline cellulose, lactose, sucrose, mannitol, or dicalcium phosphate dihydrate), a disintegrant (e.g., polyvinyl pyrrolidone, sodium starch glycolate, starch, or carboxymethyl-cellulose), a flow-aid/glidant (e.g., talc or silica derivatives (e.g., colloidal silica such as Cab-O-Sil® or Acrosil®)), and a lubricant (e.g., sodium stearyl fumarate, magnesium stearate, calcium stearate, stearic acid, stearic acid salt, talc, liquid paraffin, propylene glycol (PG), PEG 6000, or magnesium/sodium lauryl sulfate).

In certain embodiments, a contemplated pharmaceutical composition includes: (a) a mixture of lyophilized bacterial strains (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain; and (b) a filler (microcrystalline cellulose), a disintegrant (polyvinyl pyrrolidone), a flow-aid/glidant (silicon dioxide), and a lubricant (sodium stearyl fumarate).

In certain embodiments, a contemplated pharmaceutical composition is formulated as a capsule. In certain embodiments, the capsule is a hydroxypropyl methylcellulose (HPMC) capsule. In certain embodiments, the capsule includes a banding polymer (e.g., hydroxypropyl methylcellulose (HPMC)), and a banding solvent (e.g., water or ethanol). In certain embodiments, the capsule includes two banding solvents, water and ethanol. In certain embodiments the capsule is coated with a reverse enteric coating polymer (e.g., amino methacrylate copolymer), and comprises a surfactant (e.g., sodium lauryl sulfate), a flow-aid/glidant (e.g., silicon dioxide), a lubricant (e.g., stearic acid), an anti-tacking agent (e.g., talc), and a coating solvent (e.g., water). In certain embodiments the capsule is coated with an enteric coating polymer (e.g., poly(methacrylic acid-co-methyl methacrylate)), and further includes a plasticizer (e.g., triethyl citrate), an anti-tacking agent (e.g., talc), a pH adjuster (e.g., ammonia solution), and a coating solvent (e.g., purified water and isopropyl alcohol).

In certain embodiments, a contemplated capsule is a capsule-in-capsule dosage form, which includes an inner capsule and an outer capsule. In certain embodiments, the inner capsule includes a mixture of lyophilized bacterial strains (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain, a filler (e.g., microcrystalline cellulose, lactose, sucrose, mannitol, dicalcium phosphate dihydrate, or starch), a disintegrant (e.g., polyvinyl pyrrolidone, sodium starch glycolate, or carboxymethyl-cellulose), a flow-aid/glidant (e.g., silicon dioxide, talc, or colloidal silica), and a lubricant (e.g., sodium stearyl fumarate, magnesium stearate, calcium stearate, stearic acid, stearic acid salt, talc, liquid paraffin, propylene glycol (PG), PEG 6000, or magnesium/sodium lauryl sulfate). In certain embodiments, the outer capsule includes a mixture of lyophilized bacterial strains (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain, a filler (e.g., microcrystalline cellulose, lactose, sucrose, mannitol, dicalcium phosphate dihydrate, or starch), a disintegrant (e.g., polyvinyl pyrrolidone, sodium starch glycolate, or carboxymethylcellulose), a flow-aid/glidant (e.g., silicon dioxide, talc, or colloidal silica), and a lubricant (e.g., sodium stearyl fumarate, magnesium stearate, calcium stearate, stearic acid, stearic acid salt, talc liquid paraffin, propylene glycol (PG), PEG 6000, or magnesium/sodium lauryl sulfate).

In certain embodiments, a contemplated capsule is a capsule-in-capsule dosage form, which includes an inner capsule and an outer capsule. In certain embodiments, the inner capsule includes a mixture of lyophilized bacterial strains (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain, a filler (microcrystalline cellulose), a disintegrant (polyvinyl pyrrolidone), a flow-aid/glidant (silicon dioxide), and a lubricant (sodium stearyl fumarate). In certain embodiments, the outer capsule includes a mixture of lyophilized bacterial strains (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain, a filler (microcrystalline cellulose), a disintegrant (polyvinyl pyrrolidone), a flow-aid/glidant (silicon dioxide), and a lubricant (sodium stearyl fumarate).

In certain embodiments, a disclosed pharmaceutical unit comprises a dual component capsule. For example, a dual component capsule may comprise an inner capsule, wherein the inner capsule has a reverse enteric polymeric coating, and an outer capsule encapsulating the inner capsule, wherein the outer capsule has an enteric polymeric coating. A contemplated inner and/or outer capsule may comprise a bacterial strain or a bacterial strain mixture. For example, a dual component capsule may comprise an inner capsule having an inner composition comprising a bacterial strain or bacterial strain mixture and one or more pharmaceutical excipients, wherein the inner capsule has a reverse enteric polymeric coating, and an outer capsule encapsulating the inner capsule and an outer composition comprising a bacterial strain or bacterial strain mixture and one or more pharmaceutical excipients, wherein the outer capsule has an enteric polymeric coating. A contemplated inner and/or outer composition may, e.g., comprise: (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain. The inner composition and the outer composition may be the same or different.

A contemplated dual component capsule may include a total of about 5 mg to about 60 mg of the inner and outer composition, e.g., a total of about 5 mg to about 50 mg of the inner and outer composition, a total of about 5 mg to about 15 mg of the inner and outer composition, a total of about 5 mg to about 25 mg of the inner and outer composition, or a total of about 25 mg to about 50 mg of the inner and outer composition. A contemplated dual component capsule may include a total of about 50 mg to about 120 mg of the inner and outer composition, e.g., a total of about 50 mg to about 75 mg of the inner and outer composition, a total of about 60 mg to about 85 mg of the inner and outer composition, a total of about 50 mg to about 95 mg of the inner and outer composition, or a total of about 25 mg to about 110 mg of the inner and outer composition.

In certain embodiments, a disclosed dual component capsule includes an inner capsule with a reverse enteric polymeric coating, and an outer capsule with an enteric polymeric coating. Each respective coating, for example, allows for biphasic release of the capsule's contents (including bacterial strains) at distinct sites along the gastrointestinal tract. For example, it has been determined that the GI tract has several regions sharply demarcated by local pH ranging from 1 to 8.2. The normal pH profile of the GI tract rises and falls between the stomach and the colon with pH ranges of 1-4 in the stomach, 5.5-6.4 in the duodenum, 6.8-8.2 in the ileum, and 5.5-6.5 in the colon. For example, while the distal ileum contains a region where the usual pH is between 6.8 and 8.2, the pH drops sharply from 8.2 to 5.5 after passage through the ileocecal valve into the cecum and ascending colon. The pH gradually rises once again to 8.0 in the progression from proximal to distal colon. Accordingly, in certain embodiments, the enteric polymeric coating of the outer capsule solubilizes in a pH of about 7 to 8, allowing for release in the ileum, and the reverse enteric polymeric coating of the inner capsule solubilizes in a pH of about 6.2 to 6.5, allowing for subsequent release in the colon. In certain embodiments, the outer capsule maintains integrity (e.g., absence of splits, cracks, or rupture of capsule shell) for about 2 hours at pH 1.2 and 37° C. In certain embodiments, the outer capsule maintains integrity (e.g., absence of splits, cracks, or rupture of capsule shell) for about 2 hours at pH 5.5 and 37° C. In certain embodiments, the outer capsule disintegrates within about 1 hour at pH 7.4 and 37° C. In certain embodiments, the inner capsule maintains integrity (e.g., absence of splits, cracks, or rupture of capsule shell) for up to 1 hour at pH 7.4 and 37° C. In certain embodiments, the inner capsule disintegrates within 2 hours at pH 6.5 and 37° C.

In certain embodiments, the inner and/or outer capsule coating is comprised of poly(dl-lactide-co-glycolide, chitosan (Chi) stabilized with PVA (poly-vinylic alcohol), a lipid, an alginate, carboxymethylethylcellulose (CMEC), cellulose acetate trimellitiate (CAT), hydroxypropylmethyl cellulose phthalate (HPMCP), hydroxypropylmethyl cellulose, ethyl cellulose, food glaze, mixtures of hydroxypropylmethyl cellulose and ethyl cellulose, polyvinyl acetate phthalate (PVAP), cellulose acetate phthalate (CAP), shellac, copolymers of methacrylic acid and ethyl acrylate, or copolymers of methacrylic acid and ethyl acrylate to which a monomer of methylacrylate has been added during polymerization. Methylmethacrylates or copolymers of methacrylic acid and methylmethacrylate are available as Eudragit® polymers (Evonik Industries, Darmstadt, Germany). For example, Eudragit® L100 and Eudragit® S100 (anionic copolymers based on methacrylic acid and methyl methacrylate) can be used, either alone or in combination. Eudragit® L100 dissolves at about pH 6 and upwards and comprises between 46.0% and 50.6% methacrylic acid units per g dry substance; Eudragit® S100 dissolves at about pH 7 and upwards and comprises between 27.6% and 30.7% methacrylic acid units per g dry substance. Another exemplary group of encapsulating polymers are the polyacrylic acids Eudragit® L and Eudragit® S which optionally may be combined with Eudragit® RL or RS (copolymers of ethyl acrylate, methyl methacrylate and a low content of methacrylic acid ester with quaternary ammonium groups). These modified acrylic acids are useful since they can be made soluble at a pH of 6 to 7.5, depending on the particular Eudragit® chosen, and on the proportion of Eudragit® S to Eudragit® L, RS, and RL used in the formulation. In certain embodiments, a contemplated coating of the inner capsule is comprised of Eudragit EPO ReadyMix. In certain embodiments, a contemplated coating of the outer capsule is comprised of Eudragit® L100 (methylacrylic acid-methyl methacrylate co-polymer (1:1)) and Eudragit® S100 (methylacrylic acid-methyl methacrylate co-polymer (1:2)). In certain embodiments, a contemplated capsule is suitable for extended or timed release. In certain embodiments, a contemplated inner and/or outer capsule coating further comprises a band/seal, e.g., hypromellose, an opacifier, e.g., titanium dioxide, a plasticizer, e.g. triethyl citrate (TEC) or an anti-tacking agent, e.g. talc.

Further exemplary capsule-in-capsule formulations are described in U.S. Pat. No. 9,907,755.

Pharmaceutical compositions containing a bacterial strain disclosed herein can be presented in a unit dosage form, i.e., a pharmaceutical unit. A composition, e.g., a pharmaceutical unit provided herein, may include any appropriate amount of each bacterial strain, measured either by total mass or by colony forming units of the bacteria.

For example, a disclosed pharmaceutical composition or unit may include from about $10^3$ cfus to about $10^{12}$ cfus, about $10^6$ cfus to about $10^{12}$ cfus, about $10^7$ cfus to about $10^{12}$ cfus, about $10^8$ cfus to about $10^{12}$ cfus, about $10^9$ cfus to about $10^{12}$ cfus, about $10^{10}$ cfus to about $10^{12}$ cfus, about $10^{11}$ cfus to about $10^{12}$ cfus, about $10^3$ cfus to about $10^{11}$ cfus, about $10^6$ cfus to about $10^{11}$ cfus, about $10^7$ cfus to about $10^{11}$ cfus, about $10^8$ cfus to about $10^{11}$ cfus, about $10^9$ cfus to about $10^{11}$ cfus, about $10^{10}$ cfus to about $10^{11}$ cfus, about $10^3$ cfus to about $10^{10}$ cfus, about $10^6$ cfus to about $10^{10}$ cfus, about $10^7$ cfus to about $10^{10}$ cfus, about $10^8$ cfus to about $10^{10}$ cfus, about $10^9$ cfus to about $10^{10}$ cfus, about $10^3$ cfus to about $10^9$ cfus, about $10^6$ cfus to about $10^9$ cfus, about $10^7$ cfus to about $10^9$ cfus, about $10^8$ cfus to about $10^9$ cfus, about $10^3$ cfus to about $10^8$ cfus, about $10^6$ cfus to about $10^8$ cfus, about $10^7$ cfus to about $10^8$ cfus, about $10^3$ cfus to about $10^7$ cfus, about $10^6$ cfus to about $10^7$ cfus, or about $10^3$ cfus to about $10^6$ cfus of each bacterial strain, or may include about $10^3$ cfus, about $10^6$ cfus, about $10^7$ cfus, about $10^8$ cfus, about $10^9$ cfus, about $10^{10}$ cfus, about $10^{11}$ cfus, or about $10^{12}$ cfus of a bacterial strain or of each bacterial strain.

For example, a disclosed pharmaceutical composition or unit may include from about $10^3$ cfus to about $10^{12}$ cfus, about $10^6$ cfus to about $10^{12}$ cfus, about $10^7$ cfus to about $10^{12}$ cfus, about $10^8$ cfus to about $10^{12}$ cfus, about $10^9$ cfus to about $10^{12}$ cfus, about $10^{10}$ cfus to about $10^{12}$ cfus, about $10^{11}$ cfus to about $10^{12}$ cfus, about $10^3$ cfus to about $10^{11}$ cfus, about $10^6$ cfus to about $10^{11}$ cfus, about $10^7$ cfus to about $10^{11}$ cfus, about $10^8$ cfus to about $10^{11}$ cfus, about $10^9$ cfus to about $10^{11}$ cfus, about $10^{10}$ cfus to about $10^{11}$ cfus, about $10^3$ cfus to about $10^{10}$ cfus, about $10^6$ cfus to about $10^{10}$ cfus, about $10^7$ cfus to about $10^{10}$ cfus, about $10^8$ cfus to about $10^{10}$ cfus, about $10^9$ cfus to about $10^{10}$ cfus, about $10^3$ cfus to about $10^9$ cfus, about $10^6$ cfus to about $10^9$ cfus, about $10^7$ cfus to about $10^9$ cfus, about $10^8$ cfus to about $10^9$ cfus, about $10^3$ cfus to about $10^8$ cfus, about $10^6$ cfus to about $10^8$ cfus, about $10^7$ cfus to about $10^8$ cfus, about $10^3$ cfus to about $10^7$ cfus, about $10^6$ cfus to about $10^7$ cfus, or about $10^3$ cfus to about $10^6$ cfus of each bacterial strain, or may include about $10^3$ cfus, about $10^6$ cfus, about $10^7$ cfus, about $10^8$ cfus, about $10^9$ cfus, about $10^{10}$ cfus, about $10^{11}$ cfus, or about $10^{12}$ cfus of: (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain.

In certain embodiments, a provided pharmaceutical unit comprises at least $1 \times 10^3$ colony forming units of each bacterial strain (e.g., vegetative bacterial strain), or, at least $1 \times 10^4$ colony forming units of bacterial strain (e.g., vegetative bacterial strain), or, at least $1 \times 10^5$ colony forming units of bacterial strain (e.g., vegetative bacterial strain), or, at least $1 \times 10^6$ colony forming units of each bacterial strain (e.g., vegetative bacterial strain), or, at least $1 \times 10^7$ colony forming units of each bacterial strain (e.g., vegetative bacterial strain), or, at least $1 \times 10^8$ colony forming units of each bacterial strain (e.g., vegetative bacterial strain), or, at least $1 \times 10^9$ colony forming units of each bacterial strain (e.g., vegetative bacterial strain).

A composition, e.g., a pharmaceutical unit provided herein, may include each bacterial strain at any appropriate ratio, measured either by total mass or by colony forming units of the bacteria. For example, a disclosed pharmaceutical composition or unit may include two strains at a ratio of 0.1:1, 0.2:1, 0.25:1, 0.5:1, 0.75:1, 1:1, 2:1, 3:1, 4:1, 5:1, or 10:1, either by total mass or by colony forming units of the bacteria. For example, a disclosed pharmaceutical composition or unit may include three strains, e.g., (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and/or (iii) a *Roseburia* species strain, e.g., a *Roseburia hominis* strain, e.g., the RHO01 strain, at a ratio of 1:1:1, 1:1:2, 1:1:4, 1:2:1, 1:2:2, 1:2:4, 1:4:1, 1:4:2, 1:4:4, 2:1:1, 2:1:2, 2:1:4, 2:2:1, 2:4:1, 4:1:1, 4:1:2, 4:1:4, 4:2:1, 4:4:1, either by total mass or by colony forming units of the bacteria. For example, a disclosed pharmaceutical composition or unit may include (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and (iii) a *Roseburia* species strain, e.g., a *Roseburia hominis* strain, e.g., the RHO01 strain, at a ratio of 1:1:1, either by total mass or by colony forming units of the bacteria. For example, a disclosed pharmaceutical composition or unit may include approximately $1 \times 10^9$ viable organisms (e.g., cfus) of each of (i) a *Bacteroides* species strain, e.g., a *Bacteroides thetaiotaomicron* strain, e.g., the BTH01 strain; (ii) a *Eubacterium* species strain, e.g., a *Eubacterium hallii* strain, e.g., the EHA01 strain; and (iii) a *Roseburia* species strain, e.g., a *Roseburia hominis* strain, e.g., the RHO01 strain.

For example, disclosed compositions (e.g., a pharmaceutical unit such as e.g., a capsule) can include about 1 mg to about 5 mg (e.g., 2 mg to about 4 mg) of each separate bacterial strain, which can each be present in the unit, e.g., within about 5 mg to about 50 mg of a lyophilized powder form of the bacterial strain. For example, a pharmaceutical unit may comprise a total of about 30 mg to about 70 mg, about 30 mg to about 60 mg, about 30 mg to about 50 mg, about 30 mg to about 40 mg, about 40 mg to about 70 mg, about 40 mg to about 60 mg, about 40 mg to about 50 mg, about 50 mg to about 70 mg, about 50 mg to about 60 mg, about 80 mg to about 100 mg, about 90 mg to about 110 mg, about 100 mg to about 120 mg, or about 110 mg to about 150 mg of lyophilized powder forms of the bacterial strains. In certain embodiments, the pharmaceutical unit comprises a total of about 30 mg, 40 mg, 50 mg, 60 mg, 70 mg, 100 mg, 120 mg, 130 mg, 140 mg, or 150 mg of lyophilized powder form of the bacterial strains.

In certain embodiments, a disclosed composition such as a disclosed pharmaceutical unit may include about 5 to about 50 mg of each lyophilized powder form of a bacterial strain, for example, about 5 to about 45 mg, about 5 to about 40 mg, about 5 to about 35 mg, about 5 to about 30 mg, about 5 to about 25 mg, about 5 to about 15 mg, about 5 to about 10 mg, about 10 to about 50 mg, about 10 to about 35 mg of each lyophilized powder form of a bacterial strain, about 10 to about 20 mg, about 10 to about 15 mg, or about 15 to about 45 mg of each lyophilized powder form of a bacterial strain. In certain embodiments, a disclosed pharmaceutical unit comprises about 5, about 10, about 15, about 20, about 25, or about 30 mg of each lyophilized powder form of a bacterial strain. In certain embodiments, a disclosed pharmaceutical unit includes about 25 to about 50 mg of a lyophilized powder form of one bacterial strain and about 5 mg to about 10 mg of the remaining lyophilized powder forms of bacterial strains, or about 5 to about 15 mg of one lyophilized powder form of bacterial strain and about 5 to 10 mg of the remaining lyophilized powder forms of bacterial strains, for example, about 15 mg of one lyophilized powder form of bacterial strain and about 5 mg of the remaining lyophilized powder forms of bacterial strains, or about 15 mg to about 25 mg of each of two lyophilized powder forms of bacterial strains and about 5 mg to 10 mg of the remaining lyophilized powder form bacterial strains. In some embodiments, one or more (e.g. all) bacterial strain(s) of the lyophilized powder form are vegetative.

III. Therapeutic Uses

Compositions and methods disclosed herein can be used to treat various forms of gastrointestinal disorders, inflammatory disorders, and/or dysbiosis in a subject. The disclosure provides a method of treating a gastrointestinal disorder, inflammatory disorder, and/or dysbiosis in a subject. A contemplated method comprises administering to the subject an effective amount of a pharmaceutical composition, pharmaceutical unit, and/or bacterial strain disclosed herein, either alone or in a combination with another therapeutic agent to treat the gastrointestinal disorder, inflammatory disorder, and/or dysbiosis in the subject. A contemplated method comprises administering to the subject at least 2 vegetative bacterial strains each selected from the group consisting of: a *Bacteroides* species strain, a *Eubacterium* species strain, and a *Roseburia* species strain. In certain embodiments, the *Bacteroides* species is *Bacteroides thetaiotaomicron*. In certain embodiments, the *Eubacterium* species is *Eubacterium hallii*. In certain embodiments, the *Roseburia* species is *Roseburia hominis*.

As used herein, "treat", "treating" and "treatment" mean the treatment of a disease in a subject, e.g., in a human. This includes: (a) inhibiting the disease, i.e., arresting its development; and (b) relieving the disease, i.e., causing regression of the disease state. As used herein, the terms "subject" and "patient" refer to an organism to be treated by the methods and compositions described herein. Such organisms preferably include, but are not limited to, mammals, e.g., human, a companion animal (e.g., dog, cat, or rabbit), or a livestock animal (for example, cow, sheep, pig, goat, horse, donkey, and mule, buffalo, oxen, or camel)).

It will be appreciated that the exact dosage of a pharmaceutical unit, pharmaceutical composition, or bacterial strain is chosen by an individual physician in view of the patient to be treated, in general, dosage and administration are adjusted to provide an effective amount of the bacterial agent to the patient being treated. As used herein, the "effective amount" refers to the amount necessary to elicit a beneficial or desired biological response. An effective amount can be administered in one or more administrations, applications or dosages and is not intended to be limited to a particular formulation or administration route. As will be appreciated by those of ordinary skill in this art, the effective amount of a pharmaceutical unit, pharmaceutical composition, or bacterial strain may vary depending on such factors as the desired biological endpoint, the drug to be delivered, the target tissue, the route of administration, etc. Additional factors which may be taken into account include the severity of the disease state; age, weight and gender of the patient being treated; diet, time and frequency of administration; drug combinations; reaction sensitivities; and tolerance/response to therapy.

It is understood that a disclosed bacterial strain or bacterial strain mixture may not require colonization of the gut of the subject and/or persistence in the subject in order elicit a beneficial or desired biological response. For example, in certain embodiments, a bacterial strain or bacterial strain mixture colonizes or partially colonizes the gut of the subject and/or persists in the subject after administration. In certain embodiments, a bacterial strain or bacterial strain mixture does not colonize the gut of the subject and/or persist in the subject after administration.

Gastrointestinal disorders include for example, inflammatory bowel disease (IBD), Crohn's disease (CD), ulcerative colitis (UC), ulcerative proctitis, microscopic colitis, irritable bowel syndrome (IBS; e.g., IBS-c, IBS-m, or IBS-d), functional diarrhea, functional constipation, coeliac disease, radiation enteritis, *Clostridium difficile* (*C. difficile*) infection (CDI), recurrent *C. difficile* infection (rCDI), *C. difficile* associated diarrheal disease (CDAD), colitis (e.g., infectious, ischemic, indeterminate, or radiation colitis), ulcers (including gastric, peptic, and duodenal ulcers), gastroesophageal reflux disease (GERD), pouchitis, gastroenteritis, pancreatitis, mucositis (e.g., oral mucositis, gastrointestinal mucositis, nasal mucositis and proctitis), necrotizing enterocolitis, esophagitis, non-ulcer dyspepsia, chronic intestinal pseudo-obstruction, functional dyspepsia, colonic pseudo-obstruction, duodenogastric reflux, ileus inflammation, post-operative ileus, heartburn (high acidity in the GI tract), constipation (e.g., constipation associated with use of medications such as opioids, osteoarthritis drugs, osteoporosis drugs, post surgical constipation, or constipation associated with neuropathic disorders), hemorrhoids, diverticular disease, chronic pancreatitis, blind loop syndrome, gastroparesis (including diabetic and/or idiopathic), diarrhea, dysphagia, fecal incontinence, short bowel syndrome (SBS), intestinal ischemia, infant regurgitation, infant rumination syndrome, cyclic vomiting syndrome, globus, *volvulus*, cancers of the gastrointestinal tract, and gastrointestinal allergies. It is contemplated that compositions and methods disclosed herein can be used to treat any functional gastrointestinal disorder, including, for example, a disorder mediated by or otherwise associated with a brain-gut interaction.

Inflammatory Bowel Disease or IBD is used interchangeably herein to refer to diseases of the bowel that cause inflammation and/or ulceration and includes without limitation Crohn's disease and ulcerative colitis. Crohn's disease (CD) and ulcerative colitis (UC) are chronic inflammatory bowel diseases of unknown etiology.

Ulcerative colitis (UC) afflicts the large intestine. The course of the disease may be continuous or relapsing, mild or severe. The earliest lesion is an inflammatory infiltration with abscess formation at the base of the crypts of Lieberkuhn. Coalescence of these distended and ruptured crypts tends to separate the overlying mucosa from its blood supply, leading to ulceration. Symptoms of the disease include cramping, lower abdominal pain, rectal bleeding, and frequent, loose discharges consisting mainly of blood, pus and mucus with scanty fecal particles. A total colectomy may be required for acute, severe or chronic, unremitting ulcerative colitis.

Crohn's disease, unlike ulcerative colitis, can affect any part of the bowel. The most prominent feature Crohn's disease is the granular, reddish-purple edmatous thickening of the bowel wall. With the development of inflammation, these granulomas often lose their circumscribed borders and integrate with the surrounding tissue. Diarrhea and obstruction of the bowel are the predominant clinical features. As with ulcerative colitis, the course of Crohn's disease may be continuous or relapsing, mild or severe, but unlike ulcerative colitis, Crohn's disease is not curable by resection of the involved segment of bowel. Most patients with Crohn's disease require surgery at some point, but subsequent relapse is common and continuous medical treatment is usual.

Inflammatory disorders may be characterized, for example, based on the primary tissue affected, the mechanism of action underlying the disorder, or the portion of the immune system that is misregulated or overactive. Examples of inflammatory disorders include inflammation of the lungs, joints, connective tissue, eyes, nose, bowel, kidney, liver, skin, central nervous system, vascular system, heart, or adipose tissue. In certain embodiments, inflammatory disorders which may be treated include inflammation due to the infiltration of leukocytes or other immune effector cells or mediators thereof into affected tissue. In certain embodiments, inflammatory disorders which may be treated include inflammation mediated by IgA and/or IgE antibodies. Other relevant examples of inflammatory disorders which may be treated by the present disclosure include inflammation caused by infectious agents, including but not limited to viruses, bacteria, fungi, and parasites. In certain embodiments, the inflammatory disorder that is treated is an allergic reaction. In certain embodiments, the inflammatory disorder is an autoimmune disease.

Inflammatory lung disorders include asthma, adult respiratory distress syndrome, bronchitis, pulmonary inflammation, pulmonary fibrosis, and cystic fibrosis (which may additionally or alternatively involve the gastro-intestinal tract or other tissue(s)). Immune mediated inflammatory diseases include systemic lupus erythematosus, systemic vasculitis, Sjogren's syndrome, alopecia areata, and systemic sclerosis. Inflammatory joint disorders include rheumatoid arthritis, seronegative spondyloarthropathies including ankylosing spondylitis, juvenile rheumatoid arthritis, osteoarthritis, gouty arthritis and other arthritic disorders. Inflammatory eye disorders include uveitis (including iritis), conjunctivitis, episcleritis, scleritis, and keratoconjunctivitis sicca. Inflammatory bowel disorders include Crohn's disease, ulcerative colitis, inflammatory bowel disease, and distal proctitis. Inflammatory skin disorders include disorders associated with cell proliferation, such as psoriasis, eczema, dermatitis (e.g., eczematous dermatitides, topic and seborrheic dermatitis, allergic or irritant contact dermatitis, eczema craquelee, photoallergic dermatitis, phototoxicdermatitis, phytophotodermatitis, radiation dermatitis, and stasis dermatitis), and acne. Inflammatory disorders of the endocrine system include, but are not limited to, autoimmune endocrinopathies, autoimmune thyroiditis (Hashimoto's disease), Type 1 diabetes, inflammation in liver and adipose tissue associated with Type II diabetes, and acute and chronic inflammation of the adrenal cortex. Inflammatory disorders of the cardiovascular system include, but are not limited to, coronary infarct damage, peripheral vascular disease, myocarditis, vasculitis, revascularization of stenosis, atherosclerosis, and vascular disease associated with Type II diabetes. Inflammatory disorders of the kidney include, but are not limited to, glomerulonephritis, interstitial nephritis, lupus nephritis, nephritis secondary to Wegener's disease, acute renal failure secondary to acute nephritis, Goodpasture's syndrome, post-obstructive syndrome and tubular ischemia. Inflammatory disorders of the liver include, but are not limited to, hepatitis (arising from viral infection, autoimmune responses, drug treatments, toxins, environmental agents, or as a secondary consequence of a primary disorder), biliary atresia, primary biliary cirrhosis and primary sclerosing cholangitis. Metabolic disorders with inflammatory etiology include insulin resistance, metabolic syndrome, obesity, Nonalcoholic fatty liver disease (NAFLD), and Nonalcoholic steatohepatitis (NASH). In certain embodiments, the inflammatory disorder is an autoimmune disease, for example, rheumatoid arthritis, lupus, alopecia, autoimmune pancreatitis, Celiac disease, Behcet's disease, Cushing syndrome, and Grave's disease. In certain embodiments, the inflammatory disorder is a rheumatoid disorder, for example, rheumatoid arthritis, juvenile arthritis, bursitis, spondylitis, gout, scleroderma, Still's disease, and vasculitis. Additional exemplary inflammatory disorders include eosinophilic esophagitis and eosinophilic gastroenteritis.

Generally, dysbiosis refers to a state of the microbiota or microbiome of the gut or other body area, including, e.g., mucosal or skin surfaces (or any other microbiota niche) in which the normal diversity and/or function of the ecological network is disrupted. Any disruption from a typical (e.g., ideal) state of the microbiota can be considered a dysbiosis, even if such dysbiosis does not result in a detectable decrease in health. This state of dysbiosis may be unhealthy (e.g., result in a diseased state), or it may be unhealthy under only certain conditions, or it may prevent a subject from becoming healthier. Dysbiosis may be due to a decrease in diversity of the microbiota population composition, the overgrowth of one or more population of pathogens (e.g., a population of pathogenic bacteria) or pathobionts, the presence of and/or overgrowth of symbiotic organisms able to cause disease only when certain genetic and/or environmental conditions are present in a patient, or the shift to an ecological network that no longer provides a beneficial function to the host and therefore no longer promotes health. A distal dysbiosis includes, but is not limited to, a dysbiosis outside of the lumen of the gastrointestinal tract.

It is contemplated that dysbiosis may include infection with a pathogenic bacterium of a genus selected from the group consisting of *Yersinia, Vibrio, Treponema, Streptococcus, Staphylococcus, Shigella, Salmonella, Rickettsia, Orientia, Pseudomonas, Neisseria, Mycoplasma, Mycobacterium, Listeria, Leptospira, Legionella, Klebsiella, Helicobacter, Haemophilus, Francisella, Escherichia, Ehrlichia, Enterococcus, Coxiella, Corynebacterium, Clostridium, Chlamydia, Chlamydophila, Campylobacter, Burkholderia, Brucella, Borrelia, Bordetella, Bifidobacterium*, and *Bacillus*. Further examples of pathogenic bacteria include *Aeromonas hydrophila, Campylobacter fetus, Plesiomonas shigelloides, Bacillus cereus, Campylobacter jejuni, Clostridium botulinum, Clostridium difficile, Clostridium perfringens*, enteroaggregative *Escherichia coli*, enterohemorrhagic *Escherichia coli*, enteroinvasive *Escherichia coli*, enterotoxigenic *Escherichia coli* (LT or ST), *Escherichia coli* 0157: H7, *Helicobacter pylori, Lysteria monocytogenes, Plesiomonas shigelloides, Salmonella typhi, Staphylococcus aureus, Vibrio cholerae, Vibrio parahaemolyticus, Vibrio vulnificus, Yersinia enterocolitica*, carbapenem-resistant Enterobacteriaceae (CRE), extended spectrum beta-lactam resistant Enterococci (ESBL), vancomycin-resistant Enterococci (VRE), and multi-drug resistant bacteria.

It is further contemplated that compositions and methods disclosed herein can be used to treat a disorder of the liver, pancreas, or gallbladder.

IV. Combination Therapy

The methods and compositions described herein can be used alone or in combination with other therapeutic agents and/or modalities. The term administered "in combination," as used herein, is understood to mean that two (or more) different treatments are delivered to the subject during the course of the subject's affliction with the disorder, such that the effects of the treatments on the patient overlap at a point in time. In certain embodiments, the delivery of one treatment is still occurring when the delivery of the second begins, so that there is overlap in terms of administration. This is sometimes referred to herein as "simultaneous" or "concurrent delivery." In other embodiments, the delivery of one treatment ends before the delivery of the other treatment begins. In certain embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In certain embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered. In certain embodiments, a side effect of a first and/or second treatment is reduced because of combined administration.

In certain embodiments, a method or composition described herein is administered in combination with one or more additional therapies, for example, one or more anti-inflammatory agents. In certain embodiments, a contemplated additional therapy may include an aminosalicylate, a corticosteroid, a Tumor Necrosis Factor (TNF) antagonist, linaclotide, an antibiotic, or an immunosuppressive agent (e.g., azathioprine, 6-mercaptopurine, cyclosporine, methotrexate, or tacrolimus (Prograf®)). In certain embodiments, a contemplated additional therapy may include a biologic agent (e.g., infliximab (Remicade®), adalimumab (Humira®), certolizumab pegol (Cimzia®), golimumab (Simponi®), or etanercept (Enbrel®)). It is contemplated that a subject treated with a disclosed method or composition may have had an inadequate response to a previous administration of a therapy, e.g., a previous administration of an aminosalicylate, a corticosteroid, or a biologic agent.

Further therapeutic agents suitable for use in combination therapy with a pharmaceutical composition or unit described herein include proton pump inhibitors (such as pantoprazole (Protonix®), lansoprazole (Prevacid®), esomeprazole (Nexium®), omeprazole (Prilosec®), and rabeprazole), H2 blockers (such as cimetidine (Tagamet®), ranitidine (Zantac®), famotidine (Pepcid®), and nizatidine (Axid®)), prostaglandins (such as misoprostol (Cytotec®)), sucralfate, and antacids.

In certain embodiments, a pharmaceutical composition or unit may include, or be administered in combination with, a corticosteroid. Corticosteroids are a class of chemicals that includes steroid hormones naturally produced in the adrenal cortex of vertebrates and analogues of these hormones that are synthesized in laboratories. Corticosteroids are involved in a wide range of physiological processes, including stress response, immune response, and regulation of inflammation, carbohydrate metabolism, protein catabolismblood electrolyte levels, and behavior. Exemplary corticosteroids include betamethasone, budesonide, cortisone, dexamethasone, hydrocortisone, methylprednisolone, prednisolone, prednisone, or deflazacort. It is contemplated that a subject treated with a disclosed method or composition may have had an inadequate response to a previous administration of a corticosteroid.

In certain embodiments, a pharmaceutical composition or unit may include, or be administered in combination with, an aminosalicylate. Exemplary aminosalicylate include 4-Aminosalicylic acid, Balsalazide, Olsalazine, Sulfasalazine, and Mesalazine (5-Aminosalicylic acid). It is contemplated that a subject treated with a disclosed method or composition may have had an inadequate response to a previous administration of mesalamine, for example, a previous administration of ≥2.4 g/day mesalamine orally for at least 8 weeks.

In certain embodiments, a pharmaceutical composition or unit may include, or be administered in combination with, a Tumor Necrosis Factor (TNF) antagonist. Exemplary TNF antagonists include infliximab (Remicade®), adalimumab (Humira®), certolizumab pegol (Cimzia®), golimumab (Simponi®), etanercept (Enbrel®), thalidomide (Immunoprin), lenalidomide (Revlimid®), pomalidomide (Pomalyst®, Imnovid®), xanthine derivatives (e.g., pentoxifylline), and bupropion. It is contemplated that a subject treated with a disclosed method or composition may have had an inadequate response to a previous administration of a TNF antagonist.

In certain embodiments, a pharmaceutical composition or unit may include, or be administered in combination with, an integrin $\alpha\beta7$ antagonist, e.g., vedolizumab. It is contemplated that a subject treated with a disclosed method or composition may have had an inadequate response to a previous administration of an integrin $\alpha\beta7$ antagonist.

In certain embodiments, a pharmaceutical composition or unit may include, or be administered in combination with, an anti-bacterial agent, e.g., an antibiotic. A disclosed method may comprise pretreatment with an antibiotic, e.g., administration of an antibiotic to a subject prior to administration of a disclosed pharmaceutical composition or unit. Exemplary antibiotics for use in combination therapy include vancomycin, metronidazole, gentamicin, colistin, fidaxomicin, telavancin, oritavancin, dalbavancin, daptomycin, cephalexin, cefuroxime, cefadroxil, cefazolin, cephalothin, cefaclor, cefamandole, cefoxitin, cefprozil, ceftobiprole, cipro, Levaquin, floxin, tequin, avelox, norflox, tetracycline, minocycline, oxytetracycline, doxycycline, amoxicillin, ampicillin, penicillin V, dicloxacillin, carbenicillin, methicillin, ertapenem, doripenem, imipenem/cilastatin, meropenem, amikacin, kanamycin, neomycin, netilmicin, tobramycin, paromomycin, cefixime, cefdinir, cefditoren, cefoperazone, cefotaxime, ceftazidime, ceftibuten, ceftizoxime, ceftriaxone, cefoxotin, and/or streptomycin.

In certain embodiments, a pharmaceutical composition or unit may include, or be administered in combination with, an anti-fungal or anti-viral agent. Exemplary anti-viral agents include abacavir, acyclovir, adefovir, amprenavir, atazanavir, cidofovir, darunavir, delavirdine, didanosine, docosanol, efavirenz, elvitegravir, emtricitabine, enfuvirtide, etravirine, famciclovir, foscarnet, fomivirsen, ganciclovir, indinavir, idoxuridine, lamivudine, lopinavir, maraviroc, MK-2048, nelfinavir, nevirapine, penciclovir, raltegravir, rilpivirine, ritonavir, saquinavir, stavudine, tenofovir trifluridine, valaciclovir, valganciclovir, vidarabine, ibacitabine, amantadine, oseltamivir, rimantidine, tipranavir, zalcitabine, zanamivir and zidovudine. Exemplary anti-fungal agents include natamycin, rimocidin, filipin, nystatin, amphotericin B, candicin, and hamycin, miconazole, ketoconazole, clotrimazole, econazole, omoconazole, bifonazole, butoconazole, fenticonazole, isoconazole, oxiconazole, sertaconazole, sulconazole, tioconazole, fluconazole, itraconazole, isavuconazole, ravuconazole, posaconazole, voriconazole, terconazole, and albaconazole, abafungin, terbinafine, naftifine, butenafine, anidulafungin, caspofungin, micafungin, polygodial, benzoic acid, ciclopirox, tolnaftate, undecylenic acid, flucytosine or 5-fluorocytosine, griscofulvin, and haloprogin.

In certain embodiments a pharmaceutical composition or unit may include, or may be administered in combination with a prebiotic, i.e., a compound or composition which modifies the growth, maintenance, activity and/or balance of the intestinal micro flora (e.g., can allow for specific changes in the composition and/or activity of the microbiome). Exemplary prebiotics include complex carbohydrates, complex sugars, resistant dextrins, resistant starch, amino acids, peptides, nutritional compounds, biotin, polydextrose, fructooligosaccharide (FOS), galactooligosaccharides (GOS), inulin, lignin, *psyllium*, chitin, chitosan, chitosanoligosaccharides, lacitol, gums (e.g., guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, isomaltoligosaccharides, and xylooligosaccharides (XOS). Prebiotics can be found in foods (e.g., acacia gum, guar seeds, brown rice, rice bran, barley hulls, chicory root, Jerusalem artichoke, dandelion greens, garlic, leek, onion, asparagus, wheat bran, oat bran, baked beans, whole wheat flour, and banana), and breast milk. Prebiotics can also be administered in other forms (e.g., a capsule or dietary supplement).

Throughout the description, where compositions are described as having, including, or comprising specific components, or where processes and methods are described as having, including, or comprising specific steps, it is contemplated that, additionally, there are compositions of the present disclosure that consist essentially of, or consist of, the recited components, and that there are processes and methods according to the present disclosure that consist essentially of, or consist of, the recited processing steps.

In the application, where an element or component is said to be included in and/or selected from a list of recited elements or components, it should be understood that the element or component can be any one of the recited elements or components, or the element or component can be selected from a group consisting of two or more of the recited elements or components.

Further, it should be understood that elements and/or features of a composition or a method described herein can be combined in a variety of ways without departing from the spirit and scope of the present disclosure, whether explicit or implicit herein. For example, where reference is made to a particular compound, that compound can be used in various embodiments of compositions of the present disclosure and/or in methods of the present disclosure, unless otherwise understood from the context. In other words, within this application, embodiments have been described and depicted in a way that enables a clear and concise application to be written and drawn, but it is intended and will be appreciated that embodiments may be variously combined or separated without parting from the present teachings and disclosure. For example, it will be appreciated that all features described and depicted herein can be applicable to all aspects of the disclosure described and depicted herein.

It should be understood that the expression "at least one of" includes individually each of the recited objects after the expression and the various combinations of two or more of the recited objects unless otherwise understood from the context and use. The expression "and/or" in connection with three or more recited objects should be understood to have the same meaning unless otherwise understood from the context.

The use of the term "include," "includes," "including," "have," "has," "having," "contain," "contains," or "containing," including grammatical equivalents thereof, should be understood generally as open-ended and non-limiting, for example, not excluding additional unrecited elements or steps, unless otherwise specifically stated or understood from the context.

Where the use of the term "about" is before a quantitative value, the present disclosure also includes the specific quantitative value itself, unless specifically stated otherwise. As used herein, the term "about" refers to a +10% variation from the nominal value unless otherwise indicated or inferred.

It should be understood that the order of steps or order for performing certain actions is immaterial so long as the present disclosure remains operable. Moreover, two or more steps or actions may be conducted simultaneously.

The use of any and all examples, or exemplary language herein, for example, "such as" or "including," is intended merely to illustrate better the present disclosure and does not pose a limitation on the scope of the disclosure unless claimed. No language in the specification should be construed as indicating any non-claimed element as essential to the practice of the present disclosure.

EXAMPLES

The following Examples are merely illustrative and are not intended to limit the scope or content of the disclosure in any way.

Example 1—Overview of Bacterial Strain Selection Process for Consortium 1 (C1)

Consortium 1 (C1), a live biotherapeutic product for development as a treatment for gastrointestinal disorders, for example, dysbiosis and/or immune mediated inflammatory disorders, such as ulcerative colitis, Crohn's disease, and other forms of inflammatory bowel disease (IBD), comprises a consortium of three bacterial strains, namely *Bacteroides thetaiotaomicron* BTH01, *Eubacterium hallii* EHA01, and *Roseburia hominis* RHO01.

Candidate bacterial strains of interest were isolated from healthy donor stool samples, purified and characterized using standard anaerobic microbiological procedures. All stool donors underwent comprehensive clinical and laboratory testing to confirm healthy status including screening for infectious agents to minimize risk of transmissible infection. Serology screening included HIV-1/HIV-2 (IgG and EIA), HTLV-I and HTLV-II (Ab), Hepatitis A virus (IgM), Hepatitis B virus (HBSAg, anti-HBc IgG and IgM), Hepatitis C virus (anti-HCV IgG), *Treponema pallidum* (EIA, or RPR if EIA is positive), *Strongyloides stercoralis* Ab, CMV Viral Load, and EBV Viral Load. Stool screening included *Clostridium difficile* toxin A/B (PCR), Routine bacterial culture for enteric pathogens (with enrichment) including *H. pylori* EIA, *Salmonella, Shigella, Yersinia, Campylobacter,* and *Vibrio, E. coli* 0157 (perform *E. coli* 0157 culture, if stx 1/2 EIA+ve), Shiga-like toxins stx 1/2 (*Shigella*) EIA, Culture-based assays for vancomycin-resistant *Enterococcus* (VRE), extended spectrum beta-lactamase (ESBL) producers, carbapenem-resistant Enterobacteriaceae (CRE), and methicillin-resistant *Staphylococcus aureus* (MRSA), Giardia antigen (EIA), *Cryptosporidium* antigen (EIA), *Cyclospora, Isospora*, and Microsporidia (Microscopic observation with acid fast stain), Ova and Parasites (Microscopic observation), Rotavirus (EIA), Norovirus GI/GII (RT-PCR), and Adenovirus 40,41 EIA.

16S RNA sequencing was used to taxonomically identify candidate strains during the selection and screening process. Bacterial strains of interest underwent extensive phenotypic and genotypic characterization. Based on these data, a subset of candidate therapeutic strains were selected for further assessment in cell-based in vitro functional assays and in an in vivo mouse DSS colitis model (Chassaing et al., *Curr Protoc Immunol.;* 104: Unit 15.25 (2014)) to assess their potential in modulating inflammation and gut barrier integrity. Based on the results of these experiments, three bacterial strains were selected belonging to species taxa: *Bacteroides thetaiotaomicron, Eubacterium hallii*, and *Roseburia hominis*. The 16S RNA sequences of RHO01, BTH01, and EHA01 are provided in SEQ ID NOs: 1, 2, and 3, respectively. The taxonomic identity of each bacterial strain was confirmed via whole genome sequencing (WGS). The whole genome sequence of RHO01 is provided in SEQ ID NOs: 4-32. The whole genome sequence of BTH01 is provided in SEQ ID NOs: 33-390. The whole genome sequence of EHA01 is provided in SEQ ID NOs: 391-523. In accordance with the Budapest Treaty, strains BTH01, EHA01, and RHO01 were deposited with the DSMZ (Deutsche Sammlung von Mikroorganismen und Zellkulturen GmbH, Inhoffenstraße 7B, 38124 Brunswick, Germany) under DSM numbers BTH01 (DSM-32919), EHA01 (DSM-32920), and RHO01 (DSM-32921), respectively, on Sep. 14, 2018.

Information and data in support of the rationale for selecting the *Bacteroides thetaiotaomicron* strain (BTH01), the *Eubacterium hallii* strain (EHA01), and the *Roseburia hominis* strain (RHO01) for development of C1 are presented throughout the Examples, especially in Examples 2-6.

Example 2—Taxonomic and Phenotypic Characterization of C1 Bacterial Strains

A live biotherapeutic product, Consortium 1 (C1), was prepared by mixing three bacterial strains, namely BTH01, EHA01, and RHO01. Table 1 shows some of the physiological and metabolic characteristics of the C1 bacterial strains BTH01, EHA01 and RHO01. Gram staining of the three C1 bacterial strains showed EHA01 to be Gram positive, whereas, both BTH01 and RHO01 are Gram negative. All three strains are obligate anaerobes.

In order to investigate characteristics often found to be different among the strains of same bacterial species, analysis of carbon source utilization was performed for the C1 bacterial strains. The BTH01, EHA01 and RHO01 strains were evaluated for their ability to metabolize 190 carbon and 95 nitrogen sources using phenotypic microarrays (Biolog, Hayward, CA). As indicated in Table 1, BTH01 appeared to be most versatile in utilizing 34 unique carbon sources whereas EHA01 appeared to be least versatile, utilizing 8 unique carbon sources. Each of the BTH01, EHA01 and RHO01 strains were able to metabolize a few unique carbon sources that are not reported in the literature for their respective species. BTH01 was able to utilize D-Mannose, Maltose, a-D-Glucose, D-Galactose, Lactulose, Maltotriose, N-Acetyl-b-D-Mannosamine, N-Acetyl-D Glucosamine, D-Trehalose, a-D-Lactose, Sucrose, Turanose, Gentiobiose, D-Melibiose, D-Fructose, L-Fucose, L-Arabinose, D-Glucuronic Acid, D-Xylose, L-Rhamnose, D-Galacturonic Acid, α-Cyclodextrin, β-Cyclodextrin, γ-Cyclodextrin, Glycogen, Laminarin, Mannan, Pectin, N-Acetyl-D-Galactosamine, b-Methyl-D-Galactoside, D-Arabinose, Maltitol, Palatinose, and D-Raffinose. RHO01 was able to utilize D-Mannose, Maltose, a-D-Glucose, N-Acetyl-D Glucosamine, D-Trehalose, a-D-Lactose, Sucrose, Turanose, Gentiobiose, D-Cellobiose, Amygdalin, Arbutin, D-Melezitose, Salicin, D-Glucosamine, and b-Methyl-D-glucoside. EHA01 was able to utilize D-Mannose, Maltose, a-D-Glucose, D-Galactose, Lactulose, Maltotriose, N-Acetyl-b-D-Mannosamine, and L-Tartaric Acid.

Microbiota play a central role in bile acid metabolism. Analysis of IBD patient microbiota indicate an overall decrease in biodiversity with a specific decrease in bacteria from the Bacteroidetes and Firmicutes phylum, that are responsible for about 44% of the bile hydrolase activity in the gut (Baars et al., *Microorganisms* 3 (4): 641-666 (2015)). Consequently, restoring bile acid metabolism with microbes may be a potential avenue of therapeutic intervention. As conjugated bile salts possess antimicrobial activity, bacteria have evolved to produce bile salt hydrolase (BSH) to neutralize this adverse activity. A number of bacterial strains including *Bacteroides* species are tolerant to physiological concentrations of bile (Pumbwe et al., *Microb Pathog.* 43 (2-3): 78-87 (2007)).

In order to analyze bile tolerance among C1 bacterial strains, BTH01, EHA01 and RHO01, growth assays were performed in cultivation media with bile concentrations ranging from 0.2% up to 1.0%. Results are shown in Table 1. Compared to controls grown without bile added, 85% of the maximum OD was achieved by BTH01 in the presence of up to 0.6% bile concentration in growth media. RHO01 was also somewhat bile tolerant reaching 35% of maximum OD in the presence of 0.4% bile. EHA01 was sensitive to bile and exhibited growth inhibition even in the presence of 0.2% bile.

TABLE 1

Taxonomic Identities and Phenotypic Characteristics of C1 Bacterial Strains

| Strain Name | Genus Species (WGS) | Gram Stain | Oxygen Tolerance | Carbon Sources Utilized[1] | Nitrogen Sources Utilized | Bile Tolerance (%)[2] | Optimal pH Range |
|---|---|---|---|---|---|---|---|
| BTH01 | *Bacteroides thetaiotaomicron* | N | obligate anaerobe | 34 | 4 | 0.6[3] | 6.75-8.0 |

TABLE 1-continued

Taxonomic Identities and Phenotypic Characteristics of C1 Bacterial Strains

| Strain Name | Genus Species (WGS) | Gram Stain | Oxygen Tolerance | Carbon Sources Utilized[1] | Nitrogen Sources Utilized | Bile Tolerance (%)[2] | Optimal pH Range |
|---|---|---|---|---|---|---|---|
| EHA01 | Eubacterium hallii | P | obligate anaerobe | 8 | 3 | 0[3] | 6.0-7.25 |
| RHO01 | Roseburia hominis | N | obligate anaerobe | 16 | NA[5] | 0.4[4] | 6.0-6.75 |

N = Gram negative; P = Gram positive; WGS = whole genome sequencing
[1] 190 unique carbon sources were tested
[2] Physiological concentrations of bile salts in human intestine are typically between 0.1 to 1.3% (Pumbwe et al., 2007)
[3] 85% of the maximum OD was observed with a lag of eight hours to exponential phase in the presence of 0.6% bile in cultivation media
[4] 35% of the maximum OD was observed with a lag of five hours to exponential phase in the presence of 0.4% bile in cultivation media
[5] RHO01 growth was not supported by the minimal media used for the nitrogen source utilization assay Literature indicates all three of the C1 representative species to be non-sporulating. Using two distinct sporulation-inducing methods (i.e., heat-shock and chemical-shock), none of the C1 bacterial strains were found to sporulate. A positive control *Clostridium butyricum* (ATCC 19398) strain obtained from ATCC produced spores with both test methods as shown in Table 2.

TABLE 2

Assessment of Sporulation

| Test strain | Percent Sporulation with Heat-Shock Method | Percent Sporulation with Ethanol-Shock Method |
|---|---|---|
| C. butyricum | 2.68 | 24.49 |
| BTH01 | 0.0 | 0.0 |
| EHA01 | 0.0 | 0.0 |
| RHO01 | 0.0 | 0.0 |

Each bacterial strain from research cell banks (RCB) was tested for its susceptibility/resistance to a panel of clinically relevant antibiotics using an agar dilution minimal inhibitory concentration method (MIC), and each strain (RCB) was shown to be susceptible to at least two clinically relevant antibiotics (Table 3A).

TABLE 3A

Phenotypic Antibiotic Susceptibility Results for Research Cell Banks

| Compound | Class | Concentration Range (µg/mL) Max | Concentration Range (µg/mL) Min | Determined MIC (µg/mL), Interpretation BTH01 | Determined MIC (µg/mL), Interpretation EHA01 [1] | Determined MIC (µg/mL), Interpretation RHO01 [1] |
|---|---|---|---|---|---|---|
| Ampicillin | Penicillins | 128 | 0.06 | 32 (R) | 0.06 (S) | ≤0.016 (S) |
| Cefotetan | Cephalosporins (2nd generation) | 256 | 0.12 | 256 (R) | N/T | N/T |
| Clindamycin | Lincosamides | 32 | 0.016 | >32 (R) | 0.03 (S) | ≤0.016 (S) |
| Imipenem | Carbapenems | 32 | 0.016 | 0.5 (S) | 0.008 (S) | 0.12 (S) |
| Metronidazole | Other | 128 | 0.06 | 2 (S) | 0.06 (S) | 0.03 (S) |
| Moxifloxacin | Quinolones | 8 | 0.004 | 2 (S) | 2 (S) | 32 (R) |
| Vancomycin | Glycopeptides | 128 | 0.06 | 64 (N/A) | 0.12 (N/A) | 0.25 (N/A) |

N/A = no interpretive criteria available; N/T = not tested R = resistant; S = susceptible
[1] No growth on required CLSI agar; testing executed using Etests Example 3—Whole Genome Sequencing (WGS) Analysis of C1 Bacterial Strains Illumina® WGS of each bacterial strain genome (BTH01, EHA01 and RHO01) was performed to confirm taxonomic identity, and to evaluate the genomic evidence for the presence of antibiotic resistance genes, virulence factors and toxins, including evidence of associated mobile genetic elements.

Example 3.1—Genomic Analytical Methods

Taxonomic identity was assessed using the Joint Genome Institute's Microbial Species Identifier, which compares the average nucleotide identity (ANI) to a database of curated genomes and assigns taxonomy if ANI exceeds 96.5% and an alignment length of >70% between the query and reference genomes (Varghese et al., *Nucleic Acids Research*, 43 (14): 6761-6771 (2015)).

The presence of putative virulence factors, including toxins, was determined by comparing candidate bacterial strain genomes to three curated databases using BLAST: VFDB (Chen et al., *Nucleic Acids Res.* 2005 Jan. 1; 33 (2005)), PATRIC (Mao et al., *Bioinformatics*, 31 (2): 252-258 (2015)) and PHIDIAS (Xiang et. al., *Genome Biol.* 8 (7): R150 (2007)). Hits exceeding an e-value of 1e-7 with 70% identity over 70% of the reference sequence of the database hits were retained (Mao et al., 2015).

Putative antibiotic resistance genes were identified using the Resistance Gene Identifier/CARD package (Jia et al., *Nucleic Acids Res.* 45 (Database issue): D566-D573 (2017)).

Mobile genetic elements (MGE) within candidate bacterial strain genomes were predicted using IslandViewer 4

(Bertelli et al., *Nucleic Acids Res*. 45 (W1): W30-W35 (2017)) and Virsorter (for bacteriophage; Roux et al., eLife. 2015; 4: e08490 (2015)) to assess the theoretical potential for gene transfer. Default thresholds for MGE detection were used for Island Viewer 4 and phage predictions classified as "Confident" by Virsorter were retained.

Example 3.2—Results and Interpretation

Taxonomic assignments for candidate bacterial species exceeded the 96.5% ANI threshold for BTH01 (ANI=99.8%), EHA01 (ANI=97.5%), and RHO01 (ANI=98.1%).

While sequence analysis indicated the presence of antibiotic resistance in BTH01 and RHO01, no genomic evidence for antibiotic resistance was detected in EHA01. To confirm the clinical relevance of these data, empirical testing for antibiotic resistance/susceptibility was conducted on C1 research cell banks; results are presented in Table 3A. Selection of antibiotics was based on relevant antibiotic susceptibility patterns for the bacterial taxa under consideration. Importantly, all three candidate bacterial strains were shown to be susceptible to the majority of the antibiotics tested. While nucleic-acid-based techniques may become useful tools in the future for predicting antibiotic resistance, presently, there is little evidence to support the use of WGS to inform antibiotic susceptibility; concerns remain related to method standardization, accuracy and clinical interpretability (Ellington et al., *Clin Microbiol Infect*. 23 (1): 2-22 (2017)).

In our assessment of virulence factors, no genes directly associated with host mortality (e.g. genes specifically coding for toxins or secretion systems) were detected. Virulence factors identified were related to metabolic function or tolerance to physiological conditions within the host, which when impaired in pathogens through in vitro mutagenesis reduces their virulence by impairing growth or survival. It is thus not unexpected that genomes of host-associated commensal bacteria contain homologs of these genes and thus these data are not considered a clinically relevant safety risk.

In our assessment of MGE, no regions of the genomes of any strain were identified as derived from prophage using our criteria. Additionally, the bacterial candidate strains have been tested for the presence of bacteriophage and prophage via EM analyses (±mitomycin C induction). No bacteriophage or inducible prophage were detected. While other signatures of MGE were detected as shown in Table 3B, many types of MGE are not transmissible among bacteria (e.g. intracellular MGE; Siguier et al., *FEMS Microbiology Reviews*, 38 (5): 865-891 (2013)).

TABLE 3B

Presence of Predicted Antimicrobial Resistance Genes and Flanking Putative Mobile Genetic Elements (MGE)

| Strain Name | Gene | Antibiotic | Mechanism | MGE |
|---|---|---|---|---|
| BTH01 | ErmB | macrolide; lincosamide; streptogramin | antibiotic target alteration | Y |
|  | adeF | fluoriquinolone; tetracycline | antibiotic efflux | N |
|  | tetQ | tetracycline | antibiotic target protection | Y |
| EHA01 | None | N/A | N/A | N/A |
| RHO01 | tetW | tetracycline | antibiotic target protection | Y |

Example 4—Short-Chain Fatty Acid (SCFA) Production Profile of C1 Bacterial Strains Grown Individually or as a Consortium Short-Chain Fatty Acids (SCFAs) produced by human gut microbes include butyrate, acetate and propionate, all three of which are found to contribute to the maintenance of intestinal homeostasis through multiple mechanisms (Lee and Hase, *Nat Chem Biol* 10 (6): 416-424 (2014); Hoeppli et al., *Front Immunol* 6:61 (2015); Koh et al., *Cell* 165 (6): 1332-1345 (2016)). Butyrate is mainly produced by *Clostridium* cluster IV and XIVa species that include EHA01 and RHO01. On the other hand, *Bacteroides* species are major producers of acetate and propionate. The SCFA production profile of each of the C1 bacterial strain was evaluated after 72 hours of growth in batch culture in YCFAC media. As seen in FIG. 1A, acetate and propionate are the most abundant SCFA produced by BTH01. On the other hand, acetate and butyrate are the most abundant SCFA produced by EHA01 and RHO01, as expected (FIG. 1B, C). None of the three C1 bacterial strains produce a high amount of lactate. When grown as a consortium in batch cultures, acetate and butyrate are the most abundant SCFA produced (FIG. 1D).

Figure 2:
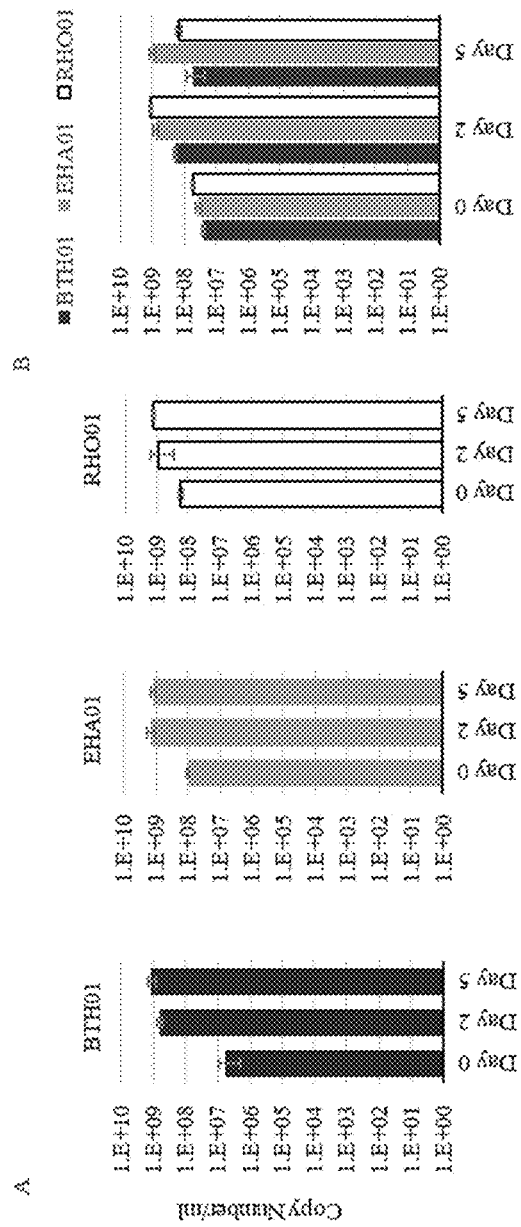
FIGS. 2A-2B depict the abundance of each of the C1 bacterial strains in individual as well as consortium fed-batch cultures. C1 bacterial strains were grown in replicate either individually or in consortium.

Certain microbial strains are known to produce compounds or toxins that inhibit growth of other microbes. There are examples of such antimicrobial compounds produced by strains belonging to gut microbiota (Spinler et al., *Anaerobe*. 14 (3): 166-71 (2008); Arief et al., *Benef Microbes*. 6 (4): 603-13 (2015); Renye Jr. et al., *Biotechnol Lett*. (11): 1947-1954 (2016)). In each of these examples, production of an antimicrobial compound results in significant growth inhibition of the susceptible strains within a short period of time (18 to 48 hours). Therefore, to rule out any antagonistic relationship between C1 bacterial strains, fed-batch culturing experiments were performed. Each of the C1 bacterial strains were grown either individually or in a consortium after normalizing inoculation cell counts. Cultures were transferred to fresh media after about 48 hours for 5 consecutive days. The 48-hour fed-batch transfer time was chosen based on previously determined growth rates of the individual strains in the YCFAC medium (data not shown), with the rationale of allowing enough time for each strain to reach to a maximum OD. Samples from replicate cultures at day 0 (right after inoculation), day 2 and day 5 were analyzed by qPCR to assess abundance of each of the C1 strains. As seen in FIG. 2A, all three C1 strains grew to a similar extent over time in individual cultures. When grown in consortium, abundance of all three C1 strains was maintained at or above the levels of inoculation over 5-day fed-batch cultures (FIG. 2B) indicating absence of any toxic/growth inhibitory relationship among C1 strains. EHA01 levels were higher compared to the BTH01 and RHO01 levels in day 5 samples, which is most likely resulting from higher growth rate of EHA01 compared to BTH01 and RHO01 in the YCFAC medium used for this experiment.

Example 5—Demonstration of Cross-Feeding Between C1 Bacterial Strains

The stability and function of a microbial community depends on nutritional interactions between community members such as the cross-feeding of essential small molecules synthesized by a subset of the population (Seth and Taga, 2014). Starches (polymers of glucose) are the most abundant polysaccharides in the human diet and occur in many foods, including cereal grains, legumes, and potatoes (Diet and Health: Implications for Reducing Chronic Disease Risk, National Academies Press (US), 1989)). In a typical Western diet, 33 to 50% of the caloric intake is in the form of carbohydrate. Approximately 17 to 25% of this total carbohydrate is represented by starch (britannica.com/science/carbohydrate/Role-in-human-nutrition, available on the world wide web).

To investigate if C1 bacterial strains exhibit cross-feeding, metabolic traits of the individual strains were identified that might allow these strains to cross-feed each other. For example, *Bacteroides* species encode an elaborate starch utilization system (Wexler et al., *Microb Genom.* 3 (11) (2017)). This includes extracellular secreted enzymes that generate starch digestion products such as oligomers, trimers (Maltotriose), dimers (maltose) and glucose monomers. From the experiments listed above to determine carbon source utilization of C1 strains, it was evident that EHA01 could utilize starch digestion products. However, based on the literature and available sequenced genomes, *Eubacterium hallii* species are not expected to express starch degradation enzymes.

Figure 3:
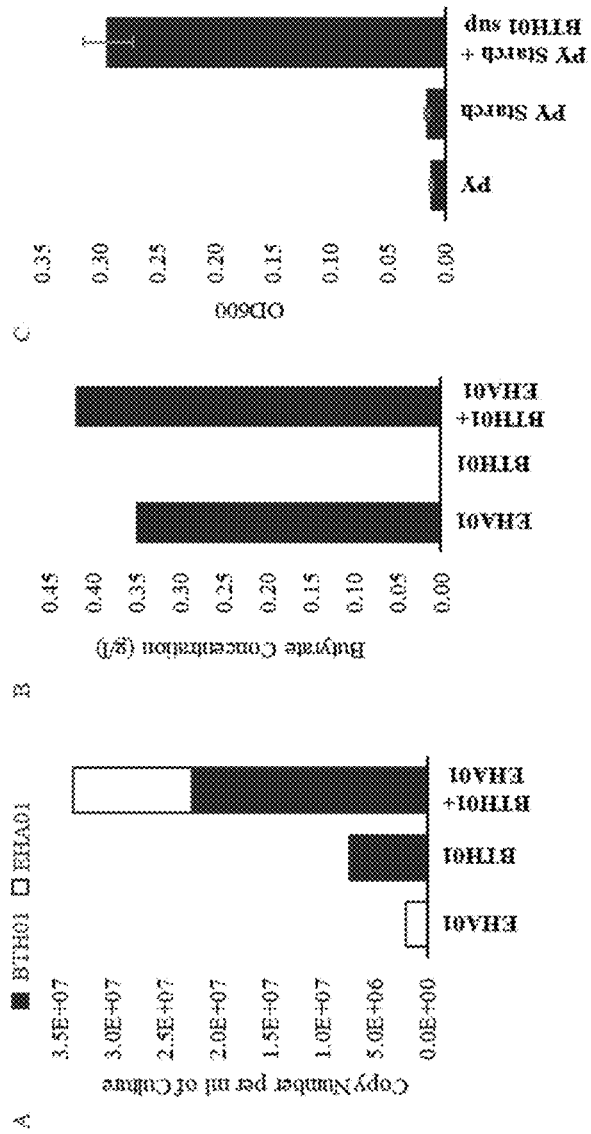
FIGS. 3A-3C depicts cross-feeding between EHA01 and BTH01. The EHA01 and BTH01 strains were grown individually or in co-culture in the presence of starch supplemented as a sole carbon source in the growth medium. After 48 hours of batch culture, the copy number of each strain was determined by species-specific qPCR (3A) and spent medium from each culture was analyzed for production of butyrate using HPLC (3B). In another experiment, the EHA01 strain was grown in Peptone-Yeast extract (PY) growth medium lacking any carbon source, PY medium supplemented with starch (PY starch) and PY medium supplemented with starch and 50% filter sterilized spent medium from a BTH01 culture previously grown for 48 hours. ODs of each of the three cultures are shown (3C).

As seen in FIG. 3A, qPCR-based copy number calculations showed that EHA01 exhibited poor growth compared to BTH01 in presence of starch as a sole carbon source provided in the growth medium. The copy number of EHA01 increased when grown in co-culture with BTH01 (FIG. 3A). A concomitant 25% increase in butyrate production by EHA01 was also observed when grown in co-culture with BTH01 in presence of starch as a sole carbon source (FIG. 3B).

To determine whether products secreted by BTH01 (including the starch degradation enzymes) could be responsible for boosting the growth of EHA01 in the presence of starch as a sole carbon source in the growth media, EHA01 culture media was supplemented with filtered supernatant from spent media in which BTH01 was previously grown. As seen in FIG. 3C, EHA01 growth in media containing starch as a sole carbon source was promoted only when BTH01 supernatant was added.

*Eubacterium hallii* species are reported to produce and secrete vitamin B12 which is essential for growth of other gut microbes including *Bacteroides thetaiotaomicron* species that sequester vitamin B12 from the extracellular milieu (Engels et al., *Front Microbiol.* 7:713 (2016)). Consequently, vitamin B12-mediated cross-feeding may be boosting the growth of BTH01 in co-culture with EHA01, as indicated by an increase in BTH01 copy number in co-culture compared to BTH01 grown in individual culture (FIG. 3A).

Taken together, these results indicate cross-feeding and mutually beneficial effects of co-culture between BTH01 and EHA01. *Roseburia* species are also able to utilize starch as sole carbon source. RHA01 and EHA01 showed similar cross-feeding when growth on starch as sole carbon source (data not shown).

Example 6—In Vitro and In Vivo Functional Activity of C1 Bacterial Strains and C1

This example describes studies of the activity of C1 bacterial strains separately, and as a consortium, in several in vitro and in vivo models, which may provide mechanistic insight to the potential clinical benefits.

Example 6.1—Preparation of Freshly Cultured Bacterial Strains and Consortium Working Stock Solutions for Cell Culture Assays Freshly cultured bacteria from overnight cultures were prepared in anaerobic conditions. EHA01 and RHO01 were grown using a rotator to allow mixing whereas BTH01 was grown without mixing. Bacteria were centrifuged at 4300×g for four minutes. Bacteria were washed once with pre-reduced anaerobic PBS (Gibco). Working stock solutions were prepared by resuspending washed bacteria with anaerobic PBS to the optical density of OD600=0.3 (~$10^8$ CFU/ml). 10-fold serial dilutions were made using anaerobic PBS for specific assays. The consortium of three bacteria was prepared by mixing working stock solutions of three individual bacteria 1:1:1 by volume. Lyophilized bacteria were prepared in anaerobic conditions using the same method of preparation as used to manufacture C1 drug substances. Working stock solutions of lyophilized bacteria were prepared by resuspending lyophilized bacteria in pre-reduced anaerobic PBS as described above.

Example 6.2—HT29-MTX-E12 Human Epithelial Barrier In Vitro Assay

The HT29-MTX-E12 human epithelial cell line (Sigma Aldrich cat #12040401-1VL) was cultured in 37° C. and 5% $CO_2$ using high glucose DMEM containing 4.00 mM L-glutamine, 4500 mg/L and sodium pyruvate (HyClone™) supplemented with 10% FBS (Tissue Culture Biologicals), 100 I·U/mL Penicillin, 100 µg/mL Streptomycin and 0.292 mg/mL L-glutamine (Corning). Passage number was restricted to 6 passages. Apical compartments of HTS 96-well Transwell plates with 0.4 µm microscopically transparent polyester membrane (Corning) were coated with Type 1 Collagen from rat tail (Sigma Aldrich). The HT29-MTX-E12 human cell line was cultured until 70-80% confluent in T-175 tissue culture flasks. Cells were removed with 0.25% Trypsin 2.21 mM EDTA and counted. 30,000 cells were plated onto the apical compartments of pre-coated transwell plates with DMEM culture medium as above and basal reservoirs of transwell plates were filled with the same medium. Cells were cultured in 37° C. and 5% $CO_2$ for 18 days until a confluent monolayer was formed as described previously (Hall et al., *Journal of Pediatric Surgery* 48:353-358 (2013)). Media in the apical compartment and basal reservoir were replaced with new media every two days. One day before the experiment, apical compartment inserts containing the confluent monolayer of HT29-MTX-E12 were transferred to HTS Transwell-96 well receiver plates (Corning). Cells were washed and resuspended with DMEM culture media without antibiotics and basal compartments of the transwell receiver plates were filled with the same.

A working solution of the indicated individual freshly cultured or lyophilized bacteria, consortium or anaerobic PBS control at 10% v/v was added onto the apical compartment of the transwell plates containing confluent HT29-MTX-E12 monolayers. Test articles were centrifuged down to the monolayer at 515×g for four minutes. HT29-MTX-E12 monolayers were co-incubated with test articles for one hour in 37° C. and 5% $CO_2$. 100 ng/ml TNF-α (InvivoGen) was added to the basal compartment of the transwell plate. Trans-epithelial electrical resistance (TEER) across the cell barrier was measured at 0 and 24 hours after addition of TNF-α using the STX100C electrode attached to EVOM2 Volt/Ohm (TEER) Meter (World Precision Instruments).

Example 6.3—Human Macrophage and Monocyte In Vitro Cytokine and Chemokine Assay

The THP-1 human monocyte cell line (ATCC cat #TIB-202) was cultured in 37° C. and 5% $CO_2$ using RPMI 1640 containing 2.05 mM L-glutamine (Corning) supplemented with 10% heat-inactivated FBS (Tissue Culture Biologicals), 100 I·U/mL Penicillin, 100 g/mL Streptomycin and 0.292 mg/mL L-glutamine (Corning). Passage number was restricted to 8 passages. The THP-1 human monocyte cell line was grown until 70-80% confluent. Cells were counted and resuspended in culture media. 100,000 cells were plated per well onto 96 well plates. THP-1 human macrophages were made by culturing the THP-1 human monocyte cells with 10 ng/mL phorbol 12-myristate 13-acetate (PMA) (InvivoGen) for 24 hours followed by 20 ng/mL IL-4 (R&D Systems) and 20 ng/ml IL-13 (R&D Systems) for 48 hours in 37° C. and 5% $CO_2$ as described previously (Genin et al., *BMC Cancer.*15:577 (2015)). One day before the experiment, cells were washed and resuspended in RPMI culture media without antibiotics containing 20 ng/ml IL-4 and 20 ng/ml IL-13.

A working stock solution of the indicated individual freshly cultured or lyophilized bacteria, consortium or anaerobic PBS control was added onto THP-1 macrophages at 10% v/v and centrifuged down onto the THP-1 cells at 515×g for four minutes. 100 ng/ml LPS (InvivoGen) was added at the same time as the test articles. The test articles, LPS and THP-1 macrophages were co-incubated for 24 hours in 37° C. and 5% $CO_2$. THP-1 cell supernatants were collected and analyzed by ELISA. IL-10 and CCL-18 levels in culture supernatants were quantified by using commercial enzyme-linked immunosorbent assay (ELISA) kits from Biolegend or R&D Systems with TMB detection according to manufacturer's specifications.

Example 6.4—Human PBMC In Vitro Cytokine Assay

Trima residual blood product containing concentrated blood mononuclear cells was obtained from anonymous donors through Blood Centers of the Pacific (San Francisco, CA) and processed within 24 hours of collection. Blood samples were tested negative for HIV, HBV. HCV, HTLV, Syphilis, West Nile Virus and Zika Virus. PBMC were isolated using a ficoll gradient as described previously (Sim et al., *J. Vis. Exp.* (112), e54128 (2016)). Briefly, 50 mL of Trima residual was diluted with 50 mL of sterile PBS (Gibco) and 25 mL was overlaid on 15 mL Ficoll-Paque Plus (GE Healthcare) in 50 mL conical tubes. The samples were centrifuged at 450×g for 30 min at room temperature and allowed to stop without brake. The PBMC interphase was collected, washed with PBS and resuspended in RPMI 1640 containing 2.05 mM L-glutamine (Corning) supplemented with 10% heat-inactivated FBS (Tissue Culture Biologicals) and 0.292 mg/mL L-glutamine (Corning). The cells were maintained by incubation in 37° C. and 5% $CO_2$ and used for assay evaluation within 24 h or frozen for later use. Cells were cryopreserved in RPMI 1640 supplemented with 50% FBS and 10% DMSO (Sigma Aldrich) at a concentration of $5\times10^7$ cells/mL and stored in liquid nitrogen until ready for use.

Human PBMC, used immediately after isolation or thawed from cryo-storage, were diluted to $1\times10^6$ cells/mL in RPMI 1640 containing L-glutamine (Corning) supplemented with 10% heat-inactivated FBS (Tissue Culture Biologicals) and 0.292 mg/mL L-glutamine (Corning). A 100 μL aliquot of the $1\times10^6$ cells/mL cell suspension was added to each well within a flat-well 96 well plate and cultured for 24 hours at 37° C. and 5% $CO_2$ before addition of test articles.

Test articles were prepared and added as described for other assays. After 24 hours of incubation in 37° C. with 5% $CO_2$, the plates containing cocultures were centrifuged (515×g; four minutes) and supernatant was collected and analyzed by ELISA as per above.

Example 6.5—Freshly Cultured C1 in HT29-MTX-E12 Human Epithelial Barrier Assay

Figure 4:
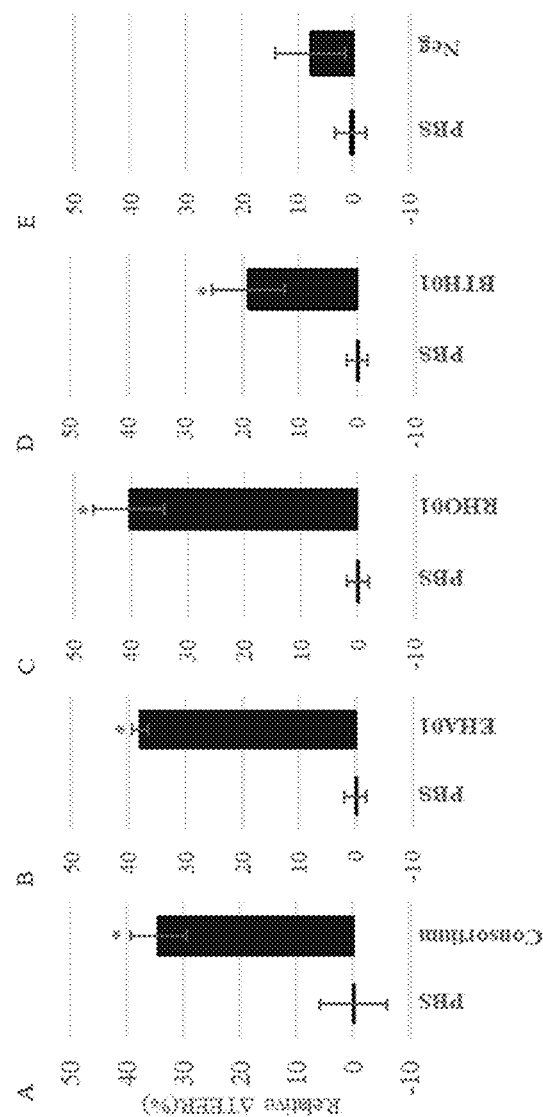
FIGS. 4A-E depicts the effect of freshly cultured C1 bacterial strains and consortium on HT29-MTX-E12 barrier integrity. The % change in TEER (ohms×cm$^2$) between time 0 and 24 hour following basal compartment addition of TNF-α was plotted for 10% v/v of freshly cultured (4A) consortium of BTH01, EHA01 and RHO01, (4B) EHA01, (4C) RHO01, (4D) BTH01 and (4E) an unrelated bacterial strain negative control with no protective effect. The PBS control was set as baseline. Each test article was evaluated in 6 replicates and results are representative of at least two independent experiments. *p value≤0.05 student t-test.

Human ulcerative colitis (UC) patients develop symptoms of increased intestinal permeability which can be reversed by reducing the levels of an inflammatory cytokine TNF-α with anti-TNF-α therapy (Michiclan et al., *Mediators Inflamm.* 2015:628157 (2015)). Finding novel therapeutics that can reduce gut permeability and barrier disruption remains an important goal in developing treatments for colitis. The functional activity of each C1 bacterial strain (BTH01, EHA01 and RHO01) and the consortium of three strains was evaluated on human epithelial cells in the presence of TNF-α, as a model of gut barrier damage and permeability. The confluent HT29-MTX-E12 human epithelial cell line forms a polarized monolayer and produces mucin which are two major characteristics of primary human intestinal epithelial cells (Dolan et al., *PLoS One.* 7 (10): c47300 (2012)). FIG. 4 shows a significant increase in TEER (measurement of cell monolayer integrity) when the three freshly cultured C1 bacterial strains were incubated individually and as a consortium with the HT29-MTX-E12 monolayer in the presence of TNF-α compared to the PBS controls. This indicates that C1 bacterial strains individually and as a consortium can protect human epithelial cells from cytokine-induced barrier damage and can reduce intestinal barrier permeability.

Figure 5:
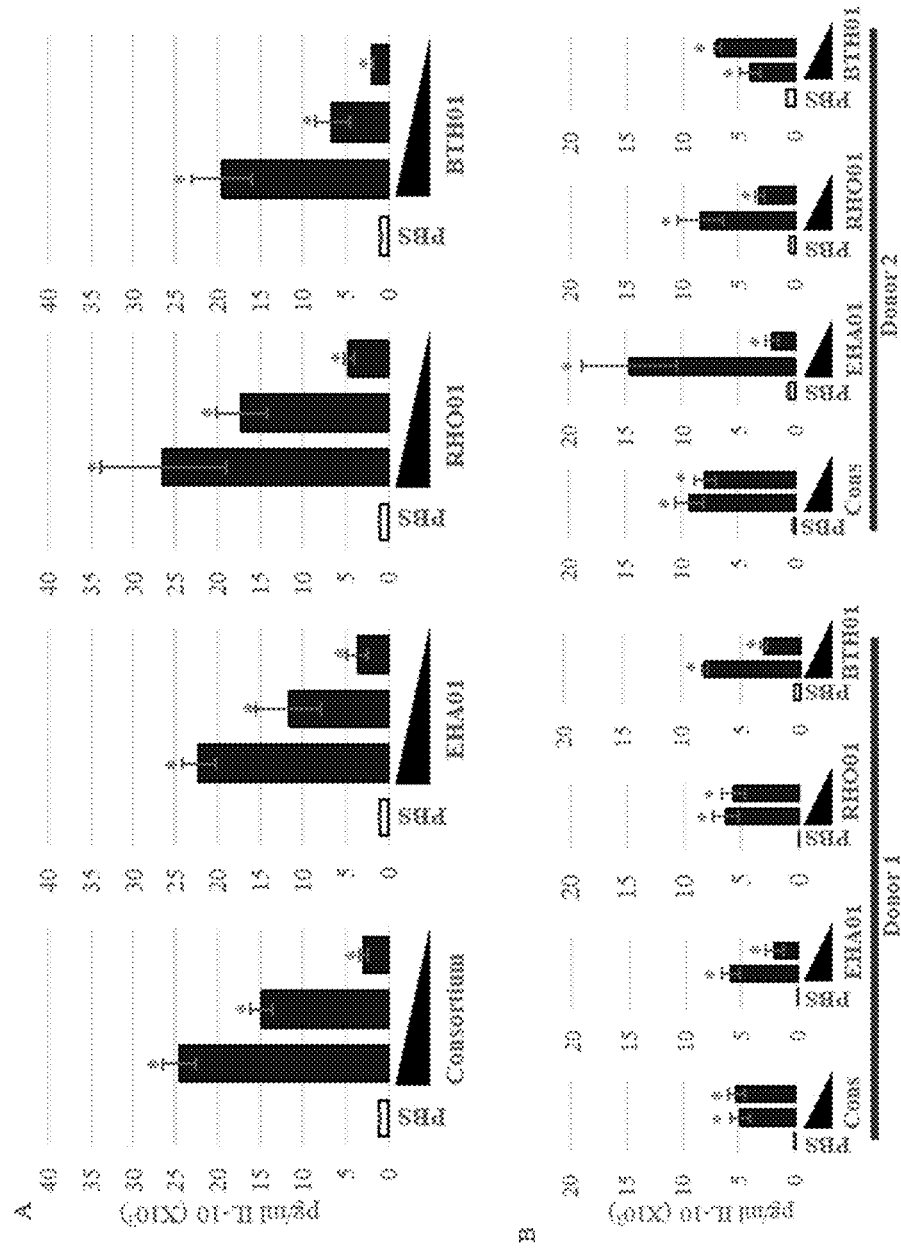
FIG. 5 depicts the effect of freshly cultured C1 bacterial strains and consortium on human THP-1 macrophage and PBMC IL-10 production. THP-1 macrophage supernatants were collected after the assay was completed and (5A) IL-10 concentrations in culture supernatant were plotted for 10%, 3.3% and 1.0% v/v working solution of each individual strain (BTH01, EHA01 and RHO01), the consortium of three strains or PBS (LPS-only) control. Each test article was evaluated in 4 replicates and results are representative of at least two independent experiments. Primary human PBMC supernatants were collected after the assay was completed and (5B) IL-10 concentrations in culture supernatants from PBMC donor 1 and PBMC donor 2 were plotted for 10% or 1% v/v working solution of individual strains or the consortium. Each test article was evaluated in 4 replicates and results are representative of at least two independent experiments. *p value≤0.05 student t-test.

Example 6.6—Freshly Cultured C1 Bacterial Strains and Consortium in Human Macrophage and Monocyte In vitro Cytokine and Chemokine Assay IL-10 is an anti-inflammatory cytokine released by immune cells vital to intestinal homeostasis (Kole et al., *Curr Top Microbiol Immunol.* 380:19-38 (2014)). Mice with genetic deletion of IL-10 (Wilson et al., *PLoS* Pathog. (8): c1002171 (2011)) and humans with IL-10 loss of function mutations (Bisborough et al., *Am J Gastroenterol* Suppl 3:27-37 (2016)) have increased susceptibility to UC development. IL-10-producing intestinal macrophages are protective against infections by the colitis-inducing intestinal pathogen *C. rodentium* (Krause et al., *Nature Communications* 6:7055 (2015)). Therapies targeting mechanisms to increase IL-10 levels have shown promise but lack sufficient efficacy (Li and He, *World J Gastroenterol.* 10 (5): 620-5 (2004)). Improvement in IL-10 promoting therapies remains an attractive strategy for therapeutics against colitis. Each individual bacterial strain and all three together as a consortium were evaluated for the ability to induce IL-10 production by human THP-1 macrophages, in the presence of LPS, and primary human PBMCs. FIG. 5 shows a significant, dose-dependent increase in the production of the anti-inflammatory cytokine IL-10 by (A) THP-1 macrophages and (B) primary human PBMCs induced by each individual freshly cultured bacterial strain or the consortium of three strains. The results indicate that C1 bacterial strains can induce anti-inflammatory IL-10 production in human THP-1 macrophages and primary human monocytes.

Figure 6:
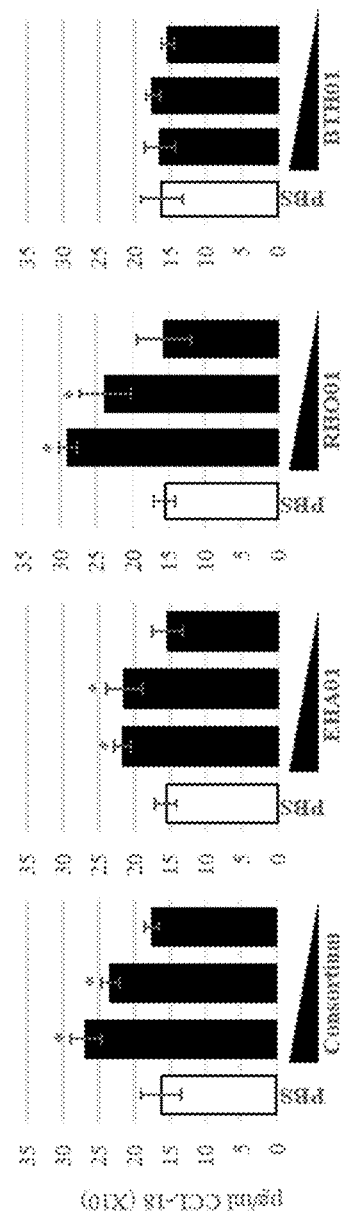
FIG. 6 depicts the effect of freshly cultured C1 bacterial strains and consortium on human THP-1 macrophage CCL-18 production. THP-1 macrophage supernatants were collected after the assay was completed and CCL-18 concentrations in culture supernatant were plotted for 10%, 3.3% and 1.0% v/v working solution of each individual strain (BTH01, EHA01 and RHO01), the consortium of three strains or PBS control. Each test article was evaluated in 4 replicates and results are representative of at least two independent experiments. *p value≤0.05 student t-test.

Each freshly cultured individual C1 bacterial strain or consortium of three strains was evaluated for the ability to induce CCL-18, an M2-macrophage-associated chemokine, by THP-1 macrophages. Induction and polarization of M2 macrophages has previously been reported to be a critical mechanism of protection against inflammatory bowel disease and colonic inflammation (Sco et al., *Sci. Rep* 7 (1): 851 (2017); Steinbach et al., *Inflamm Bowel Dis.* 20 (1): 166-175 (2014)). CCL-18 is a validated marker for M2 macrophages (Genin et al., *BMC Cancer* 15:577 (2015)). FIG. 6 shows a significant, dose-dependent increase in the production of CCL-18 when individual strains EHA01 and RHO01, and the consortium of three strains, EHA01, RHO01 and BTH01 were co-cultured with THP-1 macrophages compared to PBS controls; BTH01 alone did not induce CCL-18. These data indicate that two of three C1 bacterial strains and the consortium can increase the production of CCL-18 from human macrophages which indicates the induction and polarization of anti-inflammatory M2 macrophages.

Example 6.7—Lyophilized C1 in HT29-MTX-E12 Human Epithelial Barrier Assay

Figure 7:
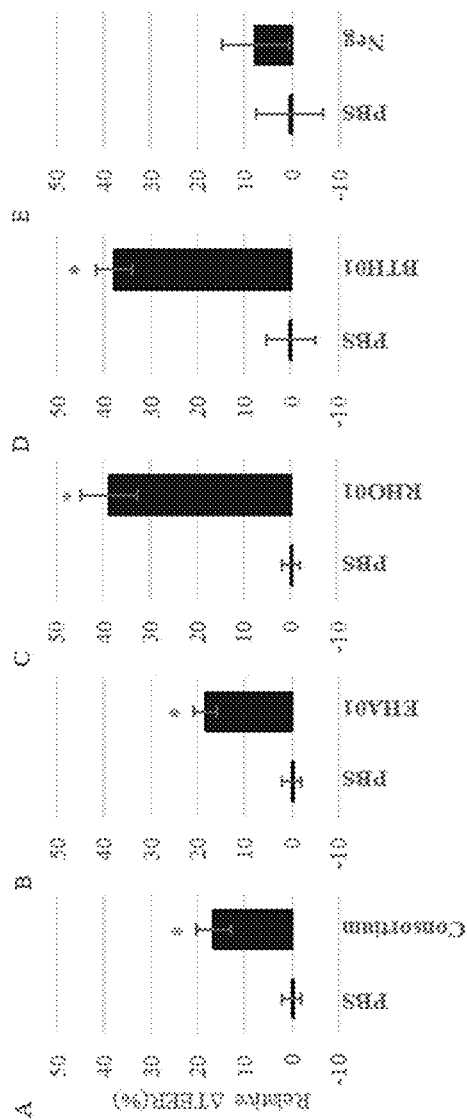
FIG. 7 depicts the effect of lyophilized C1 bacterial strains and consortium on HT29-MTX-E12 barrier integrity. The % change in TEER (ohms×cm$^2$) between time 0 and 24 hour following basal compartment addition of TNF-α was plotted for 10% v/v working solution of lyophilized (7A) consortium of BTH01, EHA01 and RHO01, (7B) EHA01, (7C) RHO01, (7D) BTH01 and (7E) an unrelated bacterial strain negative control with no protective effect. The PBS control was set as baseline. Each test article was evaluated in 6 replicates and results are representative of at least two independent experiments. *p value≤0.05 student t-test.

Results using freshly cultured C1 bacterial strains showed that strains individually and as a consortium can protect human intestinal epithelial cells from TNF-α-induced barrier damage. Since C1 bacterial strains are prepared as a lyophilized drug substance for oral delivery as a therapeutic, the lyophilized forms of C1 bacterial strains were tested to ensure that they retain barrier protective effects. Individual C1 strains were prepared as lyophilized powder using the same methods as used to manufacture C1 drug substances. FIG. 7 shows that individual lyophilized C1 bacterial strains or the consortium of all 3 significantly increased TEER when incubated with the HT29-MTX-E12 monolayer in the presence of TNF-α, compared to the PBS controls. This indicates that a lyophilized form of C1 bacterial strains retains protective effects and reduces intestinal epithelial permeability when tested on human epithelial cells in the presence of TNF-α-induced barrier damage.

Figure 8:
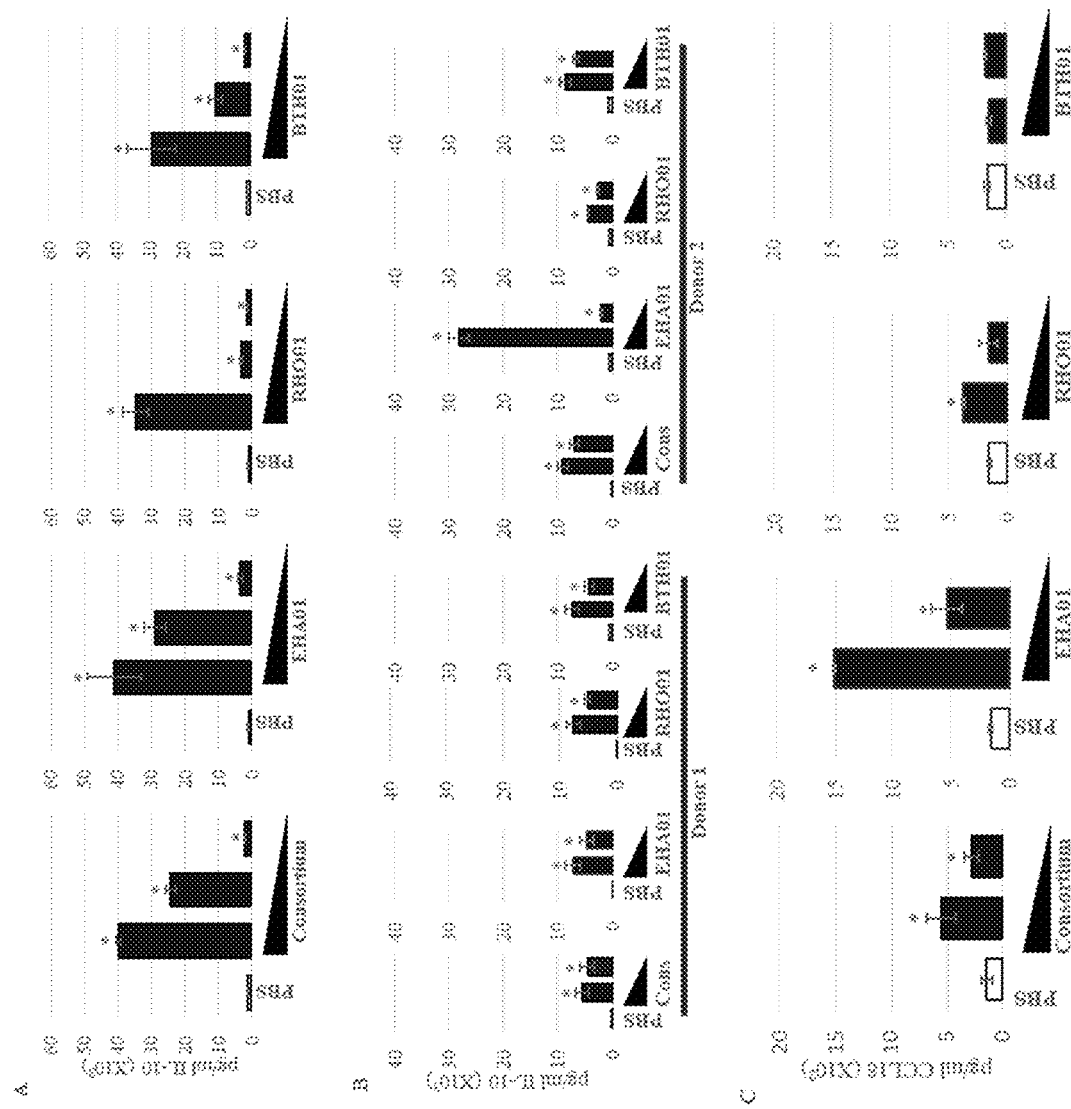
FIGS. 8A-8D depicts the in vitro effects of lyophilized individual C1 bacterial strains or consortium on IL-10 cytokine and CCL-18 chemokine production in THP-1 human macrophage model and IL-10 production in human PBMC model. THP-1 macrophage supernatants were collected at the conclusion of the assay and (8A) IL-10 concentrations in culture supernatant were plotted for 10%, 3.3% and 1.0% v/v working solution of each individual lyophilized strain (BTH01, EHA01 and RHO01), the consortium of three strains or PBS (LPS-only) control. Primary human PBMC supernatants were collected at conclusion of the assay and (8B) IL-10 concentrations in culture supernatants from PBMC donor 1 and PBMC donor 2 were plotted for 10% or 1% v/v working solution of individual lyophilized strains or the consortium. THP-1 macrophage supernatants were collected at conclusion of the assay and (8C) CCL-18 concentrations in culture supernatant were plotted for 10% and 1.0% v/v working solution of each individual lyophilized strain (BTH01, EHA01 and RHO01), the consortium of three strains or PBS control. Each test article was evaluated in 4 replicates and results are representative of at least two independent experiments.

Example 6.8—Lyophilized C1 Bacterial Strains in Human Macrophage and Monocyte In vitro Cytokine and Chemokine Assays Similar to the results in the human intestinal epithelial barrier assay, the lyophilized forms of C1 individual strains and all three together as a consortium retained the ability to induce the anti-inflammatory cytokine IL-10 and M2 macrophage-associated chemokine CCL-18 in human THP-1 macrophages (FIG. 8A, IL-10 and FIG. 8C, CCL-18). The lyophilized forms of C1 also retained the ability to induce IL-10 in primary human PBMC (FIG. 8B).

Example 6.9—UC Fecal Microflora in HT29-MTX-E12 Human Epithelial Barrier In vitro Assay and in Human THP-1 Macrophage In vitro Cytokine Assay Aliquots of glycerol stocks including 50% glycerol: 50% UC fecal sample were prepared. A working stock solution was prepared by thawing a glycerol stocks on the day of the experiment in anaerobic conditions, followed by washing and resuspending with pre-reduced anaerobic PBS to the optical density of OD600-0.3 (~$10^8$ CFU/ml). This working stock solution of the UC microflora was added to the apical compartment of transwell plates containing confluent HT29-MTX-E12 monolayers (10% v/v) along with either working stock solutions of freshly cultured C1 consortium (10% v/v), or anaerobic PBS control (10% v/v). The TEER assay was conducted as described, without added TNFα. Similarly, the UC microflora working stock solution was added to THP-1 macrophages (10% v/v), with or without freshly cultured C1 consortium working stock solution (10% v/v) or anaerobic PBS control. After four hours of co-incubation in 37° C. and 5% $CO_2$, THP-1 macrophages were washed and resuspended with RPMI culture media supplemented with Pen/Strep to remove excess bacteria. THP-1 macrophages were incubated for 24 hours in 37° C. and 5% $CO_2$. THP-1 cell supernatants were collected and analyzed for IL-10 using ELISA.

Figure 9:
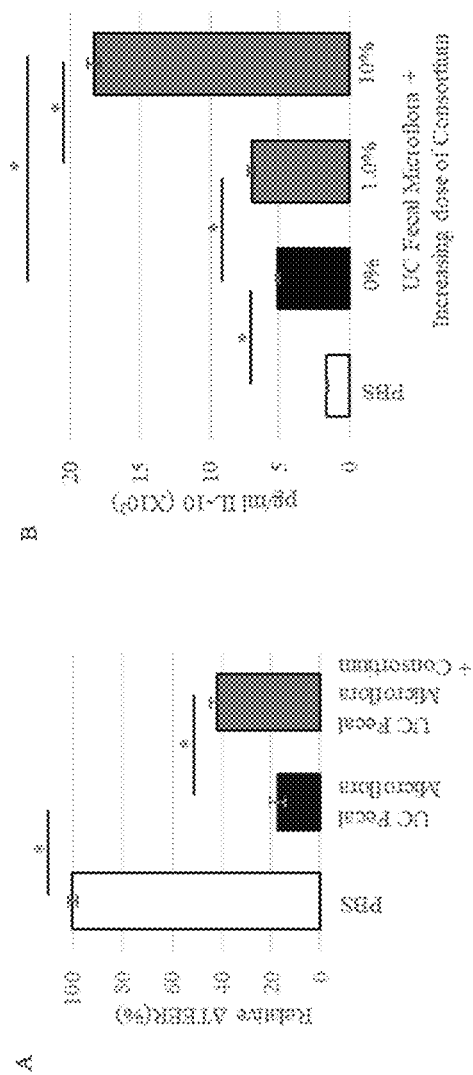
FIGS. 9A-9B depicts the effect of freshly cultured C1 consortium in HT29-MTX-E12 human epithelial barrier in vitro assay and in human THP-1 macrophage in vitro cytokine assay in the presence of UC fecal microflora. (9A) The % change in TEER (ohms×cm$^2$) between time 0 and 24 hour are plotted for the indicated test articles. The PBS control was set as the relative maximum. Each test article was evaluated in 6 replicates and results are representative of at least two independent experiments. (9B) THP-1 macrophage supernatants were collected at the end of the assay and IL-10 concentrations in culture supernatant were plotted for the PBS control, UC fecal microflora added with the indicated v/v amount of C1 consortium. Each test article was evaluated in 4 replicates and results are representative of at least two independent experiments. * p value≤0.05 student t-test.

The C1 consortium was tested for ability to protect against barrier damage induced by UC fecal microflora in the HT29-MTX-E12 human intestinal epithelial barrier assay. FIG. 9A demonstrates that addition of the UC fecal microflora alone reduced the TEER of the HT29-MTX-E12 monolayer suggesting that microbes in the UC fecal microflora can damage the monolayer and increase its permeability. When the HT29-MTX-E12 monolayer was co-incubated with the UC fecal microflora and freshly cultured C1 consortium, the reduction in TEER by the UC fecal microflora is significantly inhibited (FIG. 9A). This indicates that the C1 consortium can protect human intestinal epithelial cells from UC fecal microflora induced damage and reduce barrier permeability.

The C1 consortium was tested for ability to induce the anti-inflammatory cytokine IL-10 in THP-1 macrophages in the presence of UC fecal microflora. FIG. 9B shows that UC fecal microflora alone can induce IL-10 from THP-1 macrophages, but addition of C1 consortium significantly enhanced IL-10 production which was dose-dependent. This indicates that the C1 consortium can increase the induction of IL-10 in human macrophages in the presence of a UC microflora.

Example 6.10—C1 Bacterial Strains in Human Macrophage Autophagy and IL-10 Assays Autophagy is an intracellular process whereby unwanted or damaged cytoplasmic constituents (such as proteins and organelles) are degraded within lysosomes (Doria et al., *N Engl J Med* 368 (19): 1845 (2013)). This process plays an important role in innate and adaptive immunity and maintenance of homeostasis, and acts as a defense mechanism against invading pathogens. Autophagy dysfunction can have various pathological consequences, including tumor progression, pathogen hyper-virulence, and neurodegeneration, and has been suggested to be associated with the pathogenesis of several autoimmune and inflammatory disorders, such as systemic lupus erythematosus, psoriasis, rheumatoid arthritis, inflammatory bowel disease, and multiple sclerosis (Yin et al., *Front Immunol.* 2018; 9:1512 (2018)). The inhibition of autophagy accelerates the progress of some inflammatory and autoimmune diseases via promotion of inflammatory cytokine production (Yin et al., 2018). Modulation of autophagy has shown promise in the treatment of Crohn's disease (Nys et al., *Nat Rev Gastroenterol Hepatol.* (7): 395-401 (2013)), and several approved treatments for Crohn's disease act through the induction of autophagy, including 5-ASA (mesalamine/suffasalazine; see Wu et al., *PLoS ONE* 7: e37572 (2012); and Fiorucci et al., *Br. J. Pharmacol.* 150:996-1002 (2007)); and anti-TNF-α (Infliximab, Adalimumab, Certolizumab pegol; see Nys et al., 2013). C1 bacterial strains, EHA01, RHO01 and BTH01, were tested individually, in pair-wise combinations and together in a single consortium for the ability to induce autophagy as well as production of IL-10 in human THP-1 macrophages.

For assessing autophagy, M2 macrophages were prepared as follows. The THP-1 human monocyte cell line (ATCC cat #TIB-202) was cultured in 37° C. and 5% $CO_2$ using RPMI 1640 containing 2.05 mM L-glutamine (Corning) supplemented with 10% heat-inactivated FBS (Tissue Culture Biologicals), 100 I·U/mL Penicillin, 100 μg/mL Streptomycin and 0.292 mg/mL L-glutamine (Corning). Passage number was restricted to 8 passages. The THP-1 human monocyte cell line was grown until 70-80% confluent. Cells were counted and resuspended in culture media. 100,000 cells were plated per well onto 96 well plates. THP-1 human macrophages were made by culturing the THP-1 human monocyte cells with 10 ng/ml phorbol 12-myristate 13-acetate (PMA) (InvivoGen) for 24 hours, washed then incubated with RPMI with 20 ng/ml IL-4 (R&D Systems) and 20 ng/ml IL-13 (R&D Systems) for 48 hours in 37° C. and 5% $CO_2$ as described previously (Genin et al., *BMC Cancer* 15:577 (2015)).

For assessing IL-10, M1 macrophages were prepared as follows. The THP-1 human monocyte cell line (ATCC cat #TIB-202) was cultured in 37° C. and 5% $CO_2$ using RPMI 1640 containing 2.05 mM L-glutamine (Corning) supplemented with 10% heat-inactivated FBS (Tissue Culture Biologicals), 100 I·U/mL Penicillin, 100 μg/mL Streptomycin and 0.292 mg/mL L-glutamine (Corning). Passage number was restricted to 8 passages. The THP-1 human monocyte cell line was grown until 70-80% confluent. Cells were counted and resuspended in culture media. 100,000 cells were plated per well onto 96 well plates. THP-1 human macrophages were made by culturing the THP-1 human monocyte cells with 10 ng/ml phorbol 12-myristate 13-acetate (PMA) (InvivoGen) for 24 hours, washed then incubated with RPMI without antibiotics for 48 hours in 37° C. and 5% $CO_2$.

For both the autophagy and IL-10 assays, working stock solutions of individual freshly cultured or frozen bacteria (100% of EHA01, RHO01 or BTH01), consortia (1:1 for a 2-strain consortium (EHA01: RHO01; RHO01: BTH01; and EHA01: BTH01) and 1:1:1 for the 3-strain consortium (EHA01: RHO01: BTH01)) and anaerobic PBS control, respectively, were prepared, and each working stock of bacteria was normalized by surface area to $10^8$ μm²/ml using a Coulter Counter. Each test article was added onto THP-1 macrophages at 10% v/v and centrifuged down onto the THP-1 cells at 515×g for four minutes. 500 ng/ml LPS (InvivoGen) was added at the same time as the test articles. The test articles, LPS and THP-1 macrophages were co-incubated for 3 hours in 37° C. and 5% $CO_2$. The co-culture media was replaced with fresh RPMI with 100 I·U/mL Penicillin, 100 μg/mL Streptomycin. The cells were incubated overnight in 37° C. and 5% $CO_2$. M1 macrophage supernatants were collected and analyzed by ELISA. IL-10 in culture supernatants were quantified by using commercial enzyme-linked immunosorbent assay (ELISA) kits from Biolegend or R&D Systems with TMB detection according to manufacturer's specifications. M2 macrophage cells were lifted, processed and analyzed for autophagy levels using the CYTO-ID® Autophagy Detection Kit (Enzo).

To perform comparisons of the amount of autophagy or IL-10 production induced by a consortium to the total induction by each single strain of the consortium acting individually, assay values for the single strain test articles were normalized for biomass, since these test articles contained roughly two times (2×) or three times (3×) more biomass of a particular strain relative to that in a two-strain or three-strain consortium, respectively. Biomass normalizations were performed as follows. For purposes of comparisons to 2-strain consortia, assay values for each of the two corresponding single strain test articles were added and divided by two (i.e., averaged). For purposes of comparisons to 3-strain consortia, assay values for each of the three corresponding single strain test articles were added and divided by three (i.e., averaged). The assay value for each consortium was then compared to its corresponding single strain average (see "% increase (consortium vs single strain average)" in Tables 4 and 5).

Figure 10:
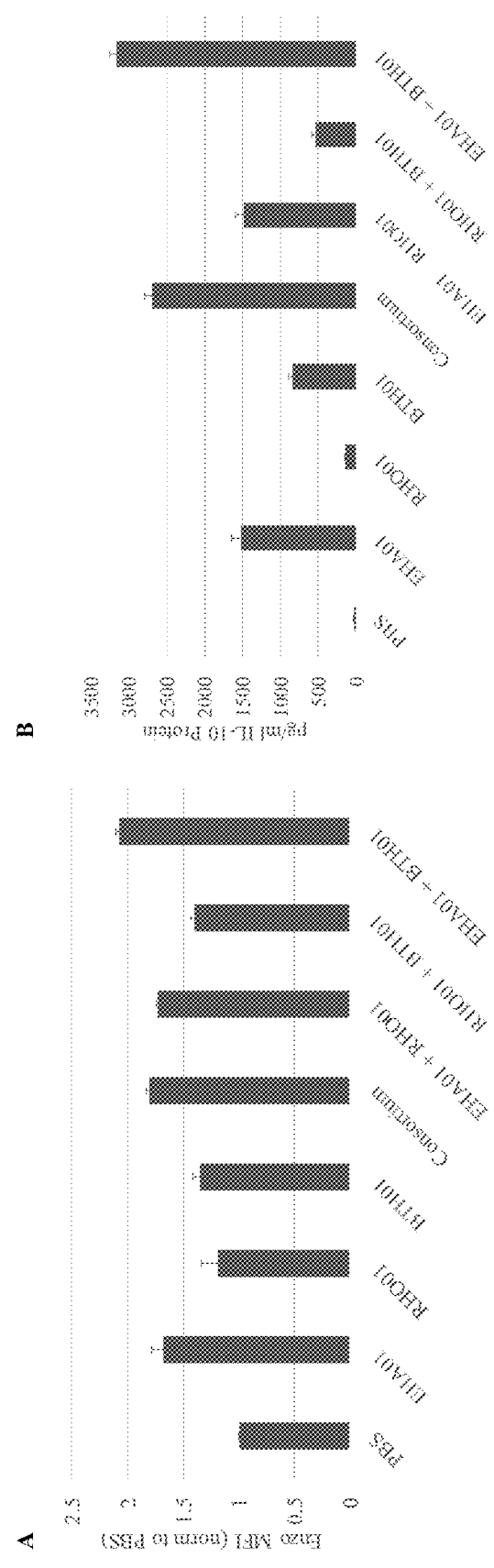
FIGS. 10A-10B depicts the in vitro effects of individual C1 bacterial strains or consortia (2-strain and 3-strain) on induction of autophagy and IL-10 cytokine production in a THP-1 human macrophage model. Following incubation with 10% v/v working solution of each test article, THP-1 human macrophage cells and supernatants were collected, processed and analyzed. (10A) Mean fluorescence intensity (MFI) corresponding to degree of autophagy induction in THP-1 M2 macrophages is shown for each individual lyophilized strain (EHA01, RHO01 and BTH01), pairwise combinations of the three strains (EHA01+RHO01, RHO01+BTH01 and EHA01+BTH01), the consortium of three strains together, or PBS (LPS-only) control. The PBS control was set as baseline. Each test article was evaluated in 4 replicates and results are representative of at least two independent experiments. (10B) IL-10 concentrations in culture supernatant from THP-1 M1 macrophages are shown for each individual lyophilized strain (EHA01, RHO01 and BTH01), pairwise combinations of the three strains (EHA01+RHO01, RHO01+BTH01 and EHA01+BTH01), the consortium of three strains together, or PBS (LPS-only) control. Each test article was evaluated in 4 replicates and results are representative of at least two independent experiments.

As shown in FIG. 10A and presented in tabular form below, autophagy was induced in THP-1 macrophages by the addition of EHA01, RHO01 and BTH01 strains individually (Table 4A); each pairwise combination of the three strains (EHA01+RHO01 in Table 4B; RHO01+BTH01 in Table 4C; and EHA01+BTH01 in Table 4D); and a consortium of all three strains combined (EHA01+RHO01+BTH01 in Table 4A), relative to the addition of PBS. Notably, each pairwise combination as well as the three-strain combination induced autophagy to a greater degree as a consortium, compared to the combined induction of each respective member strain individually, normalized for biomass (see "% increase (consortium vs single strain average)" in Tables 4A-D).

TABLE 4A

Induction of autophagy with 3-strain consortium:
*E. hallii* + *R. hominis* + *B. thetaiotaomicron*

| Test article | Enzo MFI (avg) |
|---|---|
| PBS | 1.00 |
| 100% EHA01 | 1.68 |
| 100% RHO01 | 1.19 |
| 100% BTH01 | 1.35 |
| 3-strain consortium: | 1.81 |
| 33% EHA01, 33% RHO01, 33% BTH01 | |
| single strain average (normalization for biomass) | 1.41 |
| % increase (consortium vs single strain avg.) | 28.68 |

TABLE 4B

Induction of autophagy with 2-strain consortium:
*E. hallii* + *R. hominis*

| Test article | Enzo MFI (avg) |
|---|---|
| PBS | 1.00 |
| 100% EHA01 | 1.68 |
| 100% RHO01 | 1.19 |
| 2-strain consortium: | 1.73 |
| 50% EHA01, 50% RHO01 | |
| single strain average (normalization for biomass) | 1.43 |
| % increase (consortium vs single strain avg.) | 20.61 |

TABLE 4C

Induction of autophagy with 2-strain consortium:
R. hominis + B. thetaiotaomicron

| Test article | Enzo MFI (avg) |
|---|---|
| PBS | 1.00 |
| 100% RHO01 | 1.19 |
| 100% BTH01 | 1.35 |
| 2-strain consortium: 50% RHO01, 50% BTH01 | 1.40 |
| single strain average (normalization for biomass) | 1.27 |
| % increase (consortium vs single strain avg.) | 10.24 |

TABLE 4D

Induction of autophagy with 2-strain consortium:
E. hallii + B. thetaiotaomicron

| Test article | Enzo MFI (avg) |
|---|---|
| PBS | 1.00 |
| 100% EHA01 | 1.68 |
| 100% BTH01 | 1.35 |
| 2-strain consortium: 50% EHA01, 50% BTH01 | 2.08 |
| single strain average (normalization for biomass) | 1.52 |
| % increase (consortium vs single strain avg.) | 36.99 |

As shown in FIG. 10B and presented in tabular form below, production of IL-10 was also induced in THP-1 macrophages by the addition of EHA01, RHO01 and BTH01 strains individually (Table 5A); each pairwise combination of the three strains (EHA01+RHO01 in Table 5B; RHO01+BTH01 in Table 5C; and EHA01+BTH01 in Table 5D); and a consortium of all three strains combined (EHA01+RHO01+BTH01 in Table 5A), relative to the addition of PBS. Similar to the results seen for induction of autophagy, each pairwise combination as well as the three-strain combination induced IL-10 production to a greater degree as a consortium, compared to the combined induction of each respective member strain individually, normalized for biomass (see "% increase (consortium vs single strain average)" in Tables 5A-D).

TABLE 5A

Induction of IL-10 with 3-strain consortium:
E. hallii + R. hominis + B. thetaiotaomicron

| Test article | pg/ml IL-10 protein (avg) |
|---|---|
| PBS | 1.00 |
| 100% EHA01 | 1517.12 |
| 100% RHO01 | 147.85 |
| 100% BTH01 | 835.33 |
| 3-strain consortium: 33% EHA01, 33% RHO01, 33% BTH01 | 2692.00 |
| single strain average (normalization for biomass) | 833.43 |
| % increase (consortium vs single strain avg.) | 223.00 |

TABLE 5B

Induction of IL-10 with 2-strain consortium: E. hallii + R. hominis

| Test article | pg/ml IL-10 protein (avg) |
|---|---|
| PBS | 1.00 |
| 100% EHA01 | 1517.12 |
| 100% RHO01 | 147.85 |
| 2-strain consortium: 50% EHA01, 50% RHO01 | 1484.24 |
| single strain average (normalization for biomass) | 832.48 |
| % increase (consortium vs single strain avg.) | 78.29 |

TABLE 5C

Induction of IL-10 with 2-strain consortium:
R. hominis + B. thetaiotaomicron

| Test article | pg/ml IL-10 protein (avg) |
|---|---|
| PBS | 1.00 |
| 100% RHO01 | 147.85 |
| 100% BTH01 | 835.33 |
| 2-strain consortium: 50% RHO01, 50% BTH01 | 532.66 |
| single strain average (normalization for biomass) | 491.59 |
| % increase (consortium vs single strain avg.) | 8.36 |

TABLE 5D

Induction of IL-10 with 2-strain consortium:
E. hallii + B. thetaiotaomicron

| Test article | pg/ml IL-10 protein (avg) |
|---|---|
| PBS | 1.00 |
| 100% EHA01 | 1517.12 |
| 100% BTH01 | 835.33 |
| 2-strain consortium: 50% EHA01, 50% BTH01 | 3160.89 |
| single strain average (normalization for biomass) | 1176.22 |
| % increase (consortium vs single strain avg.) | 168.73 |

These results demonstrate the ability of each C1 bacterial strain to individually induce autophagy and IL-10 production in THP-1 macrophages. Additionally, the unexpected increase in these inductions observed for each two-strain and three-strain consortia, compared to the combined inductions of each member strain individually, indicates that EHA01, RHO01 and BTH01 interact synergistically within these consortia to effect their biological activities.

Figure 11:
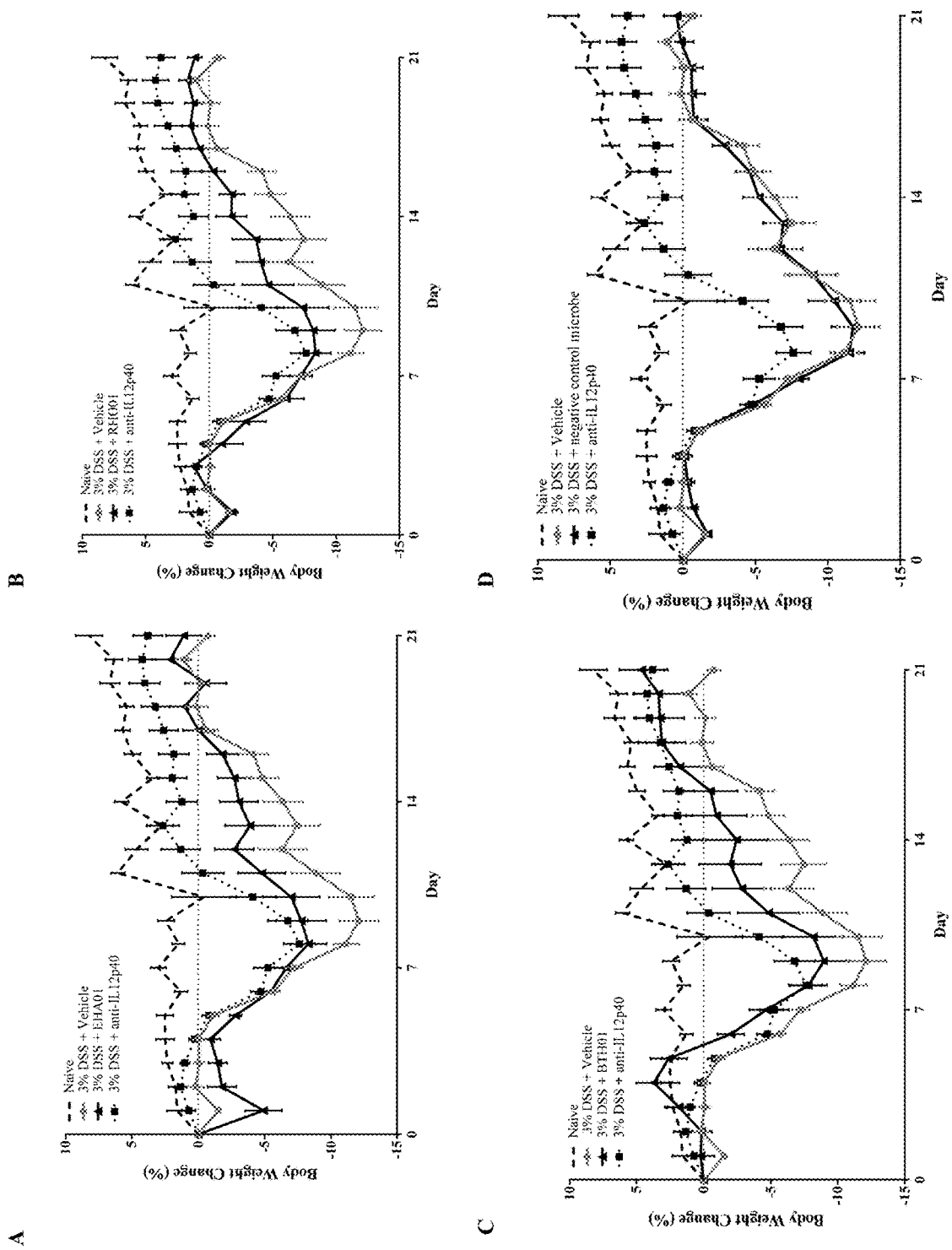
FIGS. 11A-11D depicts the effect of C1 individual bacterial strains on percent body weight change in a DSS-induced colitis mouse model. Groups of mice for naïve (N=5), test articles (N=12) and vehicle control (N=20) were used in a standard DSS-induced colitis model. Mice were treated with 3% DSS from days 0-5. Groups of mice were treated from days-1-21 daily with an oral dose at 1×10$^9$ VCC of each of the three C1 bacterial strains or with a negative control bacterial strain that did not show in vitro activity. Groups of mice were administered PBS as a vehicle control or an antibody against IL-12p40 (Q3D IP) as a positive control for efficacy. A plot of daily body weight change over time (d0-21) for each test group is shown alongside naïve mice (dashed black), vehicle control (grey, circle) and anti-IL-12p40 (dotted black, square). (11A) EHA01, (11B) RHO01, (11C) BTH01, and (11D) negative control microbe. Error bars are shown as SEM.

Example 6.11—Individual C1 Bacterial Strains Reduce Disease Severity in DSS-induced Colitis Model C1 bacterial strains, EHA01, RHO01 and BTH01 in lyophilized form, were tested individually in a well-validated DSS-induced colitis mouse model (Chassaing et al., Curr Protoc Immunol.; 104: Unit 15.25 (2014)) to evaluate efficacy under conditions of chemically-induced intestinal damage. Mice were treated with 3% DSS in drinking water for 5 days to induce gut mucosal damage followed by DSS removal for the remainder of the 21-day study. A daily dose of $1 \times 10^9$ VCC of lyophilized bacterial strain resuspended in PBS was administered by oral gavage throughout the 21-day study duration (FIG. 11). An antibody against IL-12p40 was administered parenterally as a positive control for efficacy.

Three efficacy endpoints were evaluated: body weight-loss over time, colitis severity score and stool consistency score measured by endoscopy at day 12 and day 21 of the study. Each of the three individual C1 strains and the anti-IL-12p40 antibody led to a reduction in DSS-induced body weight-loss compared to the vehicle control, whereas a microbe with no activity in promoting the intestinal barrier in vitro did not (FIG. 11A-D, Table 6). Similar effects of the three C1 strains and the anti-IL-12p40 positive control were observed on colitis severity score and stool consistency score (Table 8).

Example 6.11.1—Individual C1 Bacterial Strains Protect Against Weight Loss in DSS-induced Colitis Model All groups administered the three C1 bacterial strains, EHA01, RHO01 and BTH01 demonstrated marked improvement in weight loss compared to vehicle and negative microbe controls (FIG. 11A-C). These differences in weight loss severity are most notably seen on days 7-16 which mark the peak of intestinal damage and recovery period within the colitis model. At day 21, animals administered test article BTH01 recovered weight similar to the benchmark positive control group given anti-IL-12p40 (FIG. 11C). The negative control microbe did not demonstrate any positive effect on weight loss compared to vehicle control (FIG. 11D). These observations are also reflected in the quantified AUC which sums the weight percent change from Day 0 of the study (Table 6). The protection conferred by the individual strains reached statistical significance on several days between day 8 to 21.

TABLE 6

Evaluation of Weight Change Area Under the Curve in DSS Colitis Model

| Test Group | Weight Change Mean AUC |
|---|---|
| Naïve | 74.03 ± 11.4 |
| 3% DSS + Vehicle | −88.11 ± 16.64 |
| 3% DSS + EHA01 | −62.20 ± 16.42 |
| 3% DSS + RHO01 | −52.07 ± 16.42 |
| 3% DSS + BTH01 | −22.6 ± 29.8 |
| 3% DSS + Negative control microbe | −87.38 ± 16.42 |
| 3% DSS + Anti-IL-12p40 | −1.348 ± 18.66 |

AUC was calculated using Prism's area under the curve algorithm which applies the trapezoid rule to a nonlinear regression of % weight change. Error is represented as SEM.

The full compilation of daily weight loss percentage and statistics for each test group is depicted in Table 7, which shows mean weight loss percent±SEM by day of individual test articles (N=12), vehicle negative control (N=20) and Anti-IL-12p40 positive control (N=12). Q value≤0.05 is considered statistically significant using the Kruskal-Wallis test to concurrently compare all test articles included in table to the vehicle control with Two-stage step-up method of Bejamini, Keieger and Yekutieli to correct for multiple comparison by controlling False Discovery Rate. Results were similar when analyzed using the one-way ANOVA test.

TABLE 7

Mean Weight Loss Percent and Statistical Analysis from DSS-induced Colitis Study

| | Vehicle | EHA01 | | RHO01 | | BTH01 | | Anti-IL-12p40 | |
|---|---|---|---|---|---|---|---|---|---|
| Days | Mean | Mean | Q value | Mean | Q value | Mean | Q value | Mean | Q value |
| 0 | 0 ± 0.0 | 0 ± 0.0 | NA | 0 ± 0.0 | NA | 0 ± 0.0 | NA | 0 ± 0.0 | NA |
| 1 | −2 ± .19 | −5 ± 1.4 | 0.0224 | −2 ± .42 | 0.3444 | 0.2 ± 1.0 | 0.0561 | 0.7 ± .51 | 0.0108 |
| 2 | 0.2 ± .63 | −2 ± 1.1 | 0.4073 | 0.2 ± .34 | 0.6396 | 0.2 ± .78 | 0.6396 | 1 ± .46 | 0.4672 |
| 3 | −0.1 ± .36 | −1.5 ± .71 | 0.1732 | 1 ± .64 | 0.1732 | 2 ± 1.1 | 0.1700 | 1 ± .35 | 0.1700 |
| 4 | 0.0 ± .45 | −0.9 ± .73 | 0.9862 | −1 ± 1.7 | 0.9862 | 4 ± 1.3 | 0.0826 | .3 ± .43 | 0.9862 |
| 5 | −1 ± .40 | −3 ± .46 | 0.0747 | −3 ± 1.6 | 0.4865 | 3 ± 1.4 | 0.0747 | −0.8 ± .51 | 0.8386 |
| 6 | −6 ± .43 | −5 ± .68 | 0.7672 | −6 ± 1.4 | 0.7672 | −2 ± .99 | 0.0172 | −5 ± .78 | 0.7335 |
| 7 | −7 ± .65 | −7 ± .88 | >0.9999 | −7 ± .89 | >0.9999 | −5 ± 1.3 | 0.0753 | −5 ± 1.1 | 0.1791 |
| 8 | −11 ± 10 | −8 ± 1.4 | 0.1043 | −8 ± 1.2 | 0.1043 | 8 ± 1.4 | 0.0797 | −8 ± 1.2 | 0.0797 |
| 9 | −12 ± 1.5 | −8 ± 1.9 | 0.1364 | −8 ± 1.7 | 0.1364 | −9 ± 1.9 | 0.2034 | 7 ± 1.5 | 0.1364 |
| 10 | −12 ± 1.7 | −7 ± 2.1 | 0.1899 | −7 ± 2.0 | 0.1899 | −8 ± 2.2 | 0.2425 | −4 ± 1.7 | 0.0590 |
| 11 | −9 ± 1.9 | −5 ± 1.8 | 0.1634 | −5 ± 2.0 | 0.1634 | −5 ± 2.3 | 0.1634 | −0.4 ± 1.6 | 0.0084 |
| 12 | −6 ± 1.8 | 3 ± 1.5 | 0.3948 | −4 ± 1.9 | 0.5028 | −3 ± 2.2 | 0.3948 | 1 ± 1.5 | 0.0188 |
| 13 | −7 ± 1.7 | −4 ± 1.9 | 0.2242 | −4 ± 1.9 | 0.2242 | −2 ± 1.3 | 0.1069 | 3 ± 1.2 | 0.0005 |
| 14 | −6 ± 1.5 | −3 ± 1.4 | 0.2440 | −2 ± 1.2 | 0.1502 | −2 ± 2.3 | 0.1593 | 1 ± 1.2 | 0.0049 |
| 15 | −5 ± 1.2 | −3 ± 1.3 | 0.3843 | −2 ± 1.0 | 0.2269 | −0.9 ± 2.3 | 0.1986 | 2 ± 1.1 | 0.0015 |
| 16 | −4 ± 1.1 | −2 ± 1.2 | 0.3126 | −0.3 ± .90 | 0.0716 | −0.5 ± 2.0 | 0.2083 | 2 ± 1.1 | 0.0015 |
| 17 | −0.1 ± .86 | −0.0 ± 1.2 | 0.9912 | 0.8 ± .68 | 0.9812 | 2 ± 1.9 | 0.9812 | 2.6 ± 1.1 | 0.1336 |
| 18 | 0.1 ± .83 | 1 ± 1.1 | 0.7923 | 1 ± .61 | 0.7923 | 3 ± 1.8 | 0.7923 | 3 ± 1.1 | 0.2250 |
| 19 | −4 ± .93 | −3 ± .63 | 0.3149 | −2 ± .72 | 0.1610 | −1 ± .85 | 0.0145 | 0.0 ± .74 | 0.0008 |
| 20 | 1 ± .57 | 2 ± 1.3 | 0.8091 | 2 ± .68 | 0.8091 | 3 ± 1.8 | 0.8091 | 4 ± 1.0 | 0.0549 |
| 21 | −0.8 ± .50 | 1 ± 1.3 | 0.0544 | 1 ± .57 | 0.0551 | 5 ± 1.7 | 0.0007 | 4 ± 1.1 | 0.0002 |

Example 6.11.2—C1 Bacterial Strains Improve Endoscopy Colitis Score and Stool Consistency in DSS-induced Colitis Model On Days 12 and 21, endoscopy was performed on all groups to assess colitis severity and stool consistency, which are markers of intestinal inflammation. Colitis severity was scored using a 0-4 scale (0=normal; 1=loss of vascularity; 2=loss of vascularity and friability; 3=friability and erosions; 4=ulcerations and bleeding). Additionally, stool consistency was scored during endoscopy using the parameters defined in Table 8.

TABLE 8

Stool Consistency

| Score | Description |
|---|---|
| 0 | Normal, well-formed pellet |
| 1 | Loose stool, soft, staying in shape |
| 2 | Loose stool, abnormal form with excess moisture |
| 3 | Watery or diarrhea |
| 4 | Bloody diarrhea |

As shown in Table 9, mean endoscopy scores were reduced in animals administered EHA01 and RHO01 on Day 12 and in all animals administered test articles on Day 21 relative to the vehicle control. Mean stool consistency scores were also reduced in animals administered EHA01 and RHO01 on Day 12 and in all animals administered test articles on Day 21 as compared to those treated with vehicle control.

TABLE 9

Summary of Effects of C1 Strains and Controls on Endoscopy Score and Stool Consistency Measured on Day 12 and Day 21 of Study

| Test Group | Mean Endoscopy Score at Day 12 | Stool Consistency Score at Day 12 | Mean Endoscopy Score at Day 21 | Stool Consistency Score at Day 21 |
|---|---|---|---|---|
| Naïve | 0 ± 0 | 0 ± 0 | 0 ± 0 | 0 ± 0 |
| Vehicle | 2.20 ± 0.16 | 2.0 ± 0.15 | 2.05 ± 0.15 | 1.44 ± 0.2 |
| EHA01 | 1.92 ± 0.15 | 1.33 ± 0.24 | 1.82 ± 0.18 | 0.90 ± 0.10 |
| RHO01 | 1.75 ± 0.18 | 1.58 ± 0.23 | 1.33 ± 0.14 | 0.75 ± 0.18 |
| BTH01 | 2.08 ± 0.08 | 2.1 ± 0.23 | 1.67 ± 0.19 | 1.17 ± 0.21 |
| Negative Control Microbe | 2.25 ± 0.13 | 2.1 ± 0.18 | 1.75 ± 0.18 | 1.18 ± 0.18 |
| Anti-IL-12p40 | 1.92 ± 0.15 | 1.36 ± 0.24 | 1.75 ± 0.18 | 0.58 ± 0.15 |

Stool consistency and colitis severity was scored as described. Error is represented as SEM.

Figure 12:
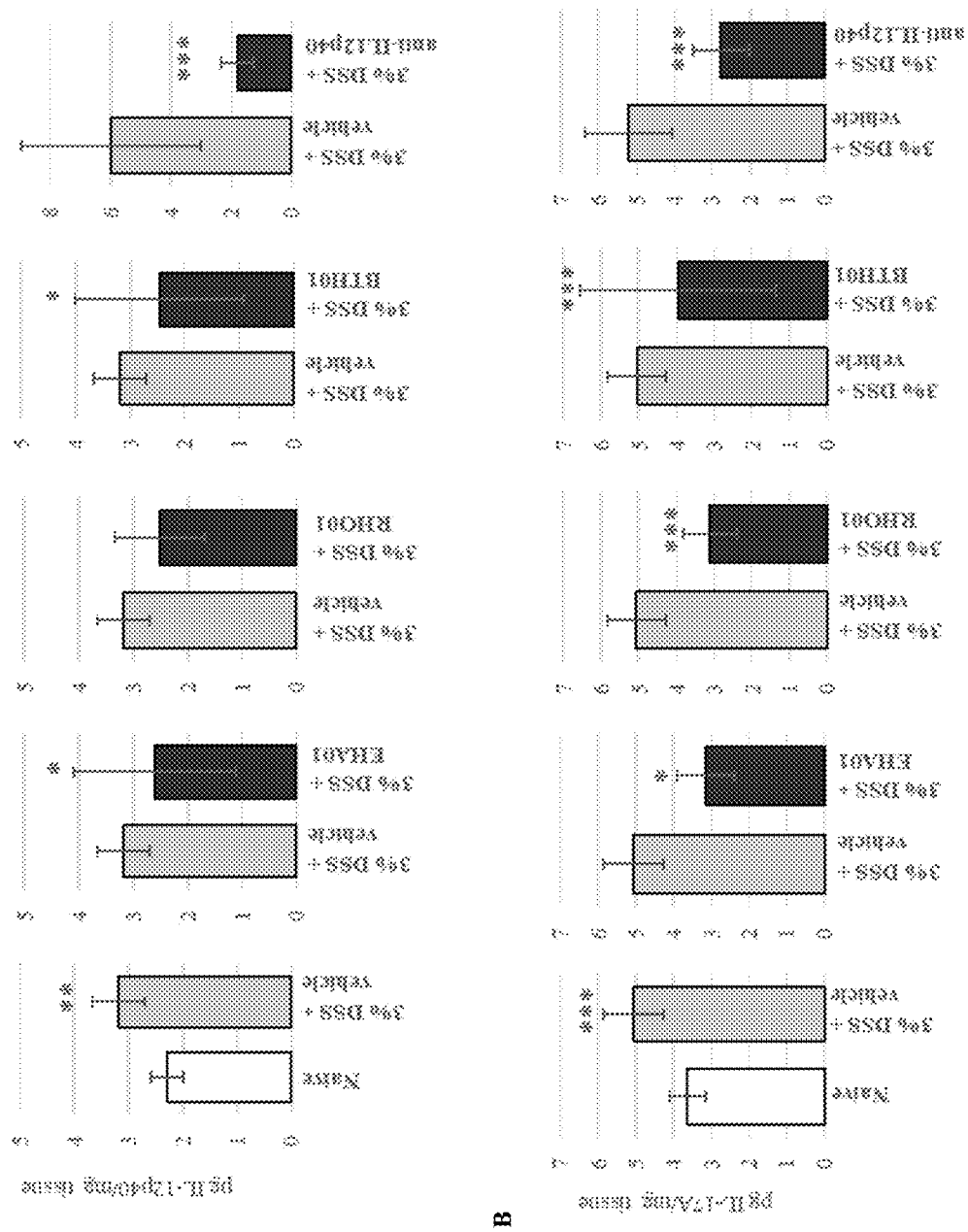
FIGS. 12A-12B depicts cytokine levels in colon tissue on Day 21 of DSS-induced colitis. Cytokine levels were evaluated by ELISA after colon tissue homogenization in lysis buffer. Levels were normalized to mg of tissue analyzed. Each test article was evaluated in N=12 animals. *p value≤0.05; p value≤0.001; *p value≤0.005; Mann-Whitney non-parametric test.

Example 6.11.3—C1 Individual Bacterial Strains Reduce Colon Tissue IL-17A and IL-12p40 in DSS-Induced Colitis Model DSS-induced colitis is characterized by intestinal inflammation associated with an increase in tissue proinflammatory cytokines which include IL-12p40 and IL-17A. In addition to disease scores, the levels of inflammatory cytokines were also evaluated in colonic tissue at the study termination on Day 21 (FIG. 12). Evaluation of colonic tissue levels of these cytokines in the groups administered the three individual C1 bacterial strains, EHA01, RHO01, and BTH01 as well as the anti-IL-12p40 positive control demonstrated a reduction in IL-12p40 (FIG. 12A) and IL-17A (FIG. 12B) relative to vehicle control. Each of the three individual C1 strains significantly protected from the DSS-induced increase in IL-17A and strains EHA01 and BTH01 also significantly lowered colonic tissue IL-12p40, with RHO01 showing a trend.

Example 6.12—Bacterial Consortium Reduces Disease Severity in DSS-Induced Colitis Model Mice were treated with drinking water containing 3% DSS for five days to induce gut mucosal damage followed by DSS removal for the remainder of the 19-day study. The C1 consortium, including $1\times10^9$ VCC of each of the individual C1 strains in re-hydrated lyophilized form, was administered by oral gavage daily for the entire study duration. Individual bacterial strains, EHA01, RHO01 and BTH01, in lyophilized form were also tested at a daily dose of $3\times10^9$ VCC for the entire duration of the study. The C1 consortium, including $1\times10^9$ VCC of each of the individual C1 strains in re-hydrated lyophilized form, was also administered in combination with anti-IL-12p40 antibody (at 10 mg/kg in PBS, dosed Q3D starting on Day 6 by IP) (FIG. 13). An antibody against IL-12p40 was administered parenterally as a positive control for efficacy. The primary efficacy endpoint in this study was body weight loss over time.

The full compilation of daily weight loss percentage and statistics is depicted in Table 10, which shows mean weight loss percent±SEM by day of individual test articles (N=12), consortium (N=24), vehicle negative control (N=20) and Anti-IL-12p40 positive control (N=12). Q value≤0.05 is considered statistically significant using the Kruskal-Wallis test to concurrently compare all test articles included in table to the vehicle control with Two-stage step-up method of Bejamini, Keieger and Yekutieli to correct for multiple comparison by controlling False Discovery Rate. Results were similar when analyzed using the one-way ANOVA test.

TABLE 10

Mean Weight Loss Percent and Statistical Analysis from DSS-induced Colitis Study

| | Vehicle | EHA01 | | RHO01 | | BTH01 | | Consortium | | Anti-IL-12p40 | |
|---|---|---|---|---|---|---|---|---|---|---|---|
| Days | Mean | Mean | Q value | Mean | Q value | Mean | Q value | Mean | Q value | Mean | Q value |
| 0 | 0 ± 0.0 | 0 ± 0.0 | NA | 0 ± 0.0 | NA | 0 ± 0.0 | NA | 0 ± 0.0 | NA | 0 ± 0.0 | NA |
| 1 | −1 ± .33 | −1 ± .44 | 0.4226 | −0.5 ± .64 | 0.2842 | 0.5 ± .48 | 0.0067 | −1 ± .42 | 0.4226 | 1 ± .47 | 0.0024 |
| 2 | −0.8 ± .29 | −1.0 ± .32 | 0.3207 | 0.6 ± .70 | 0.036 | 1.2 ± .43 | 0.0019 | 0.5 ± .55 | 0.0093 | 1.4 ± .52 | 0.0018 |
| 3 | −1.9 ± .41 | −0.7 ± .40 | 0.062 | 1.3 ± .85 | 0.0008 | 0.6 ± .64 | 0.0025 | 0.1 ± .55 | 0.0011 | 2.1 ± .56 | <0.0001 |
| 4 | −0.0 ± .40 | −0.2 ± .44 | −0.952 | 2 ± 1.1 | 0.1866 | 2 ± .90 | 0.1704 | 0.0 ± .65 | 0.952 | 0.6 ± .62 | 0.5897 |
| 5 | −3 ± .58 | −2 ± .59 | 0.8271 | 0.08 ± 1.1 | 0.1838 | −3 ± .84 | 0.8271 | −2 ± .78 | 0.8271 | −3 ± .86 | 0.8289 |
| 6 | −9 ± .51 | −9 ± .93 | 0.9826 | −8 ± 1.7 | 0.9826 | −9 ± 1.3 | 0.9826 | −8 ± .71 | 0.9826 | −9 ± 1.2 | >0.9999 |

TABLE 10-continued

Mean Weight Loss Percent and Statistical Analysis from DSS-induced Colitis Study

| | Vehicle | EHA01 | | RHO01 | | BTH01 | | Consortium | | Anti-IL-12p40 | |
|---|---|---|---|---|---|---|---|---|---|---|---|
| Days | Mean | Mean | Q value | Mean | Q value | Mean | Q value | Mean | Q value | Mean | Q value |
| 7  | −15 ± .71 | −15 ± 1.1 | >0.9999 | −13 ± 1.6 | 0.4719 | −15 ± .84 | >0.9999 | −14 ± .58 | 0.4719 | −13 ± 1.4 | 0.5332 |
| 8  | −18 ± .54 | −18 ± .96 | >0.9999 | −16 ± 1.5 | 0.1029 | −17 ± 1.1 | 0.4343 | −17 ± .58 | 0.2334 | −16 ± 1.7 | 0.1029 |
| 9  | −19 ± .66 | −18 ± 1.2 | 0.4645 | −13 ± 2.0 | 0.0141 | −17 ± 1.5 | 0.3571 | −17 ± .87 | 0.0849 | −14 ± 2.2 | 0.0366 |
| 10 | −20 ± .75 | −18 ± 1.2 | 0.0403 | −13 ± 1.8 | 0.001  | −18 ± 1.7 | 0.0403 | −17 ± .93 | 0.0058 | −15 ± 2.2 | 0.0058 |
| 11 | −20 ± .91 | −17 ± 1.7 | 0.2112 | −11 ± 2.1 | 0.0024 | −19 ± 2.0 | 0.3578 | −16 ± 1.1 | 0.0557 | −15 ± 2.6 | 0.0557 |
| 12 | −20 ± 1.0 | −16 ± 1.8 | 0.0787 | −11 ± 2.4 | 0.0028 | −18 ± 1.9 | 0.1642 | −14 ± 1.2 | 0.0049 | −15 ± 2.7 | 0.0358 |
| 13 | −19 ± 1.2 | −15 ± 1.9 | 0.0706 | −9 ± 2.1  | 0.0015 | −17 ± 2.1 | 0.1065 | −13 ± 1.2 | 0.0036 | −12 ± 2.4 | 0.0043 |
| 14 | −16 ± 1.1 | −12 ± 1.7 | 0.0298 | −9.6 ± 2.6 | 0.0053 | −14 ± 2.1 | 0.092 | −11 ± 1.1 | 0.0032 | −10 ± 2.8 | 0.0032 |
| 15 | −13 ± 1.2 | −12 ± 2.1 | 0.033  | −7 ± 2.3  | 0.0088 | −13 ± 2.1 | 0.1722 | −8 ± 1.0  | 0.0044 | −7 ± 2.9  | 0.0034 |
| 16 | −10 ± 1.2 | −6 ± 1.6  | 0.0214 | −4 ± 2.5  | 0.0095 | −9 ± 2.2  | 0.1606 | −4 ± 1.0  | 0.0019 | −4 ± 2.7  | 0.0019 |
| 17 | −11 ± 1.1 | −6 ± 1.4  | 0.0061 | −3 ± 2.1  | 0.0005 | −9 ± .2   | 0.0476 | −4 ± 1.0  | 0.0001 | −5 ± 2.4  | 0.0014 |
| 18 | −9 ± 1.2  | −6 ± 1.6  | 0.0815 | −2 ± 1.8  | 0.0043 | −8 ± 1.6  | 0.3138 | −4 ± 1.3  | 0.0077 | −3 ± 2.1  | 0.0077 |
| 19 | −7 ± 1.0  | −4 ± 1.1  | 0.0555 | −.4 ± 1.6 | 0.0027 | −5 ± 1.5  | 0.1079 | −3 ± 1.0  | 0.008  | −2 ± 1.7  | 0.0052 |

Example 6.12.1—C1 Bacterial Consortium Protects Against Weight Loss in DSS-Induced Colitis Model The C1 consortium demonstrated protection against DSS-induced weight loss, similar to that seen with the anti-IL-12p40 antibody, compared to the vehicle control (FIG. 13D). The protection observed with the C1 consortium and anti-IL-12p40 was statistically significant from the peak of gut damage on day 10 until the termination of the study on day 19. The individual strains, EHA01, RHO01 and BTH01, also demonstrated protection against weight loss compared to vehicle control (FIG. 13A-C). The individual strain protection reached statistical significance on days 10 and 17 with all treatment groups except for BTH01 reaching statistically significant weight loss protection on days 14-17. Administration of the C1 consortium in combination with anti-IL-12p40 demonstrated protection against DSS-induced weight loss compared to the vehicle control, C1 consortium alone, and anti-IL-12p40 alone (FIG. 13E), as reflected in the AUC which sums the weight percent change from Day 0 of the study (FIG. 13F).

Example 6.12.2—C1 Bacterial Consortium Reduces Colon Tissue IL-17A, TNF-α and IL-6 in DSS-Induced Colitis Model Evaluation of cytokines in colon tissue from mice administered the C1 consortium demonstrated a reduction in the proinflammatory cytokines IL-17A, TNF-α and IL-6 relative to vehicle control (FIG. 14). The anti-IL-12p40 positive control also demonstrated protection against DSS-induced increase in these proinflammatory cytokines which was statistically significant for IL-17A.

Example 6.12.3—C1 Bacterial Consortium Reduces Plasma Lipocalin-2/NGAL Levels in DSS-Induced Colitis Model Evaluation of Lipocalin-2, a disease activity biomarker in inflammatory bowel disease (Stallhofer et al., *Inflamm Bowel Dis* 21 (10): 2327-2340 (2015)), was performed on plasma from mice administered the individual strains, EHA01, RHO01 and BTH01, the C1 consortium, anti-IL-12p40 alone and anti-IL-12p40 in combination with the C1 consortium (FIG. 15). Administration of each of the individual strains, EHA01, RHO01 and BTH01, the C1 consortium alone, and the C1 consortium combined with anti-IL-12p40 resulted in a reduction in plasma levels of Lipocalin-2 compared to vehicle control, with the C1 consortium combined with anti-IL-12p40 showing a reduction greater than that observed for either the C1 consortium alone or anti-IL-12p40 alone (FIG. 15A). Differences between groups of experiments were statistically determined by using one-factor ANOVA with a Tukey post hoc test. FIG. 15B shows that the reduction in Lipocalin-2 plasma levels correlated with the % change in body weight, with greater reductions in Lipocalin-2 corresponding to reduced body weight loss in the DSS model. (r=−0.5129; 95% confidence interval=− 0.6502 to −0.3432; $R^2$=0.2631; P value: P (two-tailed)=<0.0001; significant (alpha=0.05)).

Example 7—Clinical Study

A first-in-human study is conducted to investigate the safety/tolerability, pharmacokinetics and pharmacodynamics of the investigational drug C1. C1 includes commensal gut bacterial strains derived (purified and mono-cultured) from the stool of healthy human donors. Bacterial strains were selected for their potential to modulate mucosal inflammation and barrier function, which are dysregulated in patients with UC, as described in the foregoing Examples herein.

The study is an adaptive design, two-cohort, dose-ascending study to evaluate the safety and efficacy of 1 to 5 C1 capsules orally administered once daily for 8 weeks. C1 is administered as a monotherapy or in combination with oral mesalamine (standard-of-care) to subjects with mildly-to-moderately active UC with evidence of an inadequate response to ongoing mesalamine treatment. An inadequate response to mesalamine is defined as the presence of signs and/or symptoms of active UC despite receiving treatment with ≥2.4 g/day of oral mesalamine with or without concomitant topical (rectal) mesalamine (mesalamine suppository 1000 mg PR QHS or mesalamine enema 4 g PR QHS) for >4 weeks from screening visit.

The study will enroll 44 subjects across two sequential, non-overlapping dose cohorts (Cohort A and Cohort B). The first cohort (Cohort A) will randomize 20 subjects, allocated 1:1 to treatment with one capsule per day of C1 or Placebo. The second cohort (Cohort B) will randomize 24 subjects, allocated 3:1 to once-a-day treatment with up to 5 capsules per day of C1 or Placebo.

Inclusion criteria include the following. 1) Men or women, 18 to 70 years of age. 2) Established diagnosis of UC for at least 3 months prior to screening, based on clinical history, exclusion of infectious causes, and characteristic endoscopic and histologic findings. 3) Active UC with disease involving the colon and rectum, with at least 15 cm of involved colon; subjects with isolated ulcerative proctitis (disease that does not extend beyond 15 cm of the anal verge) will be excluded. 4) Modified Mayo Score 3-8, with score of ≤2 points in each individual category of the modified Mayo scoring system and endoscopy score activity of ≥1 point at the most affected area, based on a sigmoidoscopy or full colonoscopy (if colonoscopy not done within the past 24 months), at ≤2 weeks from subject randomization. Only the sigmoid should be scored up to approximately 30-40 cm, although the extent of disease beyond this level will be documented for subjects receiving full colonoscopy or sigmoidoscopy. 5) Subjects with active disease (defined per clinical and endoscopy criteria) despite ongoing treatment with oral mesalamine ≥2.4 g/day with or without concomitant topical (rectal) mesalamine (mesalamine suppository 1000 mg PR QHS or mesalamine enema 4 g PR QHS) for ≥4 weeks from screening visit. 6) Treatment with stable dosage of oral mesalamine and concomitant topical (rectal) mesalamine (if applicable) during study screening and treatment phases. 7) Treatment with a stable oral corticosteroid dose of ≤15 mg prednisone/day or equivalent during study screening and treatment phase.

Study drug will be unit dose packaged inside a plastic tube with screw cap. The capsule-containing tube and a 1-g silica-gel desiccant sachet will be placed inside a heat-scaled aluminum foil pouch.

Seven (7) unit dose foil pouches of study drug will be placed into an outer carton to form a weekly pack. Eight (8) Weekly packs of study drug will be provided to each patient in two separate kits. The first kit [1 of 2] contains five (5) weekly packs of study drug in an outer carton. The second kit [2 of 2] contains three (3) weekly packs of study drug in an outer carton.

Study drug must be stored refrigerated (2-8° C.) in a secure location at the study site. Study drug storage conditions (e.g., temperature and other requirements) will be identified on the study drug label and in the investigator site file. Study drug must not be frozen.

Each non-placebo capsule is targeted to contain $1 \times 10^9$ viable organisms per bacterial strain. Subjects in Cohort A will be administered 1 capsule per day for 8 weeks. Subjects in Cohort B with be administered up to 5 capsules per day for 8 weeks. Subjects will be instructed to swallow intact study drug capsules at one time every day, in the morning after overnight fast, with a full glass of water. They will wait for at least 60 minutes after ingesting study drug before consuming the first solid or liquid meal of the day (excluding water).

Safety is assessed based on the incidence of treatment emergent adverse events graded for severity, including serious adverse events.

A primary efficacy assessment is the percentage of subjects in clinical remission at end of the 8-week treatment duration using the modified Mayo score (MMS).

The Mayo scoring system for assessment of ulcerative colitis activity is described in Rutgeerts et al., *N Engl J Med.* 353 (23): 2462-76 (2005). The Mayo scoring system includes stool frequency, rectal bleeding. findings on endoscopy, and physician's global assessment. Stool frequency has a subscore of 0 to 3, with 0=normal number of stools for this patient, 1=1-2 stools more than normal, 2=3-4 stools more than normal, and 3=5 or more stools more than normal. Each patient serves as his or her own control to establish the degree of abnormality of the stool frequency. Rectal bleeding has a subscore of 0 to 3, with 0=no blood seen, 1=streaks of blood with stool less than half the time, 2=obvious blood with stool most of the time, and 3=blood alone passes. The daily bleeding score represents the most severe bleeding of the day. Findings on endoscopy has a subscore of 0 to 3, with 0=normal or inactive disease, 1=mild disease (erythema, decreased vascular pattern), 2=moderate disease (marked erythema, lack of vascular pattern, friability, erosions), and 3=severe disease (spontaneous bleeding, ulceration). Physician's global assessment has a subscore of 0 to 3, with 0=normal, 1=mild disease, 2=moderate disease, 3=severe disease. The physician's global assessment acknowledges the three other criteria, the patient's daily recollection of abdominal discomfort and general sense of well-being, and other observations, such as physical findings and the patient's performance status.

The Modified Mayo Score (MMS) excludes the PGA component of the Mayo Score. The modified Mayo score ranges from 0 to 9, with higher scores indicating more severe disease. Clinical remission will be measured using the modified Mayo score (MMS), based on attaining a sub-score of '0' points for rectal bleeding and sub-scores of 0 or 1 points for endoscopic mucosal appearance and stool frequency, with at least a 1-point decrease from baseline in stool frequency.

A primary efficacy assessment is endoscopic improvement at end of the 8-week treatment duration using the Ulcerative Colitis Endoscopic Index of Severity (UCEIS). Improvement in endoscopic disease severity will be assessed using change from baseline in UCEIS score. The UCEIS includes 3 descriptors of endoscopic severity, each with specific definitions and scored on a simple visual analog scale with a score of 0 representing normality. The descriptors are vascular pattern (3 levels), bleeding (4 levels), and erosions and ulcers (4 levels). The final score, calculated from a simple sum of individual scores, ranges from 0 to 8, with higher scores indicating more severe disease.

The study also collects patient reported outcome data relevant to underlying disease state using UC PRO2. In addition to the above-mentioned clinical assessments, the study includes acquisition of longitudinal stool samples, and baseline and end-of-study mucosal biopsy samples to understand and potentially correlate changes in gut microbiota composition (taxonomy and phenotype) with clinical outcomes.

Concomitant treatments/medications, those administered between the date of study randomization and the end-of-study treatment visit, are administered only as medically necessary. Examples of such medications include rescue medications for exacerbation of UC disease activity, systemic antibiotics for treatment of intercurrent infections, or gastric acid reducers such as H2 blockers or proton pump inhibitors. These include: increase in dose of oral corticosteroids; introduction of oral corticosteroids; introduction of topical corticosteroids; increase in dose of oral mesalamine; introduction of topical mesalamine; and introduction of other oral 5-ASA formulations and prodrugs, including sulfasalazine, olsalazine or balsalazide. Rescue medications include parenteral corticosteroids, 6-MP, azathioprine, low dose methotrexate, intravenous immunoglobulins (IVIG), anti-TNF agents, natalizumab, vedolizumab, cyclosporin, tacrolimus, tofacitinib, other commercially available biologic agents, or experimental medications.

Example 8—Manufacture of Bacterial Strain Compositions: Fermentation, Harvest and Lyophilization A flow chart of an exemplary GMP process is provided in FIG. 15. One or more vials of each bacterial strain MCB is used to prepare an inoculum. The resulting culture is used to inoculate a fermenter. After fermentation, the cells are harvested by tangential flow filtration (TFF) and/or centrifugation, blended with selected cryopreservatives as detailed in Table 11 and then dispensed into trays, frozen (−70±10° C.), and subsequently lyophilized.

TABLE 11

Cryopreservatives Used for Each C1 Component

| Bacterial Strain Composition | Components of Cryopreservative Blend |
|---|---|
| BTH01 | Sucrose |
| EHA01 | Raftilose ®, Maltodextrin, Alginate, Trehalose, Sucrose |
| RHO01 | Raftilose ®, Maltodextrin, Alginate, Trehalose |

Example 9—Capsule-In-Capsule

Figure 16:
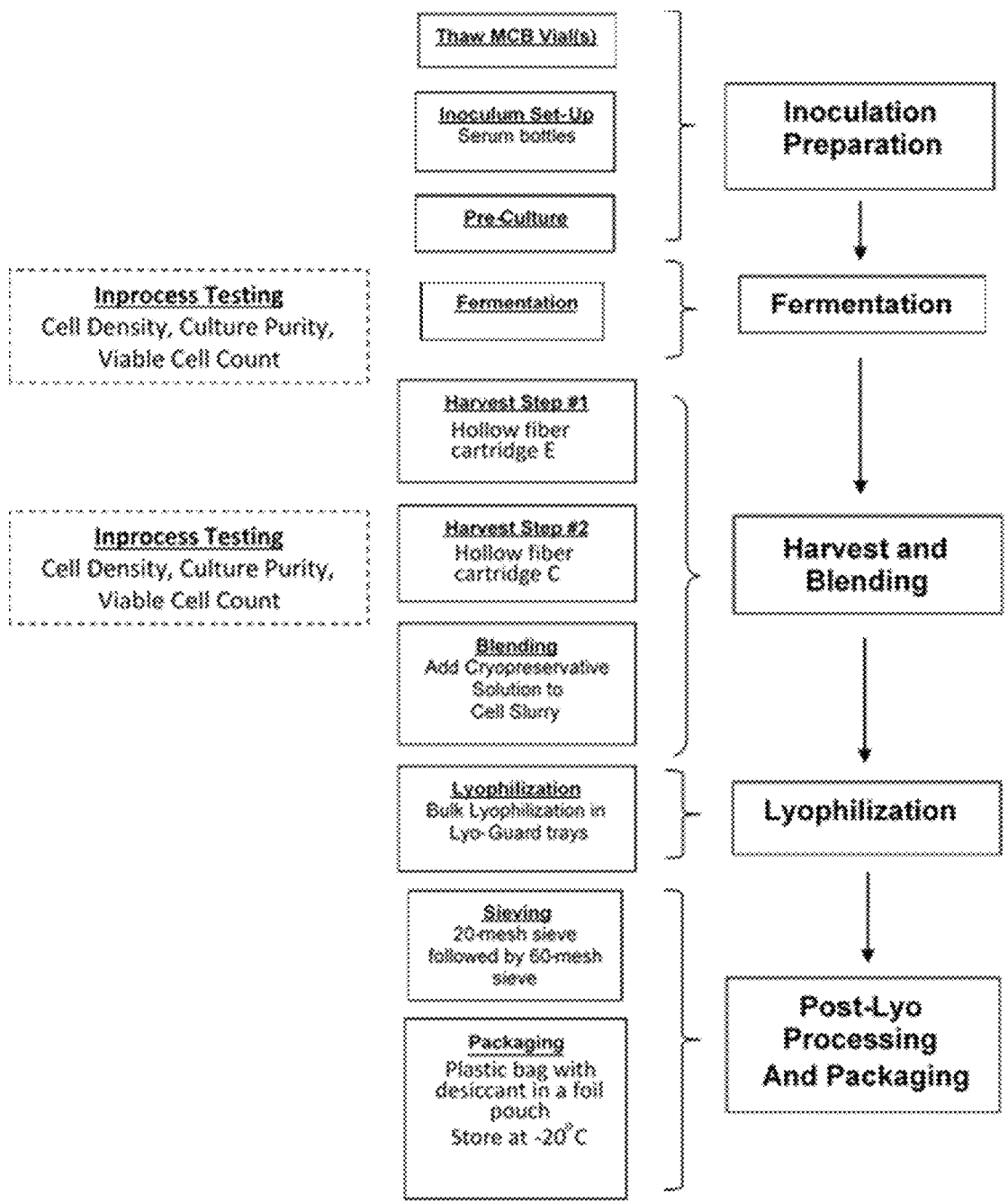
FIG. 16 depicts a process flow diagram for the manufacture of a lyophilized powder form of a bacterial strain.

In this example, C1 is formulated for oral administration as a capsule-in-capsule dosage form (e.g., Gemicel®). FIG. 16 shows a schematic representation of a Gemicel® design. In this example, both the inner and the outer capsules are filled with the same C1 formulation, and both the inner and the outer capsules are banded prior to coating. The drug release characteristics are provided by functional coatings, as follows:

(a) An outer enteric-coated capsule, which provides gastric resistance in the stomach and proximal small intestine, then releases its contents of the powder fill formulation and the coated inner capsule into the distal ileum. The enteric polymer is designed to dissolve as intestinal pH increases to a critical pH for dissolution of the enteric polymer; and (b) An inner reverse enteric-coated capsule, which is intended to release its contents of powder fill formulation in the proximal colon. The reverse enteric polymer is designed to dissolve as intestinal pH decreases to a critical pH for dissolution of the reverse enteric polymer. The reverse enteric polymer exploits the pH drop in the ileocecal region of the intestine.

A human scintigraphy study was previously performed, which demonstrated that release was achieved at the expected anatomic targets.

Figure 17:
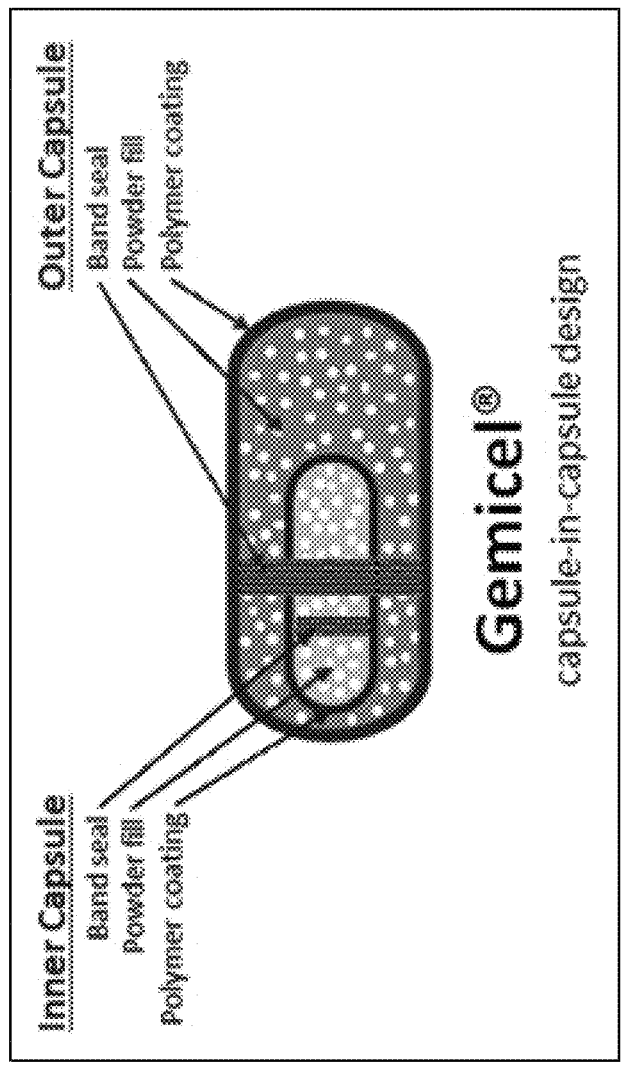
FIG. 17 depicts a schematic representation of the Gemicel® capsule-in-capsule.
Figure 18:
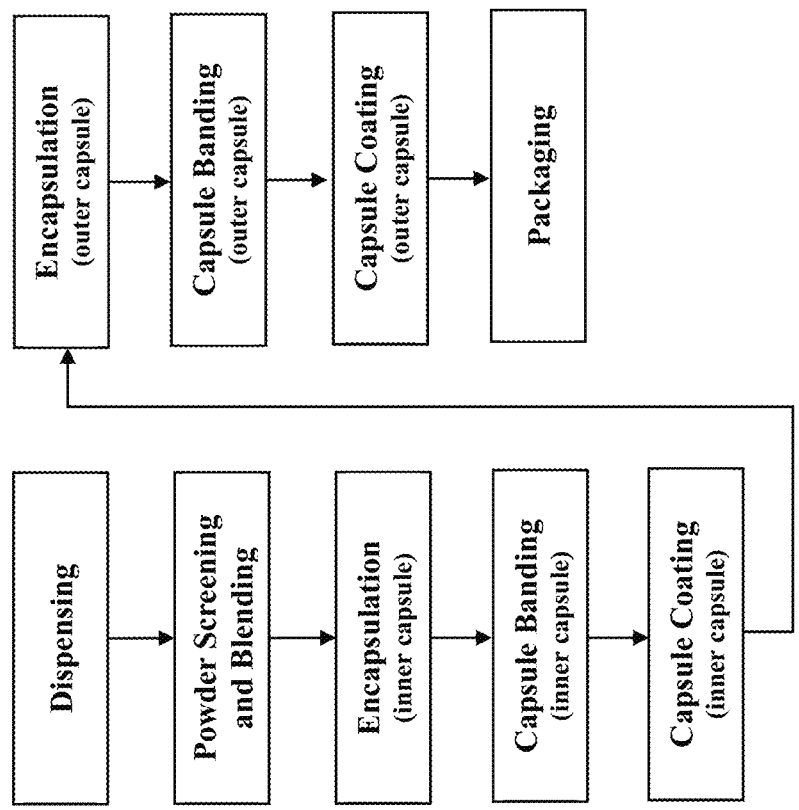
FIG. 18 depicts a manufacturing flow chart for a capsule-in-capsule.

For the example depicted in FIG. 17, the powder fill formulation includes three individually lyophilized bacterial compositions. The formulated concentration of each bacterial strain is targeted to be between about $3 \times 10^8$ and about $3 \times 10^{10}$ viable organisms in each C1 Gemicel® capsule-in-capsule dose (i.e., total of both the inner and the outer capsules in a single C1 Gemicel®). The powder fill formulation also contains other typical pharmaceutical excipients (e.g., filler, disintegrant, glidant, and lubricant).

Unit dose packaging includes a single Gemicel® capsule inside a heat-sealed foil pouch containing a desiccant pouch. As an added precaution during early studies, the capsule is inserted into a protective plastic sleeve prior to placing in the foil pouch.

Example 10—Composition

The components used for C1 in an exemplary capsule-in-capsule formulation are shown in Table 12. In this example, the powder fill formulation includes three individually lyophilized bacterial strain compositions. The powder fill formulation also contains other typical pharmaceutical excipients (e.g., filler, disintegrant, glidant, and lubricant). The inner and outer capsules are composed of hydroxypropyl methylcellulose (HPMC) with the inner capsule being a smaller size than the outer capsule. The banding polymer is also composed of HPMC, which is used to seal each capsule and provides a suitable surface across the seam prior to coating. The coating polymers determine the functional performance of the capsule-in-capsule. The outer capsule is coated with a prescribed blend of enteric polymers (poly(methacrylic acid-co-methyl methacrylate) 1:1 and poly(methacrylic acid-co-methyl methacrylate) 1:2), which provide gastric resistance in the stomach and proximal small intestine, then releases its contents of powder fill formulation and the coated inner capsule into the distal ileum. The inner capsule is coated with a reverse enteric polymer (amino methacrylate copolymer (2:1:1)), which releases its contents of powder fill formulation into the proximal colon.

TABLE 12

Components of an Exemplary C1 Capsule-in-Capsule Formulation

| | Function |
|---|---|
| Powder Fill Components | |
| Lyophilized Bacterial Strains[1] | Actives |
| Microcrystalline Cellulose | Filler |
| Crospovidone (polyvinyl pyrrolidone) | Disintegrant |
| Silicon Dioxide | Flow aid, glidant |
| Sodium Stearyl Fumarate | Lubricant |
| Capsule Shell | |
| Hydroxypropyl methylcellulose (HPMC) Capsules | Capsule shell |
| Banding Polymer | |
| Hydroxypropyl methylcellulose (HPMC) | Banding polymer |
| Purified water[2] | Banding solvent |
| Ethanol[2] | Banding solvent |
| Inner Capsule Coating Polymer | |
| Amino Methacrylate Copolymer (2:1:1) | Reverse enteric coating polymer |
| Sodium Lauryl Sulfate | Surfactant |
| Silicon Dioxide | Flow aid, glidant |
| Stearic Acid | Lubricant |
| Talc | Anti-tacking agent |
| Purified water[2] | Coating solvent |
| Outer Capsule Coating Polymer | |
| Poly (methacrylic acid-co-methyl methacrylate) 1:1 | Enteric coating polymer |
| Poly (methacrylic acid-co-methyl methacrylate) 1:2 | Enteric coating polymer |
| Triethyl Citrate | Plasticizer |
| Talc | Anti-tacking agent |
| Ammonia Solution (1N)[2] | pH adjuster |
| Purified Water[2] | Coating solvent |
| Isopropyl alcohol[2] | Coating solvent |

[1]C1 bacterial strains, BTH01, EHA01 and RHO01, including cryoprotectants, will be used in the powder fill formulation of C1 Gemicel ® capsules.
[2]These solvents are removed during processing.

Example 11—Manufacture of an Exemplary C1 Capsule-In-Capsule Formulation

A manufacturing flow chart for example C1 Gemicel® capsules is shown in FIG. 16. Exemplary steps include the following:

Dispensing

Lyophilized bacterial strain compositions are removed from frozen storage and allowed to equilibrate to room temperature prior to dispensing. Active and inactive materials are accurately weighed.

Powder Screening and Blending

Powders may be screened to remove lumps, then blended in a conventional bin-type blender (e.g., V-blender). Glidant and lubricant excipients may be separately pre-blended with an appropriate quantity of filler prior to adding into the blender.

Encapsulation (Inner Capsule)

The inner HPMC capsules are separated manually or using semi-automatic equipment. The prescribed amount of powder blend is accurately filled manually or using semi-automatic equipment into the body of each capsule, then each capsule is closed.

Capsule Banding (Inner Capsule)

The inner capsules are band sealed using a hydroalcoholic HPMC solution followed by drying. Banding is performed circumferentially at the capsule seam using semi-automatic or automatic equipment.

Capsule Coating (Inner Capsule)

The inner capsule is coated with a reverse enteric polymer (amino methacrylate copolymer) solution using conventional pan coating equipment. Capsules are coated until the target weight gain is achieved.

Encapsulation (Outer Capsule)

The outer HPMC capsules are separated manually or using semi-automatic equipment. A banded/coated inner capsule is placed into the body of each capsule. The prescribed amount of powder blend is then accurately filled manually or using semi-automatic equipment into the same body of each capsule, then each capsule is closed.

Capsule Banding (Outer Capsule)

The outer capsules are band sealed using a hydroalcoholic HPMC solution followed by drying. Banding is performed circumferentially at the capsule seam using semi-automatic or automatic equipment.

Capsule Coating (Outer Capsule)

The outer capsule is coated with an enteric polymer (poly(methacrylic acid-co-methyl methacrylate) solution using conventional pan coating equipment. Capsules are coated until the target weight gain is achieved.

Packaging

Each capsule-in-capsule unit dose is packaged inside a heat-sealed foil pouch containing a silica gel desiccant pouch. In addition, the capsule may be inserted into a protective plastic sleeve prior to placing in the foil pouch. Packaged capsule-in-capsule is stored at 5° C.

INCORPORATION BY REFERENCE

The entire disclosure of each of the patent and scientific documents referred to herein is incorporated by reference for all purposes.

EQUIVALENTS

The disclosure may be embodied in other specific forms without departing from the spirit or essential characteristics thereof. The foregoing embodiments are therefore to be considered in all respects illustrative rather than limiting on the disclosure described herein. Scope of the disclosure is thus indicated by the appended claims rather than by the foregoing description, and all changes that come within the meaning and range of equivalency of the claims are intended to be embraced therein.

SEQUENCE LISTING (523 sequences)

SEQ ID NO: 1 - DNA, 1423 bp, Roseburia hominis
gctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccaagtatgtaatgtactttctcttcggagcagtggtgacaggtggtgcatggttgtcgtcagctcgtgtcgtgagatgttgggttaagtcccgcaacgagcgcaacccctattcttagtagccagcggtttggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaag

SEQ ID NO: 2 - DNA, 1423 bp, Bacteroides thetaiotaomicron
ggatgaacgctagctacaggcttaacacatgcaagtcgaggggcagcatttcagtttgcttgcaaactggagatggcgaccggcgcacgggtgagtaacacgtatccaacctgccgataactcggggatagcctttcgaaagaaagattaatacccgatggtataatcagaccgcatggtttgattattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaataatctggaaacaggttagccgcaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagc

SEQ ID NO: 3 - DNA, 1409 bp, Eubacterium hallii
ctcaggatgaacgctggcggcgtgcctaacacatgcaagtcgaacgaagcaccttacgagattcttcggatgatcgttggtgactgagtggcggacgggtgagtaacgcgtgggtaacctgccctgtacagggggataacagctggaaacggctgctaataccgcataagcgcacgaggagacatctcctagtgtgaaaaactccggtggtacaggatgggcccgcgtctgattagctggttggcagggtaacggcctaccaaggcaacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgctcggctagagtacaggagaggcaggcggaattcctagtgtagcggtgaaatgcgtagatattaggaggaacaccagtggcgaaggcggcctgctggactgttactgacactgaggcacgaaagcgtggggagcaaacaggattagataccctggtagtccacgccgtaaacgatgaatactaggtgtcggggccgtataggcttcggtgccgccgcaaacgcagtaagtattccacctggggagtacgttcgcaagaatgaaactcaaaggaattacggggacccgcacaagcggtggagcatgtggtttaattcgaagcaacgcgaagaaccttaccaggtcttgacatccttctgaccgcaccttaatcggtgctttccttcgggacagaagagacaggtggtgcatggttgtcgtcagctcgtgtcgtgagatgttgggttaagtcccgcaacgagcgcaacccctattttcagtagccagcaggtaaggctgggcactttggagagactgccagggataacctggaggaaggtggggacgacgtcaaatcatcatgccccttatgatctgggcgacacacgtgctacaatggcggtcacagagtgaggcgaacccgcgagggggagcaaaccacaaaaaggccgtcccagttcggactgtagtttgcaacccgactacacgaagctggaatcgctagtaatcgcgaatcagaatgtcgcggtgaatacgttcccgggttttgtacacaccgcccgtcaccccatgggagtcggaaatgcccgaagccagttaccc

SEQ ID NO: 4 - DNA, 598355 bp, Roseburia hominis
agctgagtgccgctaatgacactctttttgtcatgcagttttcaaggtacaaatatatctgaaatgcatttctgcaattcattcaaaatatttcattttcagacttgacttttaatagttagtctttctgtttgaatcgtaattatcttagctgatattacaatagatgtcaaatatttgcatatttattcagaatggagtaaactgtaaaaaaagccgtgcatggaagtggtccggatgaaaaaatgcaggtatggaaagggagcaggaacatgaagccattggagataaaacaccgtgtgattgggggaggggaaccgttgatctgcgttcccgtggtagagcaggatgcacagtcggtgatccgggagatcacgtatctgagtcagagcaccgcggatatgatcgagtggagagtagatgcattccgcgattttacagattacaatgcaatccggagcgtatttgaggctgtggcgcctctgctgggggagaagcttttcctgtatacattccgtaccgcgcatcagggaggcatggcgcagatgaaagcggaacagctcgacgatctgcacgatcttgcggcggaatccggctgtgtcgatctggtggatctggaattctttgaggaagaccgaccgctccataagataaaaaggctgcgggagatgggagtgtcggtcattgcctcacatcacgattttgagcagacgccgtctccggaagtcatgaagatgctgctggagaaaatgtgcgccggcggagcggatattgtaaagcttgcggtgatgccgcagaattataaagacgtgctcaatctgctggatgtgacggcacagtttagagaggagaatccggatacgccggtgattacgatgtccatgggatcactcggcggcatcagcaggatcagtggggagacgttcggctcctgcgtcacattcggcgcgcacgaaaagccgagtgcgccgggacagttcgccatgaaagaactcagacagatgctggatacgattcatgccagcagccagatacaatagaattattaaaaaaagataaacacagggagattgcttgacgcagcaatctccctgtgctattataatgtcccaaattatgtaacagtgttaataattaacaaggtggtgaaatatggaagaattgtatgcgggtttatttcgggcgatgaaccgtttcggaaaactgcggatcggagaactgttttccgatatgacaaaaagcgacggcatgatgctctggacaatttcacagttgaaccaggaaaagaataatgggagagctacagtgtctgaactggcagagaagcttcatacccagaattctgctgtgtcaaggactttgaagaatctggaggatcacggctggatctgcagaatgacagatccgaaagaccggcgcaatacctgtgtcgctctgacggagagtggggaggacatgcagcaaaatatgacatgcaccatgcaggaatttggcagggcagtcatttcgcagatggatgaacaggatctcaaaaagctcatagtatgcctggatgaattatatgacattgcagcagaagaaatcgagaagagaagtatgcgaaacagaaaggaaggacaacatgggaaagatttttaaaaatatgattccatactggaaaccgctgatcctggtgttattgctgttgtttgtgcaggcgtggtgcgatctgtcactgccggcatacacatcggacattattgacgtcggaattcagaatcagggaataaaacacatcctgccggaggcattgacaccggaggagtatgagaaggcagaacttttgatgacggatgaagagacggcatcctgggaggaaagctatgcgttaaatggcagtgtgtacgagcggaatgtgaccggggaagaacggctggaggaactggatgatacgtttctcgtaccgcttcttatgaattatcagatgtctgctatggaggaaagtacatttaagaaactgatggcagagcagatgcatacagatgagtctgcgctggacggaatgacgatcgagcagatcggcgcgtccatgggcgtggaattaaaaacatttgaaaaagagacgcagaacgaggacggaaatacgacgacagtcacctgtgtggatatgagagatctgctgcaggcgatggtatccggcggcatgctggaaaaagaccagcttttatcaatgcgcggggaactcaactcgatgctcgatgccatgggcagttcgcttgtcaaatcgatgggcgtggcgtacgcggcaggctgcgatgcggcggcaggcgtggatgtggaagcaattcagaagtcttatctgtggaaagccggtttgaaaatggtgggaatggctctgattatggggattgccacggtcttagtcggctttatcggcgcccgcatcggtgcaggaatcggacgtgatctccgcggaaaaatatttaaaagggtggtaagcttttccaatgccgagatggatcgtttttcaacagcttcgttaattacccggagtacgaacgatatccagcagattcagatgacatgcgcgattctgatccgtatggtagcttatgcaccgatccttggaatcggcggaatcttaaaggtactgcagaccggtgccggtatgggctggatcattgtgcttgcagtgcttgtaattctgggatatgtgatggttctgatggcggttgcgatgccgcgttttaagctgatgcagaaactggtggaccgcatcaacctcgtggcgcgtgaaatcctgacaggactttcggtcatccgggcgttcggcagggagaaaaaagaggagcagcgttttgacgatgcgaaccgcgatctgacgaaaaccatgctttttacaaaccgcgtcatgacatttatgatgccgggaatgatgatgatcatgaatgtgcttacggttggaattgtgtggttcggcgcacataagatcgatcagggaactatgcaggtcggctccatgacggcgtttatcacgtatgcgatgatgattgtcatggcattcttaatgctcgcggcaatgtcgattatgcttccgcgtgcggcagtggctgcggagcgtattgatgaggtcatccgcacgcagtcttcgatcgcggaaccaatgcagccggagaaaataaaagaacaccgcggcgtgatctgtttttcccatgtgaacttccgctacccgaacgcgcaggaggatgtgctctcggacattgactttgttgcggagccgggaaagacgacggcaatcatcggcagtaccggctgcggaaagtcaacactggtgaacctgattccgcgtctttatgatgtgacgggcggaagcattaccatggacggcattgatatccggaagcttgccatggcagaacttcgggaggagattggttttgtaccacagaaaggagtactgttttccggtaccatcgcatcgaatttaagattcggcaaggatgatgccaccgatgaacagatccgggaggcggcagagattgcgcaggcatcggattttatcgcggagaaaaaagaaggatatgacagtgccattgcacagggtggaagcaatgtgtcgggaggccagaaacagcgccttgccatcgccagagcgatcgcaaagcagccgcaggtttttatttttgacgacagcttttccgcactggatctgaagacggatgccgcactgcgccgggcacttgccaaaaaggttgccgacaagacggtgatcatcgtcgcgcagcggatcagcacgatcctgcatgcagatcagattctggtattaaacgatggacgcattgtcggaaagggaacacacgaggaactgcttcgcggctgtgaaacttatcgtgagatcgcgagatcccagatgtcggcaaaagagcttggaatggaggaacaggaggtgtctgtgaatgagtaacggaaatgagacggcaaaaggaatgggcagacgccgtggaccgatgggcggacgcggtatgacgccgggagagaagccgaaggatttaaagggagccatcggaaaactggcatcctatatccggcattttaagtttgcaatcgttattgttgcagtatttgcggcgtgctccacggtgttcagcgtaatcggaccaaagattctgggaaaagcgacgacagcgctctcggaaggactgatggcgaagatccgcggaacaggcggaatagattttacttatataggaaagatcctgctgtttgtattggggctgtatcttctcagtgcactgttttcgtttgtgcagggctggattatgaccggggtgacccagaagatctgttaccagctccggaaggaaatctcggagaagatcaaccggatgccgatgaagtattttgagagccgtacctacggtgaggtgctttccagaatcaccaacgatgtggataccttaggacagggactcaaccagagcattaccacgatcattacctcggttgcgacactgatcggtgtatttatcatgatgctcagcatctcgccgctcatgacgctgatcgcgcttgtgatcctgccggtctccgcggggctgatttccttcgttgtgaagaagtcgcagaaatactttaagaatcagcaggaatatctgggacatatcaacggacaggtggaggagatttacggaggacatctggtcattaaggcatttaacagagagcaggatacgatcgaggagtttgatgcgacgaaccagaagctgtatgaatcggcatggaagtcacagtttctctccggtatgatgcagccgatcatgatgtttgtcggaaatctcggatatgcagccgttgcgcttagcggaggtctgcttgctatccggggaacgatcacaatcggagatattcaggcgtttatccagtacgtgaaaagtttcacacagccgatccagcagatcgcacaggtcatcaaccaggtgcagtcgatggcggcggcttcggagcgtgtgtttgaattcctgaatgaggaggaagaagaccagtccgtggagaatccttgtgatatttccaaggtgacaggcgcggtatcgtttgagcatgttcatttcggctaccagccggatcagacgatcattcacgacttcagcgtaaatgtggctccgggacaaaagattgccattgtcggaccgacaggcgccggaaagaccactatggtcaaacttctgatgcgtttttatgatgtaaacagcggcgcaatctgccttgacggtcatgacgtgagaagctttaaccggcgggatctgcgtgaggcattcggtatggtgcttcaggatacctggctgtttcagggaacgatcatggaaaatatccgttacggcaggctggatgcgacggatgaggaagtcattgccgcagcgaaggcggcgcacgccgaccactttatccgcacactgccgggtggctatcagatggagttaaacgaggatgcaagcaacgtctcacaggggcagaagcagcttctcaccatcgccagagcaattcttgcagacaacaagatcctgattcttgacgaggcgacgtcgtcggttgacacacgcacggaggtggcaatccagaaagcgatggatcacctgatgaaggggcgtaccagctttgtcatcgcacaccgcctgtcgaccatatgcgatgcggatatgatcctcgtcatgaaggacggcgacatcgtagagcagggcagacacgaagaactgctcaaaaagcagggcttttatgcgaacctgtataactcgcagttcgaggagaccgtggcataagagacggcatgctccgaaagcggactgccgtacggcaaggagggataaggaatattacaggaacacccgggaacagaaagctccggaatagaacggacggcggcaattctgaccgcaaaatccggtatttttaaccacgccgcgcctggcatcttcgatgatctgtgtctttccaagtttggaacactccacggaatgagttcgcaagccggcagacaattttaggacttttgtgtgtgtcccttatgacacctctgaatagaacataaccgcgcgaagccgatgtttgagtcggcatctgccttattttcaatagcagatgccggcgagtttcggttcgcgcggttttatattgtctgtgaagaggtgccattagggacaccagaaagtccgctcattgtctgcagcttgtcggacacactccgtgagtgtccaaacgtggccaagacacgaaatgggatgccggacgtggcatggaagaaatacacgaattttgcttcaaagaatttgctgccgtccgttctatccggaactttcaggtatctgtttttcggaatattcctcatcccccatccttttccgttacggctggcgattacggggacgtgccggatcggacgccgcgtctgccggatgcgctgcattgcgcttggcgcgctgcatgccgccggtcatgtgggagagcgcgggcgctgcatcgtccgcttcgataaagcaggcgcgcttgatggaatcttccccgtagcgggagcggatggcgtcgactgccacattcaggcgggagagcttctcgttcttctgcatgtcaaacaggtcgtactgctcgtagtgttcctgcgtcgccttgccggtcgagacgccgagcagccggattggacggtgatcccagagctcgtcgaagagctcacaggcacaggtgtacagcttctccgtgacgttggtggaggaagcaagcgttacctgtctggaagtgtggcggaaatcattgtccacaatctgcacctgcaccacgctgacataggcgccggcagcgcggattctggcaccgaccgtctcacagagcgagagaagcacatgctttgccaccgcggtatccgtcacatcgtactggagcgtgagggaattgccgaatcccttgcttgcggcgtcgttgtgggacagcggtgtggattcgattccgttggcataattccagatggtgtcgccgtgggatttaaagacggagagaatcatggcgtgatcgcttttggccagctggccgatggttgtgatgccgagggagcggagccttagggcggtggatttcccgacgaaaaacagatcctcgatcggaagcggccagaacttttcttccatttcggatgggaaaagcgtgtgtactttgtccggtttttcaaagtcggaggcagtcttggcgagcagtcggttggaggagatgccgatgttcacggtaaagccgagccgggtgtgaatctcgtccttcagcctgtgggcaaagtccaccggattgccgtagagcgaggaggtgcctgtcatgtcgcagaaggcctcgtcgatgctgtaggcgtccaccgagggcgcatattctttgagaagtgccatgaactggcgggaacgctccacatagatgctgtagtgcggggcatagatttttaaatcagggcacttgcgccttgcctgggcgagcggctcgccggtacagacgccgagcgcggctgcggagggcgacttggcgagaacaatcccgtgccgtgtcttttcgctgccgccgatgacggaaggaaaagagcggatgtccggggcgtccggatcctggcgcagaagttcggcggcttcccagcttaaaaatgcggaattgacgtcaatgtgataaatgagcggctgcggcatatggtaatcctccttatgatggtgtattatagcagagaagtgaacaaaagtaaatgaaaatacaaacatatgttcctggaggaagaatgaagatccgtatctatgtcatgacacataaaaagtttgagatgccgcagagcccgctgtttcgtccgctccatgtgggacgcgcgtgcggggaagacctgggctatccgggggatgataccggagagaatatttccgacaaaaattgctattacagtgagctgaccgggctctactgggtgtggaaaaactgtcacgatgtggattatgtgggcacctgtcattaccggagatatctgctcagggcggatgagaggattcttatggaggacgattacgaaaagcttttatcagagtacgatctgattacgacgaagcaggttgcactcaataactcctactattacggtttttgcgccaatcataacaaaaaggcactggatgcggcgggagaggtgataaaagaacgttatccggcatattatccggcgtttgagaggctggtgcatggcacaaggacgtatttcgggaatatgtttgtcacgtcgaaggagctttatgattcgtactgcagctggctcttttccatatttgccgaggtggaaaaacggatctgtctggagacgggggaggatgcctaccataagcgcgtgttcggatttatctccgaattcctgctgctggtctgggtgacggtgcagggactttcggtgtgtgagtgcaaggtggggatgatcggtgagaaggcggagacgagagagatgaaagagcagcttgccggctattttgcaagacgcgatgtggacggcgccaaggcgtatttccttgagcgcagaaaggagcgcccggacgttttgatggaggcgtcggatgtgacgggagaactccggctttgcatgcaggtgatcgcaacggcgggaatggagcagacacgttacgggacgaaccttttagaacgcgaaaatcgtttcaaagagctgatgcagatgtttgaccgtctggaccagatcgtgtaccgctaccgcaacggtctgcagaaaaaagaggatgccgtctttttaaaggaacagggaatcacggacaccgcgcttctgatcgcactgcggatcccgggggatgatgcagcgcgccagaaggaactgtttgcacagattacggcagacaaaaaagcactggatggcaccaccgcagataccgttactgtgtgagttcacacaattttcagaaaagcttttgggataagcgttgacaaacaaaatgccaatgtgctagtatatgttcgttgcgatatgagtttttcagagatgcgcaatgggcaaccgtagtctaatggatagaacaccggactccgactccggcaatgcgggttcgattcccgccgggtgcatttttttgacagatatggcagagcagattgctctgccatagaatattggagaatctttgacaggcgagagactgtcagattggaacatttgtgcctgcagatgtgcacacagatgatgcggtagtgcagcggatgacgaattgtttgggaaaggtacggtggagaatcaatggagaattccagtttgaatcatacagagaatcataagacagaggagaaggagacgaagagaacgccgattaagcagagaaaaaaggagaatgaggttctccgatttatccgggagcacatccggtatttcgcggcgggagcgctggtggtcgttttaatcctcgtgcttgccatgtgtgcgaagccgaagggatccgactctgatgtcgtggtgaatgcgaacgcgacggagagcacgcaggcgacggaagaagcctatcaggtggatgcctatgagaatatcaacacactgattacacagtattacacggcgtatgcggcgggagacattacgactctctcttcgattgcgacaccgatttctgcaaatgagcagagctacatcggattattttcacagtatgtggatgaatatcagaatatcaagtgctacaccaagacagggctggatgcgaactcttatctggtttccgtgtcgatggagatcaagtttacgggagtggataccacagcgccgggactggatttcttctatgtccgtacgaacgatgacggcacgctttatattgacaacctgtacagccagtacaaccttgccaatcaggagaatgcgcttgacaccagcgtacagagcctgatcggtcagtttgagagcgagtcggatgtggtggagctgcagagcgaggtgcagacgagatacgatgaggcgcttacagcggatgagaatctggcgaatatgattcagacgacgattcctgcagcaatcaaggactgggtgagccaggtggcggcacaggcggcaaccgagcagaccgaagcgaccgaggcggcggaacagccggagaccgagcaaccgcaggagacagagcagcaggaagagaccgtacagcagacagagacgcttgcgacgaaggatcgtgtgaatgtccgtgccgcagcggatacggaatctgaaaagctcggcaccttagatcagggaaccgttgtcacccgtacagcggtggacggcgactggagcgtgattgattacaacggtacgacaggttatgtcaagaatgagtttttgacctatgatctgccggatacgacggcggagaataattcggacagttcatcggataacagcgacagcacaaacagtgcttccatcgcagagggaacggtgattatgctggagaataccacgaatatccgctcgggaatgagcgaggattccggcaaagtcggaacggcttatgcgggagagaaggtcacagttgtgatgagttatgcggagggctggaccaaggtaaaatggaacggcgagaccggttacataaagacatctttattacagtaagcggtgcggcctggctgataccggaaaacggagactttttaaaaggaagtctccgttttttcacagagagaacatttgaaacggagagattatggacgaacagggagtgcggatcaacaaatatctgagtgaggcaggggtgtgttcaagacgtgaggcggaccgtcagatcgaggcgggtgcagtcactgtggacggagtctgcgccaggcccgggacaagagtgctgccggggcagacggtctgttttcaggggagaagcgtaagccaggaggaagaacgcatcctgctcgcgtttcacaagccggcgggaattgtctgcacagcggaaaaacgcgagaaaaacaatgtgatcgactatattcattatccgaagcgcatctacccggtcggaagactcgacaaggactcggaggggctgcttcttttgacgaatcagggcgatcttgtgaacaagattatgcgggcgggaaacatgcacgagaaggaatatctggtgacggtgaacaaaccgctcacggagtcttttctgcgcggaatggcaggcggcgtgccgctcgtggagctgaatgcgacaacacgccggtgctttgtggaacgcatcggcaagcgcgagttccggatcattttaacgcagggattgaaccggcagatccggaggatgtgtgaatatttcggctaccgtgtggaaaagctggtgcgcgtgcgtattatgaatattgaattgggcagtttaaagagtggaacataccggaatgtgacggaggaggagtatcacgaattgctccgcctgaccgcggattcgtccagcgatccggtgatgcctgcaaaaaagacgggggagaaaaagagatgacaccggaagaacagatcaaaaacctgcgggaacagattgcgtatcacagtgaccgctattacaatcaagataatccggagatatccgattacgagtttgaccagctgatgctggaattaaagcggctggagcgggaacatcccgagctggtcacaccggattcaccgacccagaaggtgggcggcacagcgaagcggacggcgggtgtgctggtaaggcacaatgtcccgatgctaagcctgcaggatgtgttctcaaaggaagagatctacgattttgtggcacagatgaaagaacagctgaacgatccggagtttgtcgtggagtataagatcgacggactttcgatgacgctgcgctatgagaacggggagctggcgctcgcggagacgcgcggcgacggcatcaatttcggcgaggatgtcacggcgaatgcaaaggtgatcggcgacgtgaaaaagaagctccgggaggcaccggagtatctggagatccgcggggaagtctacatgaagaatgcggattttgatgccgtgaatgaaaaacaggagctgctcgggaaaaagccgttcgccaatccgagaaactgtgcggcgggcacgctccgccagctggattccgcgatcacgaaagagcgtaagctgtcgctgtttatatttaatatccagcaggtgcggggaatgcagtttgacacgcacacacagggatatgaatatctgaagaaacagggaattcatgtgattgatgattaccgtgtctgcaagacggcagatgaagtgtgggaggcgattaccgccatcggcgagaaccgcggcaacctcggctatgacatcgacggagcggtggtcaagatcaaccgtttctcggaccgggagaagctcggggcaacctcgaaagtgcccagatgggcgatcgcctacaaatatccgccggaggaaaaagagacaaagcttttggatatcgagctgtcggtcggaaggacaggcaggatcacgccgactgcggtatttgagccgatacggctctgtggaacgagcgtttcgagggcgacgcttcacaatcaggactttatcgatgatctggatgtcggaatcggggacaccatcgtcgtctacaaatccggcgagatcattccgaaggtgaaggaagtgcggaaagaaaagcgcccggagggctggaagcgctttgtgataccggatgtctgtccggtgtgcggggcgaagacagagcgggaacgcgatacggcggacatcaagtgtacatcgccgaactgcccggcgcagctggagcgccacatcatcaattttgtcggaagagacgccatggacatcaaggggttcggaacggtttatattgaagaactcgtcagaatgggttatattaaaaatgtcgcggacattttttcgctgaaggagcaccgagaggaactgattgcacagggaatcatcggcaaggagaagaacacggacaagcttctggaggcgatagaaaaagccaagcagaatgatgcgtacaagctgttgaccggtcttgggataccgaatgtcggaaaggcggcagcgaaggcgatcatgaagcattttaagaccatggagcggctttcggaggcatccgaggaggaactgacggcagtcggggacatcggaaaagtcagtgcggactgcatccggagttatttttcggatgagaagaaccaggtggtgctgcagagactcgcacaggccggcgtcaacatgacggcggaggagagcgagaccgtggactctgtcattagcggaaagacccttgtggtgacgggaaccctgccgacgcttggcagaaaggaagcgcagacgttgatcgagcggtatggaggaaaggtatccggatctgtgtcaaagaagacggattatgtcctcgcgggggagagcgcgggaagcaagcttacgaaggcgcaggaactcggcatcagagtgatcagtgaggacgaactgtacgacatgctgcagatagagaggtaacatttttatgccaatcagaatacagagtgatttacctgcaaaggaaatactggagaaggaaaatatatttgttatggatgagaatcgtgcgatgcatcaggacatcagaccgatcaagatcggaattttaaatctgatgccgctgaaagaagagacggaactgcagcttctgcgttccctgtcgaacacgccgcttcaagtcgatgtgacatttgttgcggtgtccagccatgagtccaagaatacgtcgatgagtcatctgaataaattctacgagagttttgcggatattaagagacgctattttgacgggctgatcatcaccggggcaccggtggagcagatggaatacgaggacgtggattactgggaggagatctgccagatctttgagtggacgaagagccatgtgacgtccaccctgcatctgtgctggggggcacaggcgggaatgtactatcactacggtctgaaaaagtatctcctgccgcagaaaaaattcggtgtctacgaacaccgtgtgatgaaccggaaagtgccgctggtgcgcggttttgacgattactttatggcgccgcactccagacataccgaggtgcgcacggaggacatccgcaaagtcagggagctgaccattcttgcggagtctgaggaggcgggcgtattcctcgcgattgcggacgagggcagaagaatctttgtgatggggcatccggagtatgaccgctacacgctggataaagaatacaagcgggacaaggagaaggggcttcccattgagccgccggtcaactattatccggacgatgacgatacgaaaaagccgaacctgcagtggcgctcgcacggcaatatcctttacagcaactggttaaattactacgtctatcagcagactccttatgagttcattgatacggcggagattataggaaagtgatgcggcgtttgccaaggcacggaaaagaggacataagatggcagatacaatgaagatggaatacaagattttcctggaggcggaggacgtgtcgcagtcgcggatcctttcctgtgcttcctacatgaagcgtgtgttagagagctgtaataatccttatatcagcagggcagaacttgatgacgagagcgatctggatgattttgtgctgcgccttttcgtggaggaggagatcgaggagaaggagtgcaccaacccggcgatggtggagagctttatcgaggatatggcggagcttgtgacggggattgctgaagcacattcgttcctggatctggagggaagcttttctgtcacatggaagggaacgacgagcgcatatacctttgtttccccaggcggtgatgacggatgcgattttcaggaactcggtgtgaccgaataatttaatactttttttggtttccaaaacgggaatagtctgttataataaacgcataatatcacttaggaggcatttgacatgggtgaggatcgcaaaacatttaaaataaaggacggtaatttgggagaagtgaagattgcagatgaagtggttgccatcatcgcaggacttgccgctaccgaggttgagggcgttggttccatggctggcaacatcacaaatgaactggtaagtaagcttggtatgaagaatctttccaagggaattcgcgtagaagttctcgacggaaaggtaagcgtggatgtggcactgaacatttcatatggttattcgatccctgaagtgtcagccaaggtgcaggacagagtcaagaatgcgattgagaatatgaccggtctggaagtatctatcgtgaatatccgtatcgcaagtgtggacatgggcagcaacaagtaacgcatcgaatcacggtgaataagataaaggatgtccctgcgacatccttttttcctgtacagggaaatgtgacgaagaagacggaacatgagagaaaggaaaggtttatgaccagaagagagttgagagaacagatatttaagctgctgtttggcgtggagttccatgacagacaggaactgccggagcagattgccgtctatgaggagacggaggagccgtgggatgcaaaggacggcgcgtatatttccggcaaatgcgaggatatcgtggcgcatcttgcagagattgacgaggcgatcgatgctgtggcagaaggctggaagaccggacgcatgggaaaggtagatctcacgctgatccgcctggcggtctatgaaatgaagtatgatgaggatgtgccggtcggcgttgccatcaacgaggcggtggagcttgccaaaaagtatggcaccgatgagtcgccggcatttatcaacggtgtacttgcaaagctggtatgagaaaaaatatctattctgtcggtcaggtaaatacatacatccagaacatgttcgcacaggattttatgttgcaccagatcagcatcaagggggaagtgtcgaactgtaagtatcactccagcggtcatatttattttaccctcaaggatcagacggggacgatcgccgcggtcatgttttccaggtaccgccgcggacttgcctttcagatgaaggagggagacaaggttgttgtgaccggctccgtcgaggtgtacgagcgggacggaaagtaccagctctatgccagagagattgagcttgagggtgccgggaatctctatctgaagtttgaggcgttaaagcgcgaactcgaggagatgggaatgttcgatgcggcatacaaaaagccgatacccagatatgccacgaggatcggcattgtgacagcgcctacgggagccgcgatacaggatatccgcaacattgctgccagaaggaatccctatgtgcagttgatcttatatcccgcgctcgtgcagggggacggcgccgcagcaagcattgtgcgcggcatccatgcgctggatgtgctgggtgtggacgtcatcattgtgggacgcggcggcggttcgatcgaggatctgtgggcattcaatgaagaagaggttgcgcgggcgatttttgcatgcaacacgccggtgatctcggcggtcggacatcagacggatacgacgatatcggattatgtggcggatctgcgggcaccgacaccttccgcggcggcggagcttgcagtgtttgatgtgcagctcgtcgaaaagtggctgatggattacggaacacagatgagacgccagctggaattaaggctgaaccagatgcgcacgcgtctcatgcatgatgaggagaagctgcgctatctgaatccgcgcgccaagctcaaagagaatgaaaagcgtttggacgagctgggcgccgccttagagcgccggatgcaggcaacgcttgaacagaagcgccatacgctggcacttctttcaggaagactggacgggatgtcgccgcttaagaagctggcgcaggggtattcctatgtggaggatgccggcggacatgcgctgacggatgcggacaccgtgcagatcggagaagcgctttccattcatctctaccggggcagcttaaaagcggctgtgacagagatccgtaagcaggatgccgcagaggatggtttggagaaaggaagaatcgatggataatcagaacgaaaaaaagccgacgcttgaggaggcttttacccggatcgaggcgatccttacacagatggaacagccggagatttcgctggaggaatctttttcgctgtatcagcagggggtattgcaattaaaaaattgcggaaccattctggacgaagtggaaaaaaagatgcagatcctcggtgaggacggggaaatagaagagatgtaagaacggtagggggatgcagacgatggattttaagaccgagatggcggagcgcacagcgcagattgaacagatcataaaaaaatacctgccaaaggaagaaggctatcagaagaccatcatggaggcgatgaattacagcgtgctggcgggaggtaagcgtctccgcccgatgctgatgcaggagacttaccgcctgtttggaggaagatccgaggtgatcgaaccgttcatggcagcgatcgagatgattcacacctactcactggtgcatgatgatcttccggcaatggataatgacgaataccgccgcgggaagaagaccacgcatgccgtgtacggggaggcaatgggaatcctcgcgggagatgcgcttctgaattatgcatatgagactgcggcacgggcatttgccatggaaccgggcaatcccggggtatgccaggcatttcagattctgaccgcaaaggcggggatctatgggatggtcggcggccagaccgtggatgtcgagtcggagggaaagccagacatgaccaaggaaaaactcgattttatctatcgtctgaagacgagcgccctgatcgagggggcaatgcttacaggagcggtgctggcgggagccacgcagggtgaacagaagattatcgagcagacagccggtgaggtcggacttgcatttcagatccaggacgacattctggatgtcacgagcaccatggaggtattgggaaagcccatcggcagcgatgagaagaaccacaagatcacgtacgtgacctatgagggcattgagaaggcgaaggcggatgttgcgtcactatccgagcaggcgattgcgcggatggattcccttgtggttaagaacgaatatctgacggaactgctcagatatctgatcctccgggagaagtaaactacgataaaaagcagaggtgctctgtatgatcttggaacgtatacaaaaagaaaatgatatcaaggaactctccgatgaggaactgaaaattcttgcatcggagattcgtcaatttttaatcgagaaaatctcggataccgggggacatcttgcgtctaatctgggcgtgatcgagctgaccatggcgctgcatctgtttttggatctgccgaaggataagcttatctgggatgtcgggcatcagtcttatacccacaagcttctgaccggaagaaaagagggatttgaccagctgcgcaagtacgggggaatgagcggattcccgaagcgcaaggaaagcgaatgtgactgctttgacacgggacacagttccacgtccatttcggcgggactggggtacgcgcatgcgagagagatcacgggggaggactacaaggtggtgtcggtgatcggagacggtgcgctgaccggaggtatggcgtttgaggcgcttaataatgcggcacagcttaactccaactttatcattgtcctaaacgacaataatatgtccatctcggagaatgtcggcggattgtccacctacctggcggggttccgcacggcggatgcctaccgggatttaaagctcggggtcatgaattccctcaacaagattccggtctacggcgataagatggtggagcgtatccggcgcacgaagagcggaattaagcagctgttcattccggggatgctgtttgaggaactggggattatttatctcggaccggtggacggaggcgatatcaagggtattttaaagctgctgcaggaagcgtcgcgtgtggatggaccggtgctggtgcatgtcatcacgcacaagggaacaggctatgcacctgccgagcggcatccggcgcggttccacgggacggagccgtttgatatcgagacgggacttccgaagcatccgcggacaaaggcaaattacaccgatgttttttccacggtgatgcgcaagcttggcgaccgtgatgagcgcgtggtggcaatcacggcggcgatgaccgacggaacgggattaaaacgtttccacaatatgtttccggagcgcttttttgatgtgggcattgcggagcagcatgcggtgacatttgcggcggggctcgcggcgggaggcttaaagccgatctttgccgtgtattcatcttttttacagcgcgcctacgaccagatcctccacgacgtctgtattcagaacctgccggtggtatttgcgatcgaccgtgcaggacttgtgggcagcgacggggagacccaccagggaatttttgacatctcctatctctcaacgataccgaatatgaccattatggcgccgaagaataaatgggaactgtcggatatgattaaatatgcagttgatttttccgcgccgattgcgataagatatccgagaggagaggcatatgacggattaagagagtaccgggcgccgatcgcctgcggcaagagtgagtggatctaccggtcgggtcagattgcgctgtttgcacttggtgcgatggtgaagacggcggaggcggtgcatgagcggctgaaggcgctcggctatgagagcagcttaatcaatgcgcggtttgcaaagccgctggatgaggatgcgctcctgtccgcagcaaggcatcacgaccttatcgttacgatggaggagaatgtgatcagcggcggcatgggcgaacaggtcatgcgtttttacgaggagcacaatctctctgtgagagtgcttgccatcgcgattccggatgagtacgtggaacatggcaatgtggagattctgcgcagggaagtcggaatcgatgtggagacgatcacggagcgcaccatagaggtatatgaagaactgcacgcacaggaaagcggtgcggaaaggaatgacttttgaaagaacgattagatgttttgcttgtaaacagaggactggctccgtcgagagagaaggcaaagaccatgattatggaaggcaatgtctttgtggagaaccagcgggaagataaggcgggggctacatttgacacggaggccgagatcaccgtaaaggggaacatgctcaaatacgtgagccgcggcggattaaagcttgaaaaagccatgacgcatttcggaatcacgctggagggtaaggtctgcatggatattggagcttccaccggtggatttaccgactgcatgctgcaaaacggagccgtcaaggtgtattccgtggacgtcggctatggtcagttcgcatggaagctgcgccaggatccgcgcgtggtctgcatggagaagaccaatatccgctatgtgaccccggcggatatcgatgacgtgctggattttgcgtcggtggatgtgtcgtttatttcccttaccaaggttttaatcccggcacgggagctcttaagagacggcggcgagatggtctgtctcatcaagccccagtttgaagccggacgggaaaaagtcgggaaaaagggtgttgtgcgtgacaaggctgttcacgaggaagtggtagagcggatcattgaattcgcgtcacagaacggattttttgtaaagaatctggaatattcgcccatcaagggaccggaaggaaacatcgagtatctggtgtacatccggaaggatgagacgggcggcgtggatgcggcagtcgacattgaggcggtcgtggatgcagcgcacggcgagttagacaagtaaccggacgtctgtgaatgaccgggcgtgtctgccggatgtggggaagcttatgagacattttttgatcatcacaaatacatataaggacgagaacggcagactcaccggagaacttgcggcgtatatccgcaaaaagggcggagaatgtgactgcttttacagtgacggggagagcaaaagcgaggcggcgcctgctttggataagatggatccagcgacggactgcgtcatggtgttaggcggcgacggaacgctgattcgcgcggcatccaggctggtggacagcaggattccgttgatcggcgtgaaccttggtacggtcggttatctgtgtgaactcgaggagagcaacgtgtttgacgcggttgaccgtctgatggcggatgactgtatggtggaggagcgcatgatgctcaccggcgcaggcatccttggcggagtgcgggaagaatacggggttgccctgaatgatatcgtgattcaccgcacgggggagttgtcggtagtcagcctgatcgtctatgtgaacggggagtatctgcatacgtttcgggcggacggaatcattgtgtcgacgccgaccggttctaccggctacaatatgtcggcaggcggaccgatcgtggatccgaaggcacagatgattttaattacgccgatcaatgcgcataatctcaattcacgcagtattgtgatcggtgcggaggacgaagtggttgttgagatcggcagaaggcgctcacagaaggatgagactctggaggtcagctttgacggggataccgccgcaagacttgtggtgggagataagttcagtatccggaaggcttcggacacgacaaggatcttaaagctgagcaacaagagctttctcgagatcctaagcaaaaagatgcaggtatacacataagcgggaaacggagggcagaatgaaaaccaaacgacaggcgaaaatgctggaactgatcaagagaaatgacattgaaacacaggaagaactgtcggattatctggagcgtgagggctatcaggtaacacaggcgacggtttccagggacatccgggaactaaagctcaccaaggttgcaatgagcaacggcaggcagaaatacgttgcgctgcaggagacggacgaaaatctgtcgcagaaatatgtgcgcgtgttccacgacggatttgtatccatggatatggcgcagaatattctggtcattaagactgtctcgggtatggcgatggcggtggcggctgcgttagatgccatgcatatgcacgagatcgtgggctgcattgcgggggatgacaccatcatgtgcgcgatccgcagtgtggatgataccgttgcggtgatgaaccgcttgaaaaagcttgtggaagactagacgggattcttttggggagagtagaaggagattctatgttacaaagtctgcatgtgaaaaatctggcgctgattgacgaggcggaggtggattttacccggggactcaatatcctctcgggagagaccggtgcgggtaagtccatcatcatcggttcgatcaatctggcgctgggtgaaaaagtgcaaaaggaaatgttgagagaagatccgcagaccggggagtttgctccggcgctggtagaactggtatttacggtggagaacgggcaggaacggcaaaagctggaggcgctcgaggtctatccggaagatgaccaggtgatcctaagccgcagaatcgtaggcggaaggggaacggcgcgcgtcaacggtcagagtatgccggcatccgcggtgcgcgagatcgcggcgattttaattgacattcacggtcagcatgagcatcagtcgcttctttcaaagcgcagacatttggagattctggatgcctatgtgggagagacgctgacagagaaaaagaaggcgctcgcagagacttaccgcagctacaaaaagctggtggaggaagagaaaaatgccggcatagacggcgcagagcgcgagcgggagatttcgttcctggagtacgagatccgtgagatcgaggaggcaggacttcgggaaggcgaggacgaggaactggagaatgagtaccgccggttttccaacggacagaagattgtgaatgccgtaaacggtgcatacagcaataccggcggcgaatcggactgtgcgtcggagctgaccggaagggcggtgcgcgaactctcgtcagtctccggatacgatgagaagcttgccgaactcgagcgtgagctgcttgagatcgacgggctgttaagcgatttcaaccgggaacttgccgattatgtcgagaacatggagtacgatgaggagacgttctaccaggtggagaagcgtctcgatgaggtgaatcatctgaaatccaaatacggcagcacgatcccggacgtgcttctggcattagaagagaagcaggaacgcctgatgcagcttaaggactatgacacgtatcttgccggtcttaaggaagagattgcgcggaccaaaaaagtcttagagaagcagagcagcgaggtgtccgcaatgcgtaaggaggcggcagagcggcttaccgcggcggtcacgcaggcgctactggatctgaatttccttgatgtgcgttttacgatgaattttgagcgcatggcagagtatacggcgaacggattcgacgatgcggaatttttgatttccacgaacccgggcgagccgttaaaaccgctcggaaaagtagcgtcgggaggagaactttcgcgtatcatgcttgccatcaagacggtgttagcggatgaggatgcggtggagacgctgatttttgatgagatcgacagcggaatcagcggccggacggcgcagatggtttccgagaagatgaacgtgctgggacggtcgcaccagattatctgtatcacacatctcccgcagattgcggcgatggcggattcccattatctgattcagaaatctgtgcagaatcagacgacagtctctacgatccgcagactgtcggaggaggagagcgtgcaggagctttcccgtatgcttggaggcgtggagatcacggagacagtaaaagagagcgcaagagagatgcgcgcgcttgcaaaaagcaaaaaatcggggtttgaaaagtaaaaattttcacataataaaagaagataccacaggtatgagataccatggtatcttctttttttgctgtgtgacggccttttggggtacagaaaatggtatgggggcagatatgagacataaattttattttttgatacagcagatcacatgggttgcttttttacttttgacactgtttgccgtaaagtcgttcgggcgggcgctgccggatgagatctacgtgccgttcggggaaaaggcggattaccggtttggcgttccggtgagcgtgacgttaaaggacgacagcgaggaagtgttctatcgcatgaacgggcagtcggatactgcggcggaggctcctttttataccgttacctgcaagctgttcggcattttcccggtaaaagatgtgaaggtgatgatggtcgacagacaggcggtgtatgcgggcggcgaggcgatcggcatctatgtgaagacggacggaatcctggtactcggcacggcgaagattgcggatgtgtggggcaatgagtgcagtccggcgcagaatctggtgcagagcggggattatattgtgagtgtgaacggggagacggtgtatgagaaagaggagctgatggacaagattgacagctacggcagcgggcgtgagatcataggagtgatgcggaagggggagtatgtggaagtatccatgaatccggtcaagggtgagacgggaaaataccgtctgggcatctgggtgagggatgaccttgccggggtcggaacgctgacctactacaggcaggacggcggtttcggcgcgctcggacatgcggtgagcgacggtgacaccggcgtgcagatgagcctctcggaagggtatatttacgagacaaaaattgtcagcatccagaaggggaagaccggcgtgccgggagaacttgcgggcatcatcgactacggggaatcgcactgcatggggagcattacggagaactcgccgcttggcatccgcggcgtattaaacgatacggcgggggagctggagggagaagtttatgaggtggcttataagcaggatattgaacccggaaaagcctacatcatctcggaggtgtccggtgagcgcgcggagtatgaaatcgagatagagagtcttgattacagcggggatgaggaaaacaagggaattctttttaaggttaccgatgagcggcttttagatctgaccggaggaatcgtacaggggatgagcggcagcccgatcatccagaacgggaagatgatcggggcggtgacacatgtgtttgtgtcggatgcgtcgatgggttacggaatctttattgagaaaatgttgtgattgcacgacaaaaacttttacaacgtctggtacttatggtatactacagtcagtattgttggctttaaggacggaagacggaatggaacagcaggaacatatacaaaaactggcagatgaatactacgaagagggcagagccagattctttgaccacaagctggaggaagcggcgatgctcgtacagaatgcgcttcatctctacaagaagtgtgatgatatgctaaaatacgccacagcgctcaatatgctcggtgtgatctacggtgccacggggaacgagacgatggcggtggattatctggttgagggacttgagtgtgcgatcgattaccagctaaataacatcacgacactcttttataacaatatcggttccaggtaccaggaactgggagaacatgagaaggcgatcgattatttcttaaagtcggcgcgggaactgcagaatccgacctgcataaaggaggagcgctaccgttcctggactctgattacctacctgaatctggcggtctcctactacgaactgaatctgtacgagctttcctacaaatatttagagcaggcagagcggcagcttgacgaggaagtggaggagatgtatcattatacggtactgatcttcaaatgtaggctgctctggcagatggaaaagggagactatgtgtatgagcacatggaggatcttctggcgagcggtgaaaaagacagcaatgcatcggattatctgagcgatatgaaggatctgtgtcagttgttccgcgacatgaaagagtatgaatactggaagcagaccatatctgcggtcgagacctatacgatcgatcagaataccgtctttttccggctttttctgacagaattgtggatggactactatcagactgtggggaacgaagagcgctatgtggaactgtgtgtggcacatgcggatctgtataagcgccagaaagcaatcgatgtgaaggatcgtgcaacagcgatcgacatcaaggtccagctgcgggaaaaagaggcggagcgtaagcgcgtggagaccatgtctgtgacggatgcgctgaccggactggggaaccgctattctcttgagcgtgaggcggtgcacatcataagggatgcgggcggtgagcggatcacggtcggcgttttggacatcgactgctttaagcagctgaacgatacctacggacatattcagggagaccgctgcctgaaggtggtggcggatattctgaaggaggcagtgatggactgcggacatgtctaccggtttggcggggatgagttcgtgatgttgtttccggcagggatggagaaccggatcgaggggatcgcggaggcgatcctgcagaagattgcggaggcgggaatcgcaaacgagcactcggttgtgcagcccaatcttaccatctcccaggggtatgcctgctttgtgccggagggcacagagagcggagcgcgtctgattgagcacgcggacaaggcgctttactatgtgaagagaaacagcagaaacgcatattatatcatacgcgaatgatgcatatacttcagttgacgactagcttcgacaaattttcttgcgttggaatcagtatcatcagtaagcaaagagttttgtcacaggaggggctaaaatggaaaaactgaatgttgcaatagcagatgataatgagagaatgctgcgattattaggggatattatcgaaagtgatgacgaactgaatgttgtaggagtcgcccgcgacggcgaggaagcataccatgtgataaaggcgaaagaaccggatgtcgtgctgctcgacattgtgatgccgaagcttgacggattgggggttttagaccgcgtgagtcaggacacctccataaaaaagcatccggcgtttattatgatcagcgcgatcggtcaggagaaaatcacggaagatgcgtttgcgcgcggcgcagattattacattatgaagccgtttgacaatgatatcgtgttaagccgcatcaagaatgtgagaagacctgcggcgggacgcggtgcggaagtgcgcaaggtcaatgcctatgagaaggcggaggagacaaaggagcgcaacctggaagcggatgtcaccgatattattcacgagatcggagttccggcgcatatcaaagggtatcagtatctgcgggatgcgattgtcatgtccgtcaatgacatggatatgctcaactcgatcacgaaaattctttatcccacgatcgcgaagaagtaccagacaacctccagccgtgtggagcgggcaatccggcatgcgatcgaggtggcgtggagcagaggcaagatggataccattgatgagatgttcgggtataccatccacaacggaaaaggaaaaccgacgaattcggagtttatcgcactgattaccgaccggatacgtctggaatataagatgcattaacgatgaggacatatttttcaggaggcgcaaagccgaagaagagtatgtcctcattttcggataaccggttccttttgagcgtcagatgtgctataattatacgatgatttttcggaggatggcagatgcagaaaaacaggtatcagctcaggtgcgcggcaggaaaatactggctgttagatatggagcaggatggagaaacgtatcggccgccgctcatgttaaatgagagcggggcttatatcttcaggcagtatatggcaggaaacacggcggataaaatcgcggaggagcttgccactatgtacggggggaccgcagacgatatgcggacagatgtgatgcagtttatcagacaaatggaactacaggggatcttgtaaacgatgaatatattattggtgggaagcaaatgccgcttccttcagcttttgacggacaaactggacaaagaagggcaccgtgtgtttttgctgacggcagaagacaaatcggtcagaacgtccaaaaagatatttgagacgtatcattttgcatacgacaatccgtgcatcagagaggtgcttgagggagtgcgtccggatgtgacagtctttatgggcgcctatgatacaggctttctctgggggaaggggagcagcacggcgtcggcgtacacttcaggcctgtttcagctgctgatgaatgagacggctggtaatgtgggacgctttttgtatctctcgtcggaggaagtcttcgggggagagtatacacaggacatttcgtgcgaggaaaactgtgcggcttatacggtacgcgcgcaggcgattgcggcgggagaggaactctgccgcagttactttaacatgggctatgagacgatcgtgctgcggctggatcatctctacggggaaccgcttaccggggcggaagcgcgtgatatctgcgcccgcatgagtgtggaggggctggaaaccggtgagatccgggtaaatccccacaaccgtgtggcgctgttacactattcggatgccgtcgaatttttgtatgcggtgattacggcaaaaaagatgacgtacggcgtctatcagatttcttccggagagacgatttccgtgcgaagcgcggcggagctcgtggcggcggaactggaaggtgtgaaagtcgtagaggacaccggaagagagcggatggagccggttttgtccaaccagagatttgcggaggagtttgggatacgcattgtacataagccggagaccgagattggcagggaggcggcgtacatccggcagcacgcatcttcttttgtgcggacacagagcagaaaaaagggatggagccggttcggagagcggtcgagagaggccgtaagagcgatgattccgttcgcggagaatctgctttgtttccttccgtttttcctgttaaataactggatggcggggagcgcgtatttccagaacattgatttttaccttctgtatgtgctgctgttcgccattacctacgggcagcagcaggcgacattctcctcgattcttgcggtggcggggtatcttgcggtgcagatgtatcagcggagcggttttgatgtggtgctggatgtcaacacgtacatatggattgcacagctgctgattctgggacttgtgatcggctatatgcgcgaccggctgcatgcggtggaggaggaggagcgccatgaggtggatttcctctccagacaggtggaggacatctcggatgtcaacggcagcaacgtgcgcatcaaggagattctgtcaaatcagatcgtcaaccagaacgacagcttcggaaagctgtatgagatcacgtccagcctggacaagtacgagccgagtgaagtgttgttctatgccgcagaggtgctggcaaagctgatggacagtcaggatgtcgcaatctatacggtggcaaaccactcctatgcgcgtctgttctcggcaacttcgccgaaggcacgcatgctcggaaattccattcactatgtgcagatggaagaactctatgaaaagctgcgggagaaaaaagtattcatcaacaaaaccatggatgagcgctatccgctgatggcggacgccatttattcggaggacgagatgcagctgattctgatggtgtggggaatcccgtgggagagaatgacactcgggcaggcgaatatgctcactgtgatcggctatctgattcagaacgcggtcgtgcgcgccaaccgttatctctcggcgctggaacagcagcgctatatccacggcaccagaattttggaggcggacgcgtttgtttcgctggtgaaggcttatcttaacgccagggagaagaagctgacggagtgtgcgctcgtcgttttcgaggagggtgagacctccagggaggaagccgcgggcgtgctttccggcatgatgcgccagagtgattaccttggagaactctccgacggaaagatgtacgcactgcttgctaacacgagcgcagaggatgcgggaatggttgtggagcgttttaggagcgcaggctttccgtgcaggatgaaagaggagatggaactatgagcaggatcgaaacgtattttctgctgcttgtggtactgaatctgtgcatcacggcggcgtatgtcctgtggaatgagcagcactggagagaagagcccggaaagcgcaccggcggaagaatccgcgcggcggttatgcttttggcaccggtgatcggtcccgtcttctttgtggcgggagaactcgcgcggcatcttttattcggacagtcggcggatctggaagatgttattttcagtaaggagcgtgtcagaacacactttatggcggatgaggagcaggagcggaatgtggtgccgatcgaggaggcactggcgatttccgaccgggatagtctgcgcacactaattatgaatgtggttagaggagatgtcacggactctctcggatcgctggcgctggcacttgacagtgaggacaccgagacctcccactatgcggcgtcggtgcttcgggatgtgctcaacgatttcaggcagcatgcacagaaactctaccggcagatgcaaaaggacggcagagaggcgggggacgatgcctgccttctgatcgagtacatgtatgtcgtcttaaaacagaatgtttttcacgagaccgaacagcggacatttgtggatatgtttgaggaggcgtgtgaacttctctatgaaaaagattaccggaaactcactgcacaatacatcgaatggctgtgtgaactgctgctccgcttaaaggaattcgggcggatgcgctactggtgcaaccggagccgggaattatatccggatgcgctttccacgtacacctgctatttgaaaatgtattttacgcaggagaagaaaaccgaatttttccgggaactggatcggctgaaagcgtccaatatcgtcattgacagggagacgttagagctgatccggacgttcagttagtccggcaggaaggaaatgacatggtatcacgcagaaattatctgacgattgcaatgatgtttgtgattctgctttttatgtttcagtttacaggcgtcatgaaagaacagttaagtgaatatgagagcaacgaatatgcagacgataccacaacatcctttcaacggtcggatgcatttctggcagaacagacatctgacgacgcctgcgaggtgatctatgtgggcgaagcagggggagcggaggaatccgtggtaaagacatggtgcagctaccgcaagcggacgtttttttgcagcagctccctcgcactgcttgacagcctgcaggatgatgcactgcaggtgctggtggtggacggcagcaaggtgacgtcggaagaagaggtggcggttcttcgcagagaggcacaaatgggtgtgactgtgatttttgcaaccctgccgcagagctctgtgataagggagtaccgggatttaagagagcttctcggaatccgcgcggtgattgcggatgagataccgcttgcgggcatgcatctgttttccggctttctgctcggcggggaagagatctatgaggtcacggaactcggggaggaggagcgtcaggacatgaacccttctgttccctggtatacgaccggcgcgggaaccaagacctatatggtcggcacgctgtccgatgagacgatcgaacagacggtggataacgaaatacgggcacagtatgcgggaatggaggaagaggcggcaaaaaacagccttctgcctgccattctctggagaaacagcgtggatacggcaaagattttctgtgtgaacggggattatcttgcagacataagcgctgttggaatactggacgccatgatgggggagacatacgattacgatatctacccggtaattaacgcacagaatcttgtgattgcagatctgccgacgttcgtctccgagaacgaggaggagatgcagaagtgctacagtcagtccgcacaggcagtgtatcaggaaattgtgtggccgtcgctgacctccattgcctcccggacgggggcaaagatgacctgcatgatgacgccgcagtttacgtatacggatgaggaagagccggatggagagaacgtcacctattacctgaaacgtctgaaggaggagcacgcggaggcgggactgtccgcagacagcatggaagggatcccgctctcagaaaaaataaagcaggatcagacgttctggcagacctatgcgccgtcctaccggtttttatccctctacgcggacggagtaaagagcatcggggagaagagtgcccttccagcggaaatccggacggttgcgctcggatccggcgccagcgggcaggcggtggggtatctcaatgagaacgtcacactgcagccgtcgacgagttccggaatccggcatacgtttctggatgattttaaagtgaaatgcatggagacggcgctcggctattccaacatcacactcgacctctatagcgtgacgtatccggaaggggacgaggattcctgggagaaaatgtccaagaagatcgcagcaaacctgggcacctactggaaagcgtatgaagcgtttgacgcaaccaccctgacagagagtgatgtgcgcatccgcagatttctggcacttgactataagcagcagcgcgcgggcaatgtgattacactttccttagagcaccgggaggatgcggcatggtttctgctgcgcctgcacggagagaaagtcacagaagttgcgggcggaagctttgaagagatagaagacggcgtctacctgattcttgccgaggaagatgaggtctccgtggaagtgcagaccggggaaacatggcagtatcaggacggtggaaagcgtggtgacggcacatgagaatatgtattgtggcagagggatgctatccctatgttgtcgggggtgtatcgagctggatacacagtatgataaaaatatttccggagtaccagtttgtcgtgctggcgattgtggcgaaccgttcgctgcgcggaaagtttgtctacgatctcccggagaatgtggtggaagtgcacgaactgtatctggaggatgcagactggcggccaaaagaacttaaaagagcagccagactgaagttaaatgagcgggagtacgccgcactgcggagcctgttgatgaaccagaatgtagactgggataccctgttctcctttttcggggagaaggaattctctttgaatgaacttctcatgggggaggattttttccgggcggtgcaggaatgttatacggtgcggtatgcgggggcggtgttttctgatttcctctggacgatgcgctccatgtatcttccgctgtttctgacacttggcatgcggctgccgagggcggatgtgtatcactgtgtggcgacgggatatgcgggcgtgctgggcagcatggcaaagcgcaggtttggctgcaggcttctgatctcggagcatggaatctacaccagggagcgcgaggaagaattgatccgtgcggactgggtgtcaggcatctataaaaatatctggattgagcagttcaagaaaatgtcgaagcttgcctatgacagggcggatctggtgacaagcctttacgcgcacgcgagagagcttcagatcgaactgggatgtcctgcggataagacgagcattaccccgaatgggattgatccggcgcggtttgacggtttgaagcgtccggaagcgatggagccggatatggtgcacatcggtgcggtactccgcgtgacgccgatcaaggatgtcaagaccatgatccgggcgtttgcgtatgcaaagcgcgatgtgcctaacttaaaattatggatcatggggccgacggaagaagacgaggaatacgcgagagaatgttttgatctggtggagctgatggaactgccggatgtggtgtttaccggaagggtgaatgtgacggaatatctcggcggactggattttaccattctgaccagtatcagcgaggggcagccgttaacggttctggagggctatgcggcgaagcttccggcgatagcaaccgatgtcggaaactgccgcggactgttgtacggcgaggacgatgattttggcgaggcgggaattctgacgcacatcatgaatgtgaaggaaattgcggatgccatggtgaatcttgccagacatccggtccgcagaaaacagatgggagaaaacggttaccgccgtgtgatggcaaagtacaagatttcggatatgcagcagacgtaccggaagatttatgaaacgtttgagaacatagactggtagaagggagagagactgtggcaggaataggaatcaagcttcagaaaatatatgagaaaaaaacgattcttgcatatctgaccggattcggctacagtgcggtcgtgacggttgcaccgatgtttgtcgtgatcggaacgatcatgctcatgagtcagctcctgggatatgagaatgtgggatatgcgagaagaggactgttttccggaacgctgctttacatctttatcttttcgcttctgacggcggcgccttttaatgcggtgttgtcccgctatatgtcggatgtcatctacgaggagcgctatgaggatattctgccctgctacgatgtggggctgcttttaaacattctgctggcaagtcttctcggaattccgttttgcgcatgggaacatcttgtgggacatgtcaatctgatttttgtgtttaccggattttgcggttatatcgcactggttctcgtgttctactcgatgctttacctttccatctgtaaggattatcagaagatatcgctgtactttttgaccgggatggcggcggcactcgcctgcgccctcttttttgtaaaagtatgcggcagggagattgtctacagtatgctgctttccctcacgatcggattttttcttacggcggtgttggaatatgccacggtgaagcgctattttaagaggaacagcaaccggtacagaagagttttttcgtattttggcaggtactggaagctggtggtgatcaattttttgtataccctcggtctgtatattcataattttgtgttctggaatacagatttacagatgcgcgtggcagatacgtttgtctttgccccgacgtatgatctggcaacctgtctggcgatgtttacgaatctgtcgtcgaccatcatttttatcacgcgggtagagatgcatttccacacacgttacaaggcgtattcggaagcggttatcggaggaagatgggaagatatcaaaaatacaaaagatagaatgttccggcagctttctgcggagcttatgaatctggtgcgcatacagtttatcatctcgacggcagtgtatctgctctgcgtggtggggcttccgcagtacgggttctcgggaagagtgatgcagatctatccttgtcttgccgccggatattttatattatttattctgtatgcagaaattatttttctgtactactttaacgatctgacaggggcgcttttggcaaccctcggcttttgcctggtgacgtgggcgggaagcatgctttctgccggcgggagtgatctttggtatggcatggggctggtggcgggcagctttaccggctttaccattgcctatttcagactcaggttcatggagcgccatatggatgaacatatcttctgcggcggacagctgtttacggtgaagagagagcggatgccggagagtatggtatatacaaagaaacagaaggagcgttagtatatgaatgtgattttaattctgcggatttttctgacggcagcgggagtgttgttccttttgggggacatcaatgcgtatgtgagacaaaaactgaccgatacgattggacttctgtgggcatttgtctcggtggcgctgattttaacgggcgtggtctccgtgccgggggcaagggaggaggaatacctggtggtgcttcttctggcagtctgcctgctgcttttgatcctgctgtttaagttaagcaaggtggtgtcggttctttccatgaaaaatcaggagcttgccatgcaggtttccctgctcaatcaggaaaatgagagaatattgcacaggctggggattttgacagatgaaaaaaaagatattgttcgtgattaatacattaagccgcgccggagcggagacggcactgttggaactgcttgcgcagcttgctgccgagaggggggaagacgggcagcccagatatgagctctcgctctttgtcctgatgaaccagggagaactggtgcagcagataccagagggggtgcggcttgtcaatccaaggtatgccccggtctcggtgctcgaaccaaagggaagaatctatatgggcatgaccgttgtaaaatgtctgcttcacagagccaacctgatccggctgtggcgctatcactggagggctgcgcgggcgatgcgcaaagagggacggctgatgccggacaaactgctgtggcgggcaatctcggatggcgccagacgcttcccggaggaatatgatcttgcggttgcattcctggagggtggttctgcatactatgtggcagaccacgtcagggcgaaaaaaaaggcggcgtatattcatatcgactatcagaaggcgggatacagcagggaactggaccgcgactgctacctgcaatatgatgccgtatttccgatcggggaacaggtaaaacgggcgtttctcgccgtgtatccggagtgcagtgcacgcaccaggatctatcacaatcggatcgactgtgaaaaaatccggaagatgtccgtgcagccgggaggatttacggatgatttcgacggaatccgcctgcttacagtgggaagactcaccccgcagaaggcatatccggttgcgatcgaagcgatgcggcagttaaaggcggagggatacccggtccggtggtatgtgctgggcgagggaagcagccgcagggaattagagcagtacattgcgtcgtgcggattaaaggaggatttcctgctgcttggagcggttgagaatccctatccgtactaccggcagacggatatctatgtgcatgcgaccggatatgaggggaaaagcattgcgatacaggaggcgcagacgcttggctgtgcaatcgttgcttccgaatgtaacagagagcagattacagacggggaggacgggattttgtgcgcgcttgacgctgcggcggtaaaggaagctgtgggcttcctgatccggaatccggaccggcgcagggcgtacgcgcaggcggcgttaaagcgtcctgtaaattacgagaacgaggaacggctgttggagcagctgctttccgagaaagaataaggaagatacgatggtagagaagaaacagaaagaactgctgattatcattccggcatacaatgaggagaaaaatatagagcgggtgctggaggagctggaacgcccggagatcgcggagattgcggatattctggtcatgaatgacgcgtcctcggactctacgaactgggtcgtaaaggcacacggacatacgctggtatcccatgtctttaatctggggtacgggagcgccctgcagcttggatataaatacgcgatccgccgcaaatattcctatgtgatccagatggatgcggacggacagcatgatgtgtgcaacataccggtgatctatcagagactaaaacagcaggatgcggacggacgctgcccggatatcgtgctctgttcgcgttttatggagggaagtgcagagtatccggtctccgctacgaagaaactggcatacggattcttccgctggatgataaagatcagtaccggacgaaagattgccgatccgacgaccggtctgcagggacttaaccgcagggcatttttatattactcgaagtataagcactttgacgacaagtatccggatgccaatatgatcattcagatgcagctgctcggattccgcatagatgagatccctgctgtcatgcatgcgagaagctgtggcaccagcatgcactccggactcaaaccggtggtctatatgttccgcatggtcttctccatcatcggcgtggtatttcggatcaaggtgcttggaattgatgcgggggcaggagagcgggatgttttcatggacaaaaaggagtaagcgttcttttcacgcagaaaatttaaaaagacagcagaagccctatattgctccggggcgtgggtggtatcatatctacacgttccggctggggagaccggaggaagtatccttagactggctgccggattatcccggggagacacttgctctggtccggctggacatccgcgattacgcctcgcgtgaactggacactcttgcactggactttgcggagcagatttttcgtgcctttcaagagcggaaaaaagagatgatcctgcgcgtctgttacgatacggagggaaaggggatggagcgcgagccgcagcgcatttttgtggtgcagagacacatgcaggcgctcggtagtcttgcggaacggtatgcggatgccattctgaccgtgcagggcgtgtttgtgggaagctggggagagatgcatacctcccggtttctgcgcccggatcagatctgcctgttggcgcagacctggcaggaggcgacgcaccatgcgctgacactctcggtgcgaaagccggtgcatctgcgcatgctggcgggaaataggccggtgcgcggactgggactatacgatgatgccatgtttgccggagccgaccatatggggacgttcggggatgtgccgcgggaggcggcagactgggaagaaccgtggtgtgcggcagatgagcaggcttatctgagcggacaggatgaaaatattctgtgcggaggggaggcgctggcgggaataaagttgtctgcagagacggtcttagaggaacttcaaaagatgcaggtgacctatttaaacagcatctatgacccggcgcggatggcagagtggaaggcatgccgtctcccgtccggaaaatcgctgtatgaggagatcggcagccgcctcggttaccggatctgcgtgctttgtgcagagtggaaaaagggaagcctttgggtgacactgaaaaatgaaggattttccgccgtatgccagaaaacagatctgcttctgatccgggagtgtgatgaaggcaaagagcagaaggtgcagaaggttccttatgagatctgcggattaaagggcggtcagacggacgtggcaaaggttgaaattgtggcgggagaagacgacggggaaggaaaagaggagaaactctacctttccatggtgcggaagaaagacggaaaaccgctgccgtttgcgaatgaaggcgcgggaagccggctcttgatcggcagatggatggtgcagggaggattgcatggaagagaaaaaggaaacacagattgattttgtgattgcctgggttgacggcggggatccggcatggcagagagagcgggatcgatatgggaagatgggggagaaaacagcggtagaagagaccggagagagagagaagtccggcgttgcctgcgataccagggatgtgcgctaccgtgattgggactgcctgcggttctggttccgcagtgtggaacagaatgccccgtgggtgcacaagatctattttgtcacatggggacatgtgccgaagtggctgaatgggaatcatccgaagcttgagattgtgcgccacgaggattatattccgggagaatttctgccgacgtttaattcccacacaatcgagctcaattttcaccgcatccccggattgtcggaacagtttgtctattttaacgacgatatgtttctgttgcggcaggtaagccccggacagttttttcgggacggaaagccgcttgacatgcttgccttacagccggtcgtggcaaaccgggaggatgccgtcatgccgtatatctatctgaacaatgcgatggtgcttgcaaggtattttgacaagcgggaaaacatgaagcagcagccgggagcctactggcatccggggtatccgctcttatatttcgggtataacctgctcgagcgcatgttcccgcggtttaccggattttatacggtgcacggtccgtcgccgcttctaaagagcacctacgaggcgctctggcagcgtgagggagaacttttgtcggaggtgtgcagccacagattccgcagcagggaggatgtgagccagtatctgctcagagaatggcagaagctggagggtaatttttatcctgtcaatgccggtcggttctgcaggtattatgatctctcggatcagaatacatcgctgcttcatgcgattgagaagaaaaaaagcccggctgtctgcatcaatgattcccagaaggtggaggcgtatgacagggtcaagagggaattaaacgaagcatttttaaaagcttttccgaaaaagagttcctttgaaacggacggagcaggggaaaagcactaagacagagaggagacgccatggaaacaaagagcagaacagaatattcggcaatgaatacaaccgtggcggtcatctccagaatgacggcgattctgatgggatttgtgacgcgtgtgatttttacgcatacgctgagtgaaaactatgtcggaatcaacggtctgttcaccgatattttaaacgtgctttcgttgaccgagcttggcgcaggcacggcaatcacttacgccttgtaccggccgatcgcggagggcaacatcaagaagcagcagcagctgatgaagctttaccagacattttaccgtggaaccgcggtgtgtgtgggcgtgctgggactggcgctgattccgtttatggacgtgctcatgaaaaacagacccgaggtggagcatctgacgtttatttaccttctctatctcgccaactctgtgctgtcgtatctgctggtgtaccagaggacgctgattgaggcgcatcagatgaattatgtggtgctcatctatcagaccggctttttggtgctgcaggatctgctgcagattgttgtgctggttactacgggaaactttattctgtttttgttgatgtatctgatgtgcacggttctgtcaaatgtgtgtatctcgcgaaaggcggaaaagcttttcccgtatttaaaggaaaaagagaaggaacgtcttcccgcagaggagcggaagggactgtttcggaatatccgtgccatgatgatgcacaagcttgggacggtcgttgtaaataataccgataatttactgatctccgcgtttgtcggcgtggtcagtgtcggaatatattccaattattatcttctgatcggttccgtccgccaggtgttggaccaggtctttgcgggaattacagcgagtgtgggcaatctgggagcaacggaggaccagggcaaaatccgcgagatttttgagacggccttttttatcgggcagtggctttacgggtttgcggcgatctgcctgtacgaattgctcaatccgtttgtggagctggcttttggcagacagtatctgtttgaacgctccgttgtcatgatcttatgcatcaactttttcatcaacggaaccaggaaagcggtgctgacctttcgggattccatgggattgttctggttcgaccgctacaaggcgctggcggaggcggcgctcaatctggtgctgtcgattcttctggtaagacagtatcagacgctcggcgtatttatcggaacgtttttgtcaacgattctcacgtcggtgtgggtggagccgtttgtcctgtaccggagaagattgcacctgccggtgcaccggttttatctgcgctaccttttgtacgcggtctgtgtgggagcggtatggattgtgacagacctggtctgcggactggcagagggaagtccgcttaccgttcttctcatccggctgccgctctgcgtggtgctgcccaatctgttgttttttatggcatacggcaggacgaaagaatggaaacgggtgttggagcgcctgcggcgcatcgagtggggcaggctgcatcggggaggaatgtgatgagacagcggatggaagaagaacaatgggatttgtgcaggctgctggatgcggcgctgcacggcagaccggcggaaatgctcccgccggctgaaaaatacggagccattcttgaactggcagaccggcatcgcgtgctgccgctgctgtacgacgtgctggcacccaagctgcccgaggaggatgagaaccggaagcgccttgagaagagaagcgcagagacggtgcggcagagctaccgcctgctgttcctcgggaaatatgtgacaggacttttgcgggaacatggaatcgagacggttcttttaaaggggagcggcacggcgggactctatccggtgccggaacttcgcaagtccggggatattgatctgctcgttgcggatcagaaagcgggagaaaaggcgtatgaggtgctgcatgagcatggattccggaaagcctcagagcagcacgcgcaccatcatatcgtctgcgttggcacagagcagatcggaatagaaattcacgttgcgctggcagagccgttcgactccaaaagcgtcaacgagtggctcgccgcacatcaggcggaatttctggcgcactgtgagaggacggcggtgatgggggtggagtttccggtgctgcagccggcatatcatgcgttttacctgctgcttcatatgctgcagcatttcctgcgtgccggattcgggttaaagctgctctgcgactgggtcgtattctgggaaaagggatacggcagcggggtagaggagcgttttttctccatggcagaggaatgccgcgtgatgggatttgcgcggctggtgacggcggtctgtgtaaaatatctgggactttctggggaaaaagtgcccctgctgctttgccgatttgactgggaggcggaagctgcaaatctggaagcattcctgacagagattctggaagcggaggagttcggcaagtcaagtgccgaccgtatggtggcgctgcggggaaccggctggcgggattattgcagggaatttcatcatcagatgctgctcacctatccaggggcagggcgctaccgcattctgcatccggtgttgtgggtgatgatgttctgcggttttgcataccgcaacgttaagatgcgccgggtatcggggtacgcggtgttaaagaaggcgagagcgcgcggaaagcttgtggaggagatgaagctgttccgctagaaaaaaggatgttcgacgggaaaggaggagagcaaaatggatacatggtactgggcactggaatatgtcagggtattttttgcctatgtgatgattctgtttgtgtggccgtctgtggtattccgggattatttaagaggcaggagccgcacggtgcggtttgctttctgtgtgacggttccggttgtgctgctcaatacggtggtactaagtctgggcgtgtttcatatactgtacggatggctgattgccgtgctgttttacggcacattgctgcttggcttgctgagatggcaccctgtgcggcgggagcagatcaaaaagatctcccgcctgtttctgggaacctacggcatccggcttttgctgcttcgcctgcgcaacagggtaaaaaacgggatcgggcgtgcacatgcacaattcaggcagagcatacggggacggcgctgcgtctatctgatgctgggtgtggttgtgtgctttggcatggtgtatttttcctacggggcattccatgattactcctacgggtttggcgatatgtaccgccaccactcgtggatctacgggctgttaaacggtacgcctttttatgagggaatctacccggaagccatgcactgctttatctacgccatgcgcgtgctgttcggggtaaagatttacagcagccagctgttcctggcgggaatccacgtcgcggtttttctggtcagcgcgtatctgctgctgaaggaattatttgcatgggatggaaccgcggtgcttgcactggcgttgttcctgaccgtggatcttttgtgcattgacgagatcttttccatgtcacgtctgcagtggacgctgccgcaggagttcggactgtatacacaattcctgtgcgcactgtttctgcttcgctgccttaagacggactttagcgacagatccggcagccggagagagcggatcagaaagtttttgacggatgagaatctgctgctgtttctgctgtcactggcggcttcccttgccattcatttttatgtcacgatgatggcgtttttcctctgcgtggtgattgccgcgtgcaggcttcccgctctttttcaaaagagaaggtttgtatctctcgtaaaggcggtctgcctcggtgtgctgatagcggtgctgccgatgggaattgcgtatgcgaagggtgtaccgttccagggatcgatcggatgggcggtcaatgtcataaacggtacggataccgcggaggggcgtaccagccaggcggaacagatcttagaacagacgcagacatcgagtgagcagacatcgaaggagcagacatcgtccggtgagaggatgacagagagcggggagacgacagaaacggcggtgcagccgacggaacaatcccacggggggaacgggcagataccagatggcgggattgcggatgcgggacaaaatagcgctccgaaacaatccgccggtaatcatatgcttgcgatggcagaacggatggcggcatcgttcgccggcaaggcacaactggtctggaaatacgggtatgtgcagctgtaccgtgaaaaccgggcggaatggattgtgttttttagcggtctggcactgatcctctgggcggtgtaccggatggcggcggggattatcgccggcctgctaaaaaagggaagagacagcaaaaagatccagcagctgtttgacggatatccggtgctggtcggaatatcggtattgcttatgattgtctatgcggcgccgttcctcgggctgccggagcttattgcaggctccaggctatgctctacggaacagcttttcattctggcggtcgtggtcattccggtggatctggctgccggggcaatcgcccttacgcccggcagacgtgtgctgccgcttgcgcttgccgcgggagtggcggtgatctatgtggggacgagacagcttggcatttttcacggatacctctactatgaactgaccagatacaatgcggcggtgatggtgacacaggacatcacggataaattcccggagaacagctatacgattgtgtctaccacggatgaactttaccaggtgatcgaacagggacggcatgaggagcttttgactttcctgaaccgggtgaacggaagcggctataccctgccgacggaatacatttttgtgtatgtggagaagcggccgattcaatacgcacagagccatttctttatcggaccggactggctggcagaggaaaaatacacttcttactatacgacctatttcagcgaggggaacagcatcaatgcctcggagatctcgcgggagcaggcagagaaggagatgatgacgttctcaaaactctcgcagacctattccaatctggacagccgcacgatactggaatccaaagcgtacgaatggtgcaggaagtttgaagcatcctatccgcaggagatgaaggtatattatgaagatgagaatttctgctgctatatcatacggcagaacacctatcggttatatcagctggagggatcatgagtggacgttggaaaaggattttggcgcttggcgcagcggttgttttgtgtcttatagcagcagctcaaatgggcagtctgtttcactggaaggtgacatgtacgccggcggcgtttgcagagtcatccaggaggctttccaatccggaccgcggattttattacatttacggctaccgcattacggatgaaccagtcgactatgccacagatttaagagacaggacgagggaagatgacgcgacgcggcttggaatgatgcagatcaatctgcgggaataccggacgggtgccatatcggaggaggggctgtcaaatgtccggcagttgtttgcagccatggcggacagcgacaagaaatggatcgtccgtttcctctatgactggaacggggagaacgagcagtatgaaccggagaatcttgacattatattgcagcatatggagcaggtgggagatgtgctccgggagtatcacagctgtatctatacgcttcagggactctttatcggcaactggggggagatgaacggaacaaaatacacggacccggattctatgagagaactggcggcacgccttgccgatgtgagcgatgcgtccacgtttctctccgtgcggacgccggcgcagtggagaaaaatcacgggggaggcggcaccggacggctggacagagaacccgctagccaaaaggcttggactttttaatgacggcatgctgggaagcgtgagcgattacggaacttacagcgataacaccagacaggacgccggggatttttcggcgtggacgcgggaggaagaactggcatttcaggatgtattgtgcagcagtgtgccgtccggcggggaagtgattgtcgataacccgtacaatgatcttgaaaatgcgatcgcggatttaaaaaccatgcatgtgagttacttaaacgaggactatgacaggaatgtcctggataagtgggcagggacggtcgtgaatacagatgactgctacgacggaatggacggctggtcttatgtggaacggcatctggggtaccgcctgtggattgccggtgccgctttgagccattcgttctgggcggatacggtggaggtaaatgctgctttaaaaaacagcgggtttgcaccgttttaccggcagacaaaagtctgtgtgagcgttacagatgaggcgggggtagtctgctatacggatgaatgggaagaggaactacttaagctttccggcggaaatgaggacgacagggaactggcgctcaccggaaccattccgatccgcggctgggagagcgggacttaccgggtatatatcaatcttagcgatgcagacagcggggaacaggttttacttgcaaacgaagcggatgccacagaaaacggatactgcctcggtgaggtggcagtgcgataggtgcacaacgatgcaagtataaaggcttacaagtgcaaaatcgtacaagaaatcacaagtttgtacgaggaatcacgccgcagaaaccactataatgaaaagaaaaagaatcctgtatgtggtgggattgtggaaggtggtttcttatgcagaactatgaaaaaccggaagtgattttgatgacggaatgttcggagggcgtctatctggcaagcggcggacagaccggggaagatccgacggcaggtggatgtgacagccggtacatgaagggagcctggaaaaagccggattacagcaacagcaatgtgcagatgcgtgcctatgacagaaaaggctgcgagggctgtgcggcggatgacggtgacggctgcaagctgcaaaagggtgatgcaaaagtcgccggaaatgtctatcagcctgtctgggaacagcagggactgaccccggataccatggtctggtagagaaaatgccggcatgccgttctggcagaaaattcatgcttgacagcgcaaacacagaattttatacttaaaatatgtgtatgagtcagcggcagaagtgccgcaaaaagtgttagaaggtggctggttttatgaagaattatgagcgtccggtgatgatacggacggaggagcttgcagagggggtttatcttgcgagcggaggcatcaagtgtgacagtgtctacatgaacggtgtgtggcaggcgccggattattccgactggaatggcaccacacgcggatacaagcagcagttcggatgtcttggatgcccggcgaatactgcttccggctgcggtctgttgagccattatgtggattccgggtatgcgggaagttacgatgtggataatggtaaccgtaagccgtcatgggagaagaagggctatggtccggatgatgcggtcacagactggaacatgtaacaatctttaaaacggggggaaatgctatgacgaattatgagagtcctgtgattcttagaacagaagagcttgcggaaggggtctatcttgcaagcggatgctatacggcgagcgcgtacattcatcagacaccgcagtccggaagcggggagtaccgtatccaggtgaacggtcagcacagtgccgatcatacgaaagaggcgcagacattgaccatttcgttcagtcttccggtaacctacaccagttccggcggatcactggtatccggtagcggaacgaatacacttgtgatcaattataactatcatcagaatccgaccgacaatatcggactcggggatctggtcgtgcaggcagatgcggggcttgcggtgacaagcgtgaacattacagattaagaagccggcaggcgaccgggcggatgtgagaagtcaaaagcttcgcgggaggaatcggttcctcctgtgaagctcttttttatgtaataggaaacttctttcctattacataaaaaactctccagggatcgcactgcggcggagacgaaagatgtcgcaagagcgacccgccgcaggcggagaatcctgcagacagaattcatttttatgaaagaataggaaaattacaatgcttgagaagttcagacattacagagagcggatcaaagagggaatgctccgtgatatgtggagacagacgctatggatctacgaatatgcgagactttattggaagcagatgatattttatacgcttctgggacttgcgggaacgctggtatcgctcatttcaagtctcatttcccgcgatatggtggatattatcacaggacagcaggcggggcttctggcgcgcaccttctgcctctatatcgggttctcggttggaaatgtcctgatttcccagatctccaattactttgcgaacaagatcagcatcagcgtggacaatgccatcaaggcggatatttttgaaaaaatgctgttgacggatctggagtcaatccagaactaccacacgggagatcttttaacgcgctggagttcggatgcctccaatatttcaagcggtgttctaaactggattccgaatctcgtgatctatacggtgcgttttgtcagcacctttgcggtcgtgttctaccatgatccgatgttcgcgttattagcgctgatcggaatgccggtcagcatgctgatgtcgaagacgctgcttcgccgcatgaaggggaataatgagcggagtgcggcgatgagcgcaaagatgtcgggctttaatcaggaggcgttttccaatatccagacgatcaaggcatttgatctgatccggctgtacgcggagcgcctgcgcggtctgcagcgggagtatctcaccatgaagctggagtttcagaaaatgtccatggcgacctcaattctgctgtcgatcgtgggacttgtggtgtcctacagctgctacgggtttggaatctaccgtgtgtggagcggtgcgatctcctacggtaccatgaccatgtttttatcgctgtcgggctctctcacgggcaccttaaaccagctggtgtctctggtgcccacggcagtgtctttaaccacatcggcgggaagactgatggacattctcgatatgccaaaggaagatttttcggatgctgatcaggtggagcagttcgccggacagaatcagtcggatggcatcggaatcgtcttttccggggtgagttacgcctatcataatggaaagcaggtgttttgcggtgcagactttttggcgcgtcccaaggagattgtcgctctcgtgggaccttccggggaggggaagacgacaatgctccgcctgatgctggggcttttgcatccgcaggagggagagcggatcctgatcggggagacggacggggagaagatcgccgtagatccctctgcaagacggctgttttcctatgtgccgcaggggaataccatgttttcgggaacaatcgcggaaaatatgagaaatgtaagaccggaagcctcggatgaggaaatctgtgaagtgttaaaggcggcatgtgcctgggagtttgtggaaaaacttcccgatgggatctattccatggttggagagcgtggaggcggattctcggagggacaggcgcagcgtctgtcgattgccagagcactgcttcgccgatcaccgattcttctgctggatgaggcgacctcggcgttagacgtcgcaacagagcgcagagtgctgcggaatatcatgagtaccacggagccacgcacctgtatcgtcacaacacaccgcccgacggtattgtccatctgtcagaaggtgtaccgcatccgggagcagaagtgtgtgcagatgcaggaggaagagatccgtcagatgatgcgggaattctaaagagcatcgatgacggcttttaaggtcctggcagcggaaggctctttcgtgcagtacagccggcaggaaaagatgagcggagcgagggcttcggaaaaatgcagattgcgaaggagaagctcctttgtccacgcgggggagatcatccgctgcaggatgtggagcactttttcgtccggctgcagggactgcacctgatctatggcagcctgctttaagaagatgatgccgccgagaggatagtctttcggggtgcagatgcccgatgtgccgcaccatggaagtccataggcgtagggtatgttgtctctgattccgagcaggtttaagtcgccgtttaagaggggcgtctggtacagatcatgccacagggcagagtgtgtggacttcccggttccggaactgccggaaacgagaaaggcgcgcccgcggtacaaaaaagaggcggagtgcagcacataaagctccttctgctgagccaggatgagaaaagcgaagcgaagtgcgtgaaacaggtcttcgatgtgcatatcatccggatccggcatgcggtaaaggacggcgcgcgagccgtctttttttacatgcatttcgcggatgccccacggcgctgcaaaaaagaaacaatacgaacttccgctgtcgcagatggtaagttcctccgtgtgaataagcacggcgccgtaaggaatggaagccggtttcccggtcagaataagaacctcctggtcgaagtcttcctcttcgcaggaaaaagcggagaagaagcggtcgtataggagagagggaccgcggtaggaaaagaccagaggaccgatgcggtagaaaagaggaggcgtatcatcgccccggctttcgggtgtatccgcaagaagaattcccatacggcacagggaatgaagatactggtcgacatcttccgcaagtgccgcgcgctcgcgctctgtggtatggtaacggtctgcgagaagggcgagcagttcctcgcggctatcgccctctaagatgccgtcccacagaagtgccccggaatcgttgagccgggtggcaggagcgggagctgcgatgagctgtccgtaaggaagcagatagggaatacctgcgagcgttgacttgatgtatcgatcgttgagtttcataccggtgtcactcctttattagcggttcataagtatgcttattatagcattcagaggtaaaaaatgctacaatgaatgaagagaaacgggaggggaagaatggagcagatctatgagattgagccgctccttaaggcgggagtatgcatacagattcatccacaggggtacagcatgtatccgtttatagatccgcggagggacgaggtggtacttgccggcatagaggatgggagcgcgctgcggcgcggggacgttgtgctttatcgcagggaaaacggaatgctggtactgcaccggatttataagatcgggcaggacggactgtatctgctgggggatcaccagacagccatcgagggacccgtgcggcgggagcaggtcaaggggaaaatgaccggtatggtaagagacggacgctatatggatgtggggaatccgggataccggatgttaagtgtggtgtggctatggctcagaccggcgcgcagagctattatggtgcctgccgcgcggctgcggcgcatggtaagattcgcacttttcagaagaaacaataagcgctataataaatagagggatcaaaaagcctgggggtgattacatgatgaagattttatttgcagcttcggaagcagtgccgtttatgaaaacgggtggtctggcggatgtgaccggatcgctgccggggtatttcgataagaagcattttgatgtgcgcattatcatgccaaagtatttatgcatggatgaaaagtggaaggcacagctgcggtttgtctgccatttctatgtgaatctcagctggcggagacagtacgtcggtatctttgaaacggtacagaacggcattacatactattttgtggacaatgaattctactttgcgggagataagccgtatcacaatatctatgaggacgtggagaagttcgcattcttctcgaaagcggtgttagaggcgctgccgtatctggatttctggccggatgtcattcactgccatgactggcagacgggactggtaccggtattcttgcggacattttacggggatcagagatgttattccaatatccgcacggtcttttccgttcacaatctgaagtttcagggaaggttctcactgccggcggttatagatattaccggtctgccagagcagatcttttcttcggataagctggagtcctacggggaggccaactacctgaagggcggtgtggtgtatgccgatgcggtcacgacggtgagccccacatatgcgagagagatcatgacgccggagggcggagagggattggacggtctgatgcgcgcccgggaaggcagcctgtatggaatcttaaacggcattgatatcagggaatatgatccgcagacagatgcctatctggcgaaccattacaacgagaccaatcacacggaggggaagggactcaataagctaaagcttcagaagcttttgggactcccggtggataaggacgtatttttacttggaatggtgtcccggatgacggatcagaagggatttgacctgattgcctatgtgatggatgaactgatgagcaccgagcgtctgcagcttgtggtggcgggtaccggtgaggcgcgctacgaggagatgctgcgctattttgcggaaaaatatccgcagaagattcacgtgacgatcggctactcggaggagcttgcacaccgcatctacggctcctgcgatgcgtttttaatgccgtcgctgtttgagccgtgtggtctgtcgcagctgatgagtcttcgctatggaaccgtgccgatcgtgcgcgagacgggcgggctgaaagatacggtgatgccgtacaatgaatacgaacagaccggcacaggattctcctttgccaattataatgcgcatgaaatgctgggcgtcctccgctatgcgatgcgcgtgtattacacgcagagaaaatgctggaacggcattgcggagcgtgcgatgcgggaggatttctcctggaaaaagtcagcggagacgtatgcgcggctgtatgaggatatcgtgggcagaccataggatcacatagtgatctggtccgtctcgagggagtagtagtagacgtgatccgacaaaatctcttctctggccagctgggacgaattgacgtcccggaccatggaggagagcgtggacatactgatctggttgtctgcgggaatcagaagaacttcgtggacgctgctcggcagaatataaaaatcactgccgatgcgccgggcaaaatcgtgcagcagatgctgatagagaatacaggaggagccgttgagcctgtgctggttggacagaacgtagatcggaaaaggctcaatgagatcgcttcccgctggatccgcaaattcatccgcaaacagctcgcgcagaacttcggtcatgctgcgcagatcatagcggagcagctgcggtgtgtttgccatggcgagggcgtagaggtcgtctctggtaatcccccagtaagtgagatgttcattgtggatcaggaccgttgctgtgccggaagaatcagattccaccaggcataagaagacgatggcgagatccaaaaagcgatagtagggaacccgctttaacagttcgcggttgcgctcatagttgatcagcttcattgtgacgcgggattttaccttgtcatagtcggtgaaaaaagagatgtcaacaggggatttgggacggttctcccgataggcggtcagaatgtcgtctgtgatgtcggaaaacgatctgccgcgctcatactgtccatagtagtaatccagataaatggtgggagccaggttctgaccgggcgcgagaatggtgagtccgtcaagatgggtatcgttgtttttgagaatgtctgaaacagtaatgcggacatcggagccgaggcggtccgagagagtagagatgatctgctgcttgaaatcgtggtaattcataaaatcctccgaatgaatggaggggaagtaaaatcgtacagatggggaagaaaaatccacatgaatgcgtagctgcatttatgtggatttaatttatcatatagaaagtcaaaaagcaattggacaatattactaaaaatgtcggatgctattcggactttaatgttttccagagatagctgtaaagctctggggtatcgctgccgagctgtttgtagaccgtgcagttcgcaaagacatcgtcaggaggaaagatcgtggtatcattgcgggtgtcctcgtcaagcgcatcgacgacggcctgatttggcgtggcgtagcagacgcagtcaaaattgagcatggcgacgtcctcgcggcacagaaaatccagaaacttttcggcgttttccttgtgtgtgctgtcagccggaatgaaccaggaatcgatccagaggttggatccctccttcggaaccgtgtaggagagatcggcgttggactccatggcggtggctgcctcgccggagtagacgagcgctaacgccgcattccccgcgatcatctcatctgcggtctcatccacataataagcgtagacgaggggtttctgctccaccagaagcgagagcgcgtcacgcagatcggtctcgtcctccgtgttgatgtcgcggcccagaagacggagcgccgggacaaaggaatcccggacggagttctgcatgataatggtatcgcggtagcggtcgtcccacaggatgttccagctctcggtctccttctcgctcaccatggtcgtgttgtacaggattcccagcgtgccgtaaaagtacggcatggaatactggttctgcgggtcgaagacctcggcggcagcaagaatagcgggattaagattcttatagtaggagaaggaggaaaaatcaatcggcgccacttttccctcgtggatcagccgctccaccatataatccgaggtgcacacgacatcgtaactgatggaaccggcagaaaacttcgtgtacatctcctcgggactctcgtattcctcgagcttgatcttgatgccggtttcctgctcaaacattttgatggcggaggcatccagatatttgccgtagtttaacacgacgagggaattgtcgccggagctgccggcggtatcggtatccgcgctgccgcacgccgagagaagcagggcggcaaacgcggcggtaatcagtgcataatggaatcgtttcataagtaagtggcacctcctttaatggataccggcatgattcccggcgattctgtccgaacggcggttcatgacaagaagcagaagaaatgcaaacaaaaacaaaatggttgacagggcgtacaattccgggcgcacccccttgcgcagctccgtgtagagcatcgtcgacagggtgttgacaccggcacctttggtaaaaaaggtgatggaaaaatcgtcgagcgacatggtaaccgccatcaggaatccggaaaatacaccggatttgatctccggccaggtcaccttgtagaacgcgtacatcggagtggcaccgagcatgatggtgcggttctttttttcatggcactgatgccgatcgcggcaagcgttccgatggcggtcgagacgatggctgcggtgagtgtgacctgtagagttgtcacaaacgcattcatgatggtctcgtccgtaaaacaggaagcgtaccatttgagtgtaaaaccgccccatacgacacgtgattttgaattgttaaaagagagcacgatgagtacgaggatcggcagatacaaaaataaaaagatgacggcaagatagatgcgctgtccccatttctttaccataccgcggtacctccttcgtctttatccagcacattcataagtgccatacttgcaatgacaaacagcatcagcacaacggacagtccggaacccagatgccagttggtgccctgcataaattcctgctcaatgacgtttccgattaagagcaccttgcccccaccgagcaggtcggagatgacgaacgaggtcagtgccggcacaaagaccatgacgattccgcttaacacgccggagagggtgagcggaaaaatgatttttacgagaacggtcagattgttcgcgccgagatccctggcggcttcgatgacgtccttgttgatccgcaccatggagttgtagatcggcaggatcataaaaggaagaaaatcgtacaccatgccgaacacaacggcggtcggggtgttgagcatcttcacatggccggtgccgacggcttctaaaatggcattgacaataccgttgttggagagcagaagtctccacgcgagaatgcgcagcataaaattcatccacatcgggaggatgaacaaaaagacgacaaagctctggtgacggaagcggaatgtgcttaaaatcatgcagaacggataggacaaaacaaggcagaacagcgtgcacagaaagccgagctttaaagagagaagaatcgacttgacatgcaccggatcggcgatggcggcgatattggaaaaggtaaagctgccgtccgccgcagtgatggcataatagagaataaatataagcggcagaagaataaatccgatcatccagatcagataaggtcctgccagaagctgttttttgaagttagacatcgatttctgctgcctcctcgtcctcggattccggtttgttcataatctggatgttgaatggaatcacgcggatcccgacatgggttccgacggtgtaaaactgcgtggtgtccaccagccactcaaagccgcccgccatgatctcgatctcgtagtggacgcccttgaagatgacggaagtgatatcgccgtccataaagccttccccgggtgcgacgatctccacatcctccggacggatgacgacgtcgaccggcgtgttggtgccgaatccttcatccgcacagggaatcctggtgccgagaatctcaacgacccggtctttcatcatgataccgttgatgatattgctgtccccgataaaatcggctacgaacgcgttgaccggctcattgtagatcatttccggtgtgccgatctgctggatgtagccctggttcatgacgacgatggtgtcggacatggtgagggcttcctcctggtcgtgcgtaacgaagacaaaggtgatgccgagctcgtttttcaggcggatcagctcatactgcatttcctggcggagctttaagtccagtgcgccgagcggctcgtcgaggagaagaaccttcggctcattgacgatggcgcgggcgatggcaattctctgctgctggccgccgctcaaagaatcgatggagcggtgctcgaatccgtccaggtttacgagctttaaggcgtatttgattttgtcgtcgatgtatgccttgctttttttctgatcttaagtccgaaagcgatattttccgcgatggacatatgcggaaaaagggcgtatttctggaatacagtgctgagatcgcgctcgttgggcgggagggcggtaatatcctttccgtcaaacagaacctggcctttgtcaggggtctcaaatccgccgataatgcgcagggttgttgtcttgccgcaaccggacggaccgagcagtgtgatgaattcattctcacggatgtagaggttcaaatcgtccagaatgacattgtcaccgtaggatttggcaatgtgcataagattgatcagttttttgctcattcgggggagtcctttcttaatatatgcagaatgctcccgcatgtctgcgggagatcgatgatatgctgattttgcagtattttcatagcataagaaagattttattttaataattgaaaaaaagtagttgcaattttttgaaattccgttataataactcaatgtgatgttaaacatgacctgccgatatggctcagttggtagagcaacgcattcgtaatgcgtaggtcgtcggttcgagtccgactatcggctttaaataaaaactctcagtaattgtgctgggagatttttatttatatgctagttataacacatgcttatcaatgtttattagagcgggttatgactgagtgcaaaaggaggaaaatattatgaagaaaaaagtgattagcttactgctcactgcagcaatggcaaccaccatgttcgcaggctgtggttcttccagcgaggagaatacaactgcagacaacaatcagacagcagcaccggcagcgacagaggctgcagcagaggatagcacagaggcagctgctcctgcagtatccgctgatggaaagatcgcaatgattaccgattccggtgacatcacagacgagtctttcaaccagatcacatgggagacctgtgtggcttacggtgataagaacggtattgagtatcagtactataagccggctgaggacacagacgaggagagaatcaacgcaatcgaccttgcagttgcagacggtgcaaccgtaatcgttatgccgggttatctgttcggaccggcaatcgctgaggagcaggatctttatccggatgtttcctttatcgcagttgatgtgacagaggctgacatcgtagatctttccggcaacgcagtcggaatcagcgacaacgtatatatctgttctttccaggaggagcaggcaggttaccttgcaggttatgcggcagttaaggatggttacacaagccttggattcctcggtggaatcgcagttccggcagttatccgttatggttacggttatattcagggtatcaacgatgcagcagaagagatgggcgttgatgtagatgtgaaatactactatggcggtcagttctacggaagtgatgcgatcacagctcgtatggagggctggtatcaggatggcacacaggttgtattcgcatgcggcggcggtatctacacatctgctgttgaggctgcagagcagtacgacggcaaggtaatcggtgtcgatgttgaccagcgtccgaagatcggtgatctgtgcattacctctgctatgaagggcttaggctctgcagtgaactctgcactggatgcatactttggcggcaactgggcttccatcggtggcaagtctgagcagctcggtctggcacagggcgattatcttggtcttccgacggatacagattcctggggctttacaacatttacggtagatgagtacaatacagtattagacggactcaaggacggcagcatcactgtttctaacgatacagagaatcagccggaggtaggttctcacgtgaccgttgactatgtagagtaagcggactctttaaaggggaagagaaatagtttctcttcctcttttttttatatccagaagatgttatactataagatatgcaggaatgactcatgcggcgcatgaaaaaaaagaacgaagaggatacatgtatatggaaaacgaatatgttattgagatgttgaacatcacgaaagaatttccaggaatcaaagccaacgataatattaccctgcagttgagaaagggagagattcatgcactgcttggagagaacggtgcaggaaagtctaccctcatgagtattctgtttggtctgtaccagccgacgtccggtacgatcaaaaagaacgggcaggttgtacagatcaatacgccgaacgacgcgaatgatctgaacatcggaatggttcatcagcacttcaaactggtggagtgtttttccgtgctggataatattatccttggtgttgagccatcgaaaggattgttccttgaaaaagatggtgccagaaaaaaggtactggagctgagtgagaggtacgggcttaaggtggagccggatgcgctgatttcggatatcaccgtaggtatgcagcagcgtgttgagattcttaagatgctctaccgtgataacgaggtgctgatctttgatgagccgacggcagtgctgacgccgcaggagatcgaggaactgatgaagatcatgaagaatctcgcgcacgagggcaaatccattctgttcatcacgcataagctgaatgagatcatggaggtggcggaccgctgtacgatcttaagaaaaggaaagtacatcggaacggtcgacatcgcggatacgacgaaggaagaactttccaagatgatggtgggcagaaatgtaagctttaccgttgacaaggacgagaaaaagccgggggatacggtgcttgaggtatcgcatctgacggtggcaagcagatcgcatgagaacaatgccgtgcgggatgtctcgtttcaggtgcgccgtggtgagatcgtatgtattgcgggtatcgacggcaacggacagacagagttggtgcaggggctgaccggactggagaagatcggagggggcagcgtgaaatttctgggacaggatatcacaaacaccacgatccgggagcgttccaagcatggtatgagccatattccggaagaccggcataagcacggactggtactggactacacgttggagcagaatctcgtgctgcagcgctactggcagccgcagtttgaacgcgcgggctttatcaagtcgggcgaggtgcgcagatatgcgcagaagctgatcgagcagtatgatgtgcgaagcggtcagggacctgtgaccattgtgcggagtatgtccggcggtaaccagcagaaggcgatcattgcaagagagattgacaaagacccggagcttcttgtggcagtgcagccgaccagaggtcttgacgtaggcgcgatcgagtatatccataagcagcttgtggcacagcgcgacaaaggaaaagccgtgctgttagtctcgttggagctggatgaagttatggacgtatccgaccgtatcctggtgatgtacgagggtgagatcgtaggagaactggatccgaagaaagtgactgtggaggaacttggactttacatggcaggtgcaaagcgggatgaggttgcaaagaaagcataaaggcgaggccttacagattaacagaaaggaaatatgacaatgagtgaaaagacaaaggatgtcctattgtccatctttgcatcgcttctttgcattgtgatcggacttctcgtgggacttatcatactttattgtatcaatgcagagaatgcattggatggtttttcaagaattatcaagggtggcttttacctcaaaccaaagggaatcggaagtgagattgcgcaggcgacaccgctgatcatgacgggtctttccgttgcgtttgcttttaagacgggactgttcaacatcggtgcggcaggccagtataccttgggcgtgttcggtgcattgtattttgcactgattctgcagatgccgtggtatgtatgtcttctggcagcaatggtctgcggagccatctggggtgctgttccgggaattttcaaggcgtactttaatgtcaatgaggttatcacctccatcatgtttaactggatcggtttatatctggtgaacgagctgatgtacagcacggtatccggaatgtacgaccagaagacgacgcgtacttacaagctgagttccgcagcaccgcagtcattgattccagattgcggcatgagcgctgtttttaagacaagctcgaccacgattgctatttttatcgcgatggcgatcgcaattatcatgtatgtggtactcaacaagaccacattcggttatgagttaaaagcctgtggctttaataaagacgccgcaaaatatgcgggcatcaatgaaaaacgcaacattgtgctttccatgacaatctccggcgcacttgcaggtatcggtgcgggactttactatctgtccggtgcatccgagtggaatccgcaggtgtccacagcgcttccggcgatcggtttcaacggtatcccggtagcacttttggcgctgagcaatccgatcggcgtggtatttgcagcaatctttgtcgcacatatctccgtgggaggagcgtatcttccaaccaagtattatcagccggagattgcggatctgatcgtggcagtcatcatttacctgtgtgcgtttgttatgctctttaagagcgtggttgtatcgaagctcggcaggaaaaaagcgaagaaggaggatgtgaaataatgttcttactgattaagtttacattactctatgcggtagtattgatgctggtggcgcttggcggcatgttctcggagcgaagcggtgtaatcaacattgcacttgaaggtatcatggcaatcggcggtctggcgggcgttttcgtcctggcactctgcggggattcccttccgtccggcgtgctggtggcggtgtccatcctggcaagtgcggtagcgggaattctctattcccttctgctcggattttccgccatcacgttaaaggcggatcagacaatcggcggaacggctttaaatatgcttgccacagcggtggcgatcgtagcggtaaaagcgttcaacaactcctcggcagcgggaaacggtgcggcttccgcaaagctttcctacagcaacaaggcatttatctataaaatcggaccgctcacgatcaacattttcctgattatcggaattatcattctgattgtaagctatgtatttttgttcaagaccaaatggggcttacgtctgcgcgcgtgcggtgaacatccgcaggcagccgattcggtcggtatcaatgtgtatcagtggagatataccggtgtcatgatctcgggtgcactcggcggaatcggaggcttcgcctacatcgttccatccgttaccacctggaactttgaggtcggcgtagcgggagccggtttcctcgccctggcagttatgattttcggacagtggaagccgttcaacattgcgggcgcagccgtgttctttgcggtattccgttccctggcgaacatcgcggattccaccgtgcttgcaaacctcggattgtcaaagaatatctacagcatgatgccgtttatcgcatccatgattattcttgcgtttacatccaagaattcccaggcaccgaaagcggagggtattccgtatgataagggtgccagataggaagacggcgtaagagaccggaatttccggaagcgtccgggagcatatgataacaaacagaaaggattctaagatcatgatttcaagcaaatattttgaccatactattttaaaggcagaggcgacggagacacaggtggcaaagatctgtgatgaggcgcttgccaatgatttcgcatccgtgtgcgtgaaccagtattacacccgttttgtggcagagaagttaaaaggttctgacgtgaaggtgtgcacagtggtaggtttccctctgggaatgtctgacaccggtgtgaaggcattcgagacgaaggctgccatcgaggacggcgcacaggagatcgatatggtaatcaatgtcggcgcattgaaagacaagaagtatgactatgtaaaaaatgatattcataccttaaaagaagtctgtggcagcgatattgtcttaaaggtcatcatcgagacctgtcttctgacagacgaggaaaaggtgaaggcatgtgagctggcaaaagaagcaggagctgatttcgtaaagacttccaccggattttccaccggaggagcaaaggcggaagatgtcgcactgatgagaaaaaccgtgggtgatgatatgggtgtgaaagcatccggcggaattcacacggcagaggaagcacaggcaatgatcgatgccggagcaagccgccttggaacgagcgctacacttgctatcattgggaaatagtaatcaggagcggtaggatgaatacaattttgattggaattgcaggaggcaccggaagcggcaagacaacacttgccgacaaactgatcgacagctttggcgatgatgaggtgagtattctgcgtcatgataactactataaacgccatgacgacatgtgttatgaggaacggtcgaagttaaactatgatcatccggatgcgtttgatacagcactgttgtgtgaacatatctgtaagctgaaagcgggagagcagatttatatgccagtctatgactactcgatacataatcgttccgaggagaccattctggtaaaacctgcaccgatgattgtgctggagggcattctcatttttgctgagccgagtctctgtgatcttatggatatcaaggtatttgtggacacagatgcggatgtgcggattctgcggcggatcatccgtgatgtaaaggaacgcgggcgttcgttagacagcgtgattacccagtatctgacaacggtaaagccgatgcatgaacagtttgtagaaccgagcaagcgccgggcggatattatcatcccggaagggggagaaaatatcgtggcgcttgacatgctgattgaacgcgtacgcaaacatttaaagaataaataattagcgcaataaagtggcaggcactgtgtctgccatttttttgtatgcaggattgcttggatgcagatgatcgccgctgtcatatccttccgcgaaagaacgcggatcatcggcggcacgaagtgcctgatcgaaatcgatacagccgtcgctctcgtggttggagcggatccagtcattgacggcaccgcgcagctcctcgcggaacggtgcgtaggtgcgccagccgtaaatcggcagaagggttccgagatagacgctgtcgtgaagctttctggcctcctcgatataccatttcagaccgtcgatcagttcggcggcagtcggcagatcactcatgggacggaacggattgacgtcggttccgaccggatggatgatatcgttgatgccctgctggatgatgacggtatccgcaccggcggttgggatttcgtgggcaaaacggttggttcccttaagaccgtaggagtcgtaggtgatacagtcgtactggcgcagaatacgcgtaccgcttgccgcacggcggatcaccgaggtatggttgcgcccttcttcgatgaggcgcagcgtcagatagtccggccatgcctgtgcggtgatggaatctccgtagcagataatggtatgacaatcttcctttgtcagaatatcgatgttgctaagaaaatagaaccagtttgtcaccttggaggtggcaagggacagcacttcgctgtgcgtctggtcgccgtaggaaaaatagccgcgggacaatggacctgtgatcagtacagcggactgcatggcagtgtagccgccaaaatacaggctgacgcagagcgtctgtccggcagacaccggaaaggagagtgcgtcacttgtggcggacgcgcccgctgcaagcgtgacggagggactgccgtcaaaggtaatatcccggatggtgcctgccgtaagagggcaggaaaggggaactttcttggtgagatcggaatcacacaccgccaccgttgcccggtggatggtgacaggttctttcccacagtagttgtcgagcgtgaagcggagtgcgcttccggaaaaaggtgcatagaccggatagcgcagcgtcagatcttttgcgtagccttccggatgatgttctgcgatggacatggcattgccccacatggagacccattttgtatcattcataagtttgttctcttttctttattatttactggtaaggaatataagagtatattcctgcgttattatagcggaagtgaaggtatttttccagtggacttgttctttttttcgatccttgctataatgagcgcatgcgggtgaagacctgcagacagaatagaaagacaataaaggagttcatttgtatgggagagattgcaaatcgtgataataagaagatgctgattttgtttgcagaggtggttgcggcgcttgcgacgattctgatcgccgttttagcgatgaagattccggtggtgccggtgtgtgtgatcgttttgatcgaggtggcgattgctgcctgtctgcaggaggtaccggtgtgggtacacgccgtggtcgccgcagtacagctggttgccggggtactttgcggcagagccgtattctgcctgttgtgtattttgatctatgtgtttgcgatactgacactgcgggaagcaagagcgtaatgataagacctttatgaagcggatgcttggtaaaggtcttctttctgtcaaaggagaaaagatgttagagaaactttttttggaaatgatctcatattacagcggagacccgaaacggatccagcattttacaaaggtacacagctatgcaaagctgatcggagagcgcgagcagctttcgccggaggaactctatattctggaagcggctgcatacacgcacgatatcggcatcaagccggcggaggagaagtacgggagcagtgcgggaaagctgcaggagcaggaaggccctgcggtggcacgcgggatgctgatgcggctgggctttgcggagaatgtgattgagcgcgtctgctatctgatcggacatcaccacacctacaccggcatagagggcagagactatcagattctggtggaggcggattttctggtgaatttgtatgaggacggcagaacggacggagacggcgggtttgtgccggataaagcggctgtagagacggcatatcagaggatttttgcgacggagaccggaaaatggatctgccggagcatgtttgcacttggaggtgtgtcatgatgcaggaaaggaagcagaagggaaaaattctggtattcagttccagggaaatctgctatctgtccagcaactttttcgcaaatcagatcggcgcggcgtttgaggaactgggatatgaggtgacggtgtgcgaactctcaaaggaggatgatctggatgcgaagcttgcgcgctatatcggacagccgtaccgcctgattctggattttaattcccttctgccgcggatggtgttagacgacggcactccctatgtggaccgccttgcgggaccgttttttgactatattttagatcacccgctgtttcactatcagggactttcaagcggtgtgaaaaacctgcatgcgattgtcctcgacgaggcacagcagaagtacgtagaaaaatattatgaaaaggtggcgagcgtccacatgctgccgctcggggcgacaagagcagtctacgagggcacaaaagagccggagtgccggattttatttccgggaacgtatgacagaccggacgcggtttatcagattgtagagaatgctcccgagccgcttgggagcatgatgaaagatctgattgagcggaggcttgccgatcccacactgccgatggaggaagcattttcacagcatcttaaggaggaggaactggaacttcctgccggacagtttgcgctgtttatgaacagcatgtatgcggtggacgcctatgtgcgggattatttccgcaaggcggcgttggacgcgctgctcgcgaagaagctgccggttaccgtattcggggaaggctgggaaaaatattcctgcggggacgggcacagcctgcggcgcgagccggcggtgccgtttgcgctctcctttgagaggattgccaaagcccatgtgcttttaaatgtctcaccgatttttaaccggggaatgcacgaccgggtttctgccggaatggcgaatcatgcggtggtgttaaccgatgaaaatccgtatttaagaagaacgtttacaggcgggaaggagctgcttttttattcgctggaaaaaccggacacgctgtgtgagcaggcggagagagcacttacagacgtaagacttcgtgagaagattgcggcttctgcctatgagacctttgagcgggaatatacatggaagcgccgtgcggagcagatcctcgcatttgcagaggaggtggaagcatgagagcacagaagaattatcagaaaatgctggaggcgacgatcgctggattaaaggagcagaaccgtgtgccgacgctgctgctgcacagctgctgcgcgccgtgcagctcgtactgcctcgagtatctgtcgcagtattttcatatcaccgtggattattacaaccccaatatttatccggaagaagagtatcatatgcgggtgcaggagcagcagcggctgattcgggaacttccggcaaaatatccgatcgcattccgggagggcgcctatgataaggaacgtttttatgagatggcgcgcggactggaggaggaaaaggagggcggcgaacgctgcttccggtgctatgagctgcgcttgagagaggcggcggagacggcaaaaagccttggcatggattacttcaccacgacgctgtccatcagtccactcaagaatgcggaaaaattaaatgagatcggggatgcgctggcggaggaatacggcgtggcatatttgaattctgacttcaaaaagaaaaatggctacaagcgctcggtagagctttccgaacaatacggaatgtaccggcagtattattgcgggtgcgttttttccaagcgggagcgcgatgcccagattgctgcaaaagcggcggcacagggaatttgacgcggtaaagcatgaaaggacttgcgggaagcgcgaacttcatgtagaatgataggaaatgtagtgaaagcgagggttttaaaatggctcagttatggggaggacgttttaccaaacagaccgacaagctggtctataattttaatgcgtctatttcgtttgaccagaaattctataaacaggacattgagggaagtattgcacatgtgcggatgctcgggaaacaggaaatcttaaccggggaggagatgcaggcgatcgtcgcatgcttaaaggaaatccttgcggatgtggaagccggacgtcttgtcataacggatgaatatgaggatattcacagctttgtggaggcgaatctgatcgaccgtctgggagacaccggaaagaagctgcataccgggcgcagccgcaacgaccaggtggcgctcgatatgcgtctctacaccagagaggaactgctccacgtggatgtgctcttaaaggaactgctcggcacgatattacatatcatggagcagaatacggagacgattatgccgggtttcacccatctgcagaaggcacagccgatcacgctcgcgcatcacatgggggcttattttgagatgtttaagagagaccgcctgcgcctgtatgacatctacgagcggatgaattactgtccgcttggttccggagcgctcgcaggcaccacctatccgcttgaccgtgcatacacggcagagctgctcggtttttacggaccgactttaaacagcatggacggcgtgtctgaccgcgattatctgatcgaatttctgtccgcctgcgccacgatcatgatgcatctgtcgcgcttctcggaggaggtcattatctggaattccaacgaataccagtttgtggagattgatgatgcgtacagtaccggaagcagcatcatgccgcagaaaaagaacccggacatcgcagaattagtcagaggaaagaccggacgcgtctacggcgcgctgatgtcgcttctcacgacgatgaagggaatcccgcttgcgtacaataaggacatgcaggaggacaaggagctttcctttgacgcgatggacacggtcaaaggctgtatcgcgctgtttaacggcatgctcgccacgatgaagttcaacaaggagcgcatgcgtgcttcagcgaacggaggctttaccaatgcgacggatgccgccgactatctcgtgaaccacggggtgccgttccgcgatgcacatggaattgtgggacagatcgtgctttactgcatcgaaaagggaattgcgatcgatgatatgagcctggaggagttaaaggcaatcagtccggtgtttgaggatgatgtctatgaggcgatctccatggaaacctgtgtgaacaagcgtctgacggtcggagcaccgggaaaagaggcgatggaacaggtgatcgcagcggagaagaagtacctggaggaagagtggaagcctcttgaaacttcaatacagtaacgtgatattgtgagaaatgtacaagaactgtcaaaaaaaaccgggaagttttacgaaaaaagcattgctttttgacgggaaatggcataatatattcactatgacgacacttgttcgtcactgacggacacgaacagcgcaaaaagcaggtacgtgtaatgatccggcagaggcaatgagaggcggagtcgtatgccacagcgggtgtcataagaaaaagatgaggagattagaagagtcatgagtgaaaagttgagagttggtattctgggtggtacaggtatggttggtcagagatttatttctctgctggagaatcatccgtggtttgaagtgacaacgatcgcagcgagcccgagaagtgccggcaagacttatgaggaggcagtcggagaccgctggaagatggacacaccgatgccggaagcagtgaaaaagattgtcgttatgaatgtcaacgaagtggagaaggttgcggcagaggtcgatttcgtattttccgcagtggacatgacaaaggaagagattaagaagatcgaggaggagtatgcgaagacagaaactccggtcgtttccaataacagcgcgcatcgctggacaccggatgtgccgatggtggttccggaggtcaacccggagcatatggaggtcatcaaataccagaaggagcgtcttggcacaaagcgcggtttcgtggctgtaaagccgaactgctccattcagtcttacgcgccggtacttactgcgtggaaggaatttgagccgtatgaggtggtggcaacaacctatcaggccatttccggagcaggcaagacctttaaggactggccggagatggttggaaatattattccgtatatcggcggtgaggaggagaagtcggagaaggagccgcttcgtatctggggacatgtggacccggagaagaaggcgatcgttccggccaaatccccggtcattacctgccagtgcatccgtgtgccggtgttaaacggtcacactgcggcggtgttcgtaaagtttaagaagaacccgacaaaagagcagctgatcgaggcacttcgcaatttcagcggtgttccgcaggagttaaagcttccgagcgcaccggagcattttatccagtatctcgaggaggataaccgcccgcagattgctctggatgtcaactatgagaacggtatgggtatctcggtaggacgtctgagagaggacacggtctatgactggaagttcgtgggactgtcccacaataccgtgcgcggcgccgcgggcggtgcagtgctctgcgcagagcttttgaaagcacagggatacatcacagcgaaataaagaataaaaaagaatcctgcttgcaggattcttttttatttcataggaaatagcgtgatacgttaatgtgtgaaagtggaacttccctatgaaaataaaaaacgctccgcgaggatgcgcagctcgcggtaaggaaaatatcgctttgcgaaccgcttgcgcgcggagaatttcgcaagcgagattcttttttattgcccggaaaattaaaaaatgatataatttccgcagaacatatggacagatagaatgtgccggatatgggatgcggtgtggcttttcgtgcccggcaggaaagtgcagaggagaagagatggtcgtaaaatcgtcggtgttaaaggaactggaagagtgctaccgggaaccgggcaatcagctggttgtgctgtacgggcggacggactcggagaaagagcggctgcttggcgcatttgtgcagaacaagaagcatttttattaccgcgcgagacaggtggcggagcgagagcagcgcgcacagatggggcgtgaactggcggcgcagtttgaggtgatgctgcagaagtatacctatgaggaatattttaaccgggtaaagagcggtgatcccacgaagctggtagtcgtgatcgatgaatttcagtatattgccaaaaaggatcctacttttatggaggcggtgctgaaactgaaagcgcacaggctttatccgggacctgtgatgattctgctctgcagctcggcggtgtcatgggcagagcgggaactggcggagtgtatcggtgaggcggcatgccgcaaaatagaccggaaaatcaaatttacgaatctgaattttctggaagtggtgcgggcgctgcccgagtatccggtggcggaatgtatcaagacttacggcatcatcggcggtgtgccgggatacatcaaccgctggaacgcaaaagcggatgtaaagaccaatatctgtagactgattctttcgccgggcggctatctgtaccatgcggcggaagatctgatcggggagagtctgcgggaactgtctgtctatgagaccatcctggcgcagatcgcggccgggcaggacaagctgaatgatctgtaccggacgaccggattctcgcgcgccaagatcagcgtctatatgaagaatctggcggcatttgatatcgtccagaaggtggtatcgtttgagacgggcggctgggagaacacgaagaaaggtgtgtaccggatccgcgacaattatgtgaatttctggtttcactttatctatccgcatctgtcggatctgtatatgacccgcccggaagaattctacgacagatatatcgcgcccggactggatgcgtacctctcccggtattttgtggaggtatgcatggaatatctgggacttctcggtatggtgggaaagcttccgcttaagattgcacgcatgggaacctgggtcggcaaagaggggaatatcgacatcattgcgcagaatgagattcgacagaatatggtcggactctgcaactggcaggaacccaagcttacgatggaaatgtgcgaggcgctgttccttaacatgaagcgggcaaaaatcggcgcggaatattatttcctcttttccgcacagggatttgcaccggaggttaccgccatggcggagcgggataagcggttcgtgctcgtggatatgaatgaactgtaagttgcccgatgcctggaaaaatgctataatttgcttcatgcgaaagtaattggaggaacagattgtggcaaaatctttgatcatcacggagaaaccgagtgttgcgcaggagttcgcgcggattctcggcgtatccggaagaaatgacggttatatagagaacgacgggtatgtcatcacctggtgcgtggggcatctggtggagatggtgtacccggaggagtatgatgagcggtataaaaaatggcggctggaagatctgccgtttctgccgcgggattacaaatataatgtaatcccatctgtgagcaggcagtatgatgtggtacataaaatgctgcaccgcgaggatattgacacggtctactgggcaggagatgccggaaaagaaggacagacgatcgaggaaaatatccggaagttcggcggcgtgcgcgagggcatgaaggagctccgcgtctggattgattcgcagaccgaggaggagattctgcgcggcatccgtgaggcaaaagacatgtcggagtatgacaatctcgcaaagtcgggcgtgatgcgggcgatcgaggattatgcgatgggaatcaatttttccagagccatgtcggtaaagtacggaaagcttctgaatgatgcggcgggaacatcgagctatacggcgatcgcggtcggtcgcgtcatgacctgcgttcttggcatggttgtgatccgggagcgcgagatccgcaattttacagagacgccgttttaccgtgtcgtgggaacctttcatcccgaaggagaggaagaatgccggatcacggcggagtggaaggcaatagaaggctctaaatattttgagtcgccgcttttatataaggaaaacggttttaaaaaggaagagagcgcgcagacgctgattgcggagttaaagggacaggaagcgctcattgattccgtggagacagggacgcagaaaaagcgtgcgccgctgcttttcaatcttgcggagctgcaggcggagtgttccaagcgttttaagatcagtccggatgagacgctgcaggtggcgcaggatctgtatgagaagaagcttaccacctatccgagaacggatgcacgtgtgctctcctcggcggtggcaaaagagattacaaaaaatatcagcagactgaaaaattttgcgccggtggctccttttgtggagcgcatcatgaaggaagggcgctatcggaacattgcgaacacgcagtatacggatgattccaagattaccgaccactacgcgatcattccgaccggacagctcacagagctggaatctttaaacagtcttgaacgaagcgtctatgagatgattgtgcgccgtttcttaagcattttttatccgccggcggagtatcagacggtgaagcttgtcgttgcggcaggcggtgagaagctttacacttccgcgaagcagttaaaggttccgggctatctggagattgcaggcattccgaaatcggcgaaggagcggaatgcggcgaagacggacggggaggagcagacgcagggcggtgatgctgaggctgcacaggaagaagaggagaacgccgggcttttggcgtatgccgacaagcttcaaaagggagagacgcttttttcggacggctatgccatccgtgaggggaagacctccccgccgaagcgttacacgtcaggatcgatggtgctcgccatggagaatgccggacagctcatcgaggaggaagaattaagagagcagatcaagggttccggaatcggtacatctgccacgcgggcagagatcatcaaaaagctggttcgggtcggctatctgaatctgaacaaaaagacgcaggttctcacgccggagcggctgggggaaatgatctttgaggtggtttcgatgacggttccggcactgctcaaccccaagatgacagcttcctgggaaaagggactggacggaatcacgcggggaacggtcgtgatggaggattaccgctcaaaactggaggattttatccgcagggagacggtcgccatgatcgagcaggatctgaccggccagattgccacgcggatccacccgctcgtcggaaagggcggaaaggggcttgcggcgaagcgcagcctcggcattccctgtccggtgtgcggaggaacgatcgagacgacgccgttcggttacgggtgcagcaattatcagaaagatggcggcggatgccgcttctccatcggtacaatcgccggaagagacttaaacgatgaggaagtaaaggagcttttgaccgaaggacataccggcgtgctgtccgggtttgtctcgaagtcgaagaaaaagttctcggcgagcctcatcctggaaaaggatgatgagggaaaagtttcggttggatttgatttttcaaagaaccagccggaaatcctggagggtgccgtatgtccggtgtgcggttctgctgtggagatcacgccgtttggctatagctgcgtcaagcaccacgagcatcccgatgaatgttatttttccgtgggaaagatcgcgggaaaggcgctgggcgtcgatgatctgacggagcttcttacgaccggaaagaccggtctgatccgcggctttactgccaggaataaaaagaagttcaatgcctgtttaaagctggagcagacggaggacggaagaaagaatattgcatttgatttttcacagaacgatgccgctgttgttcccgatgtcgtgtgtccgatctgcggcggggcgattgtggagacgtcgttcgggttcggctgcgcgaattacaggcaggatgccccggacagctgccggtttgcgatcggtacgatggcgggaaaggacttaaatgcagcgcaggtgaaggagcttttaaaccaggggagaaccggaacaatccgcggattcaagtcgaagagcgggaagaagtttgacgcctgtgtcgctctggaacacacggaagacggaagaattgaattgagatttgattttgaacatgtcgaagccaaaaagatcaaggatgtggtgtgcccgatctgcggcggtgatatcgtggcgacgccgttcggctttggctgtgccaattatgtgaaggacgatccgaacagctgccggttctctgtcgggaagatggcggagaaggcactgacggaagcgaacgtaaaggagcttctgaccaacggaagaaccggaacgatccgcggctttaagtcgaagagcgggaagaaatttgatgcgcgcgtcgcactggcaaaggatgagaagggaaaggtcacggggctgaagtttgattttacggatctggaagcgccgaaggtaaaggatgtaaaatgtccggtctgcggcggggatatcgtaaagacgatgtttggatacggctgtgccaactattcaaaggagaatccggacagctgccggttcgcaatcggcaagatcgcgggtgtctctttaaaggaagcacaggtaaaggaacttttgctccgcgggaagacggacgtcatcaagggatttgtggcgaagaccggcatgaagttcgacgcgccgctgaaactgacgccggaagggcagatcgcatttgattttccggagaagccaaagcccgtcgagacaacacttgcctgcccgaaatgcgggaaaatgttaaagaagagccagtggtattacgagtgtgagtgcggttttaaggtctcccacacggtggcgaaggtggcgctgaccgaggaggtcatgcgcgaactgttagagacagggaaaaccaaagataaagtgaccgggtttgtgtcaaaagccggcaacacgtttgacacctgcctaaagctggaggatgaccgcattgtgtttgattttgacaatcccggcacaaagcgtgagggtgcttccgacggcaagggcggggagcgcatgttctatgaggaattagaagaaaatgcacagccgcagccgctggcggctgaggacggcgcacagtacattgaggaggacgtgcctccgttttatgatgcgatggcggaggagtatgcggcttacgaggaggaagaggcaaaacagcaggcggctgcatccaattttctggatgaatttcctgaatgagaaacgaatggggaaagaaagtaaaaatcggatggcgtgcggtgcatgcttgctattgacagccggataaaatgtcattaaaatttgagtagttattgatagaatccggcagaagacacaggaggaaacagggcatggagtacaatgagcaggcctttaaagagaaagccaatttaaaggcaatgaaagtatggctggctttgattgcgattatgacactgtcatacggaagcgacctttccaagggaatctatacggcgacgcagtatgttgtttttttggttatggcgtgggtgccgtttgcaatcggactgctgacgttgaagttaaaggggagagcgacaccgtattataaggatgtcctggctctcggatatggctttttctatgcctacgtggtgtgtatcacggactcggcgaccgcctatgcatatattctgccgttgacgagtatgttgattctgttcaaggatcgcagttatatgatacggtgcgcggtcacaaacgagatcgtcattgtgctcagtgcactgctccatgtcttcctcggcctgaatccgaatgtgaaaatgacagactattacctgcagttttcaacactgcttctgtgttatatctgttatattctttctgtcgaccacttaaatgagtcggacggagcgctggtggcatcgatccgggataatctgagccgggtcgtgacgacggtgggacaggtaaagggagcgagcaactcgattgtggacggcgttacggttgtgcgtgagctggcggatgagaaccggcagggagcggattccgtcgtaagcagtatggaggaactcacccggaacaacgatgttctccacaataagacgatgtcctccatggaccggagtaccgacatcagcacgcaggtgcagaatgtggcgggactgatcgatgagatggtgacgctgatccaggagtcggtcgagcatgcggatgtgagtgcggaagaacttgcggatgtcatgaatacgacggataccatggcggcgctttccggcgaggtcgagcaggtgctcgagaactttaagcagaaatttgaaatggtaaaggaagagacgggtaccatagagggaatcacgttccagacgaaccttctggcactgaacgcttcgattgaggcggcgagagccggggaagccggaaagggctttgccgtggtggcaggtcagatacaggatctgagcatgggaaccaagacttcttccggacgtatcagggacgcactggatcatctggaggagacttcggagaagatgacggaatccatcaccaagacgcttgagatgatccgcatgacaagagagaagctcacgcaggtgcaggagagtgtcacaagcattaccgatgattccaaaaagctgggacagaatatcggggtaattgacggcgctatgaaggaagtggaagcttccaacagcgacatggtggagaacatgaagcagatctgcgataccatggaggtcatgacggagtgcatcaaccagtccgacgaagcgtcccgcacgatgctaagcaaatacgaggagtcttccgtcaatgtggataagattgagagtgtggtaggaaagctcatggaagaactcggtagcggcggattcatgggaattggcgatgcgcagccgggaatgcatgtggtgttagtcgctaagaacggagcacaggcagccgggacggagttccacggggaagtgtttgagagtcagagcgacggagttctggtaaagatcaagccggaagccggaaaaacgattgagataaagaaaaaagacattacatatgaactgcagatctgtgtcaacaatgcactgtatacatgggaggatgtcagcgtatccgccgcttccaatgcgggtgccgacagctaccggattgctgtggcgacaaacccgaaggtcatcaaccgcagaaagtatccgcgtatgccggttgccaatgcatgtaccgtgacgctgaaaaaatccggcaaagcttacaacggcaggatgattaatatcagcgcaggcggtttcgcattcagcgcacatcaggaggatttcgcaaatgcgatcgggcaggatattttgctggaaatcccggacttcccgctggaggaggcacggacgctggacggacatatcatccgcagtacggataatgatggtgagttcattgtcggatgccgtatgccggaggacagcgaagagatccaggcttatgtcaataaaaattacagggaatagagaggaatttgtgtgatggaaacagcaaaaatcagccagttatatgacttaggggagacgattgcggcggaactgtttgcgggactgacctatccgtgggaggctctgccgaaaatcagcggctttataaagaagctgggaccgatgcttgacccggaggtctatgagcagcgcggcgagaatatctgggtggcgaagagtgcgacggttgcaccgactgctttcttaaatggacctttaattattgatgaggatgcggaaatcagacactgcgcttttgtcagggggaatgccatcgtaggaaaaggctccgtggtgggcaattcaacagaattgaaaaacgttgtgatttttaattccgtgcaggttccgcattacaattacgtgggagattcgattctcggttacaaatcccatatgggtgccggctcgatcacttccaatgtcaagtcggataagacgctggtggtggtaaaggatcatgatgagaaaattgaaacagggttaaagaaattcggagcaatgctcggcgactatgtggaagtcggctgcaattccgtgctgaatccgggaaccgtcatcggaagccacaccaatgtttatccgctttcgagcgtgcgtggcgtggttccggcaaattcgatttacaagaaccgcagcgaggtagtggaaaagcggtaggacaacagaagagggacagagacaatgaagagaagatgggtgcagggaatgcttcttgcaggaatgctgattttgacaggatgcggcgcaaagaacagttcacctgtggagaacggtaaagattatacatggaacgacattacagtgatgcttccggaagactgggcggaccgctgtacgatcaaagaggatgagaatggatttaccatctatcagacggcttcctatgagaagatggaaggacttggctacctgtgttcctttgaaaaaagcgacgcatggatgaattacggtgcgggagagaacctgatcgcctacacggaggacggaacgctgtattacctgatgcagccgacggatgttgcgtgcgatacggaggatcagacaatcgtggaagagtacggatccatgatggaggaggtcacggccatcgcatcaagtgtgaagatcgatgcggatgacgttcattacgatgccgatcagtatgtcgttccggttggcgcaatactgccggtgacggaggagaatctgtcggatctgtcagagcaggaactctatttggcggcaaacgagatttatgccagacatggaaaaacctttgatgacacctacctgcaggcgcattttgatgcgtgcagctggtatacgcccgccgggggagcgactgcaggcgatgcgggattaagtgagattgagcaggcgaatctgaaactgatcaaggcaatgcagacggcatatgcggcggaacatatatatccgaaatcctattcggcaggcgagaccgcagagatcgctcttttggacaatggagttcttaacgaagtcagctacacggtaaccggtaagggggagcaggcggtctgcacgctcacgatcgacgggacagcgtacgaccttgccgagtacattcagatgcacgcgccggttgcggatgcgttttatgtgacagaccttgtggagaacatcggaacaccggaagaggatgatggtctggagattgccgtacttgatgaaggaacagatggcatcggggcgacccattttttcaaatatgatggagatctttactatctgggcgaggtcggaggattcccgttccgggaccggaatgccggatttagcggttttaacggccagggcggtgtgatggatctgatccgttacgacaagccggcagactgcatcctgcaggggtatgcctggtacaacagttcggagaagaagatcgagcatgcggacggcgggctttattcctattacgagccgtgtaagctggagcataagggagcactgaccgtgtatttttcgatggatgagacatcagcagaaaaaacgattgcggcaggggaggacatctactgtatccggtcggacggagacggttggatgtatgtgcgtgcaaaagacggaacggaagggtttttacctgtgacgcaaatgtaagaaaagcagctgttttgacaaaagtgcataaaatttgcagtacccacttgtgaaaatcaagaaaatgtgagaaaataaatgcagtatgttaaatgtgtaacaatgtttaacaactcagttctatttatgcgaaaggagtcttaaaatgatttacactaaggaagttgaaaacatgtgcccagtcgcaaagggcgcaaaacatgaaccagctccgattccggaagaaggcaagtgggttcattccaaaaaaattgaagatatttcaggctttacacacggtgtaggctggtgtgcacctcagcagggtgcctgcaagctttccctgaatgtgaagaatggtgtgatcgaagaggcattagttgagaccatcggatgctccggtatgacacattctgcagctatggcagcagaggtattacagggtaagaccatccttgaggcactcaatacagaccttgtctgtgatgccatcaatacagcaatgagagagttattcttacagatcgtttacggtcgtacacagagtgctttctctgatgatggacttgcaatcggtgccggtcttgaggatttaggaaaaggacttcgttcccaggttggtaccatgtacgcaaccaaggagaagggcgttcgttatctggagatggctgagggctatgtaacaggtatcgctcttgacgagaacaacgaggttatcggataccagttcgtttctcttggaaaaatgactgacttcatcaaaaaaggcgatgatccgaacactgcttgggagaaagcaaagggacagtacggccgtgtagcagatgctgttaaaatcatcgacccgagagaagagtaggaaaggagacggacgaaaatggcattatttgaaggatatgaaagaagaattgaccagatcaacgctgtattaaacagctatggtatcagctccatcgaagaggcagagaagattaccaaagatgctggtttgaatgtatatgatcaggtaaagaagattcagccgatctgtttcgagaacgcttgctgggcttacacagtaggtgctgcaatcgcaatcaagaaaggatgcacaaaggctgctgatgctgctgcagcaatcggtgagggtcttcaggcattctgtatcccgggttctgttgctgaccacagaaaagtaggtcttggacatggtaaccttggtaagatgttattagaggaagagaccgagtgcttctgcttcctggcaggtcacgagtctttcgcagctgctgagggtgcaatcggtatcgctgagaaggcaaacaaagtacgtcagaaacctctgcgcgttatcttaaacggtcttggaaaagacgctgcacagatcatctctcgtatcaatggatttacattcgttgagacacagtatgactacaaggcagcaaaattaaacgttgtatacgagaaggcatactccaacggacttcgcgctactgtaaagtgctacggtgcagatgacgttcaggaaggtgttgcaatcatgcatcacgagaacgtaggtgtttccatcaccggtaactctacgaacccgacacgtttccagcatccggttgcaggtacatacaagaaagaatgtatcgagcagggtaagaaatacttctctgttgcatccggcggtggtacaggccgtacccttcacccggacaacatggcagcaggtcctgcttcctacggtatgacagataccatgggacgtatgcactctgacgcacagttcgcaggttcctcttccgtaccggctcacgttgagatgatgggtctgatcggaatgggtaacaacccaatggttggtgctacagttgctgttgcagtaagtgttgaggaagcagccgaggcaggcaagttctaaatagaccttacaatttgaaaagacgttaaacccaggaagtaccgtaatcacagcgattgcggtacttttttggtgcctggaaacgagaaaatgaaatgtggtgtgagaagtgctgaaaagtagtgaaaattggaaagtaggaaaccggtaggtaacaagtaggaaacatggagaaggtaacactttttgaagcatctgcagaaagcagaaataccgcaaccacgtgggttacggtatcttttccagctcagctctgagccattccaagtcacggtctgtataagcagcttcggttatgtcggtgattctgtgaccgacaagtttctttatggtgtattcgtcaacctcagctttctttgccattgtgatgaatgtcattcggggatcatgcggtctatgatcgtcacgaagtttgagagcgtcgataaccttatcgaaacggccggcatatttgtcgtaagtgatcgtcatgccgcctttgggagaatccggatcgttaaagaggcgggtgctgccaagttcaacggcgtagtcgtagttcttctttaccaggtcgaacactttagggtgtattggtaccattcgatgccgtccagcctgggttttcattccgccgacaatgtagcgttcgtccaggtgcacgtcctctaattccagtatggcgagttcttgtgggcgccatcccatgtagcactgtatgagaatccagtctacaaagcggatcttgccgaggttgtcccaaagggtctgcatttcggattcctggaagatgatgtggccacgtttcgcctcttccttttctttgatgatgtcgtccgacagttcaaatgtccgggcgtagttcttatctacaagctcatattcgagagcatagtccagcatgagattgaacatagacttgatcctggatttggtaccagcagatgcaagcaccttttcgcctttgctggctccacgtgaagggataatatagccgtcctccataattcctttgatatggcgggcacgcaggtccttgacgcgcataccggcaatggcgtggcagtagctccatgccgatttgatggtacggcaggaagattcgctttccagggtagcaaagtatgctgcagtccatttttcgtaaagctcagcgagagtcattgaggcgttctgtatatcgtaagggttggctccgtactcagcgagtgcctgcagagcttcccttttggttttgaacgtccccaggggtacacggttctgtactgtctttccggtttgttcgtctgtagtccagccaagagtgacacgggccaggtacggcttacgcctgtttccggaaagtttggttacgctgccgtaaccgttagggagtttcatccggtaaccttactgattccacagccgcaggcaggcctgagaaatctgttttgattggttccagtttgagaagagaggacagagagattttcttctgttccggtaccctctcattaagaaccgatgtagggagtacataaaagtcccagtagtccaggtccaggattgaaacatcacgtgtacgagcggtaaagacgcagaacacatacaaatcattattacgcatagctttagaggcgtaggtagctccatcccaggcaagtttctttgagatgtcgaagatgatctgcgaaaacacatcttccggagtccatgcctgcaggtaggcagacgacttgacctcaatccgtagacctgatggagaggtaaggtcgaacggcaaccagtcggcacgtgcgacatcctttgttccgagagcggagtgtacgagaaattccgcaagcactccacggtgagtattgttgagcagatcagaatacgcccaacgccaaaagtcctgcaggatgatagaagtatcggaaccgtgcagggtaaatggttcatttccgtttagttgttccatgatttcctccgtatctttccaggagcgtccacaggacacgcttatcgtcgctggaagcgattgaatacaaggacacgagtattttatcgtccgggacattatgaagtccgagaaggtagtctacggaaacgtcgagtgcatctgcaaggagaatgacattatcgacagtaggcgttcgcagtccgttaaggtagcgtgaaattgtagctgcagtcacgccggaaagagtagccaagtcgttaccgttcaagtggcgttcctgcatacattgagacagacgctctgagaatctgttaatatccataggcgtaaccggacagaccggcaccacgtatggagtagtacaatagtttcctgcactccgaatccgaaagcggaccataggagcggatcagtccgaacagctgcagatcagtaatcataagtttacgctgcaggagacggatttttgcaacagtaccgtaggaagtattcctggtaccatgattacagctgtcacaaaaagaggagagatacagaagcaatgcagcggcatcgttcccggacctctcctcattgcgtgccagctcaaagtatttgttattcataggcacatctcctcaataccggccgtaaagtcggtaccattctaaactgataatcttttttccttatcgagatatttctgagattctgtgtaggctttcaagaagcctttgagttccccgataaattcaaattttttgttctccggcaacgcccggtacaattcaagaagctcatcctcttctgcagtagtgagcttgcgggcaggagcctcttcgccggtgagcagataatgaacggatacgcccaggaagtcagcaatagatttgatgtactttgctggcgggtcgctattgcgagttttccaggtagacatagtggacgtgcgtatgccgaggcgatcacacaggtcagtggcttttttgtcccgtttttcaagggtttctgtgattctttcaatgatttccataggcaacctccgatataaaaataatacgcaaataagagtaaaaacatttacaaactcgcatatacgtgttataataaatacatgaaatacaaaacaattcaaagttgcgagctgagatattgtgcgtgtatttcgtgtgtctgtttgcgagtttgtaaagaggtttacttacattatagcacgcaaatcagaaaagataaatagtttttacacaaatgcgagaaaggagtgaaacgcaagcatgaagcaggaaacatcacagtggggcaaagctgttaagaaggcagtgatcgaccacaacatgacattgaagcagctggccgaaaaaatcggttacagcaatgcaactgtttcccaggtcgtcaatggcagatattccaattcaagctacaagatgattgctgagaagatcaacaaagtgcttggaacggagggactgccggagaggaccgagacaccttccgatgaatggtgccagtcagtgaagatcgaactggtgaaacagagcatgaccgtcaatgagctggcgaagcagctggatgtctccagggatcggctgtcactggtaattaacggcaagatgatgaacgaagcaatcgttggcggggtgaaccgcctgctcagaatcaacacggccgctgttccagctgataagtaaattatagcggaagggtaggtaacaagaaatgggaagaggccctatgaatgagaaccaaaatgtatatttccaggcgagaaaaaaggccgcagcatacaacgagaggctatggagccgtgaaggagcagcggaactgttaggaatatcggtatcgacgctggctgattatgagcttggcaatacgaaagtggttccagtggataaggtagttcttatggcggacctctataaaacgccggaactgattactgggtactgtatgcgagaatgcccggtacacggattcctaccgctggcaaccgaagaaaaaagtttagaaggaattgcattaaggcttttacagaacttcaatgaggattcattgaagaatatgcgagacagtctgatcgagataactgcagatggaaaaatcacaaaggatgaattaccagccttggaaaaaatcgttgggcagctcgaaaagatggcagaggtaataagcgaaatgaaaattgccggagagaagtatttgaacggcaagtaagccggagcaacgccggaaaggagttcagaattgaagaaagcaagtaagcgaagaatattgtttgcagcaagaatggcaacgatggtcggagctgcctgttttgcagtcagtggcatttcagaaacgctcgggcaggagaaagaaaaaagccggccggtctacatagccacagaggaagtggcagagacgacgtatacgccggaagttgaagaggcaacacagccaacggagacagcaaaggcagttgagacagaagaaccgttgatcacaagtatggattgggacaaggacgattcttacctgctatgtaagatagcgatggccgaagctgagagcgaaggcgtgaaaggaaaggcactggttatgctggtagtcctcaacagggtttggagcaatgagttcccggacacaatcgaggaagtgatttttcagaagaaccagttcagtccagttgcaaacggaagatacgatgcagtagagccggacgaggagtgttacgaagcattgaagctgatccaggtagaccattggaacgaaagccaggatgctttgtattttgagagcaagagcgacagtaagtggcacagcgagaatttggaatttcttttcaagtacggcaagcactacttctataagtgaaaggaacaggcggtatgagaagatttagaaagaaagtcagaagatttgtgagactgtattggttttgggtaagtctgggactggttctcacaaaagtatcggttgaagcagcgtacatcgagagaggatataaagcctacggcggtgagtggctggttttaccagtggtgatgatcgtcggatattttgtaaatgaggcgagaatgtacctgccggacttcatcgaagaacggagagaggagaaagcctatgagcgaagagttgcagaaaatcgtagacgagtacagagagaaagaaattcacatctcagatgaagaggctgagcaaatcttatggttgtgcaaccggaagatggatatatgcaagattgagaacagagaggaatacctgccgttgttattcaaggacgaggttaagaactatctgttcagatgctcagtaaatgctacgacgtttttgagaagattggaggcagaaggaatatgtgtgcagaatgcggtatgaacccatgccatccaagatgcccgaacgcaccggagccggtaccggttcacgaatgtgtgaaatgcgggtatggaatcctggcaggagataagttttgggattctccggaagggaagatttgtgaagaatgcgtggatgatatgagcgcagaagaaatattaaagttgtgtggcgaaagtctcacggaagcagaaaaggaggaaaggtagtatggcagaacagaatgcagtggcaacacagcagggaacgcagttaagtgtagcagcgcaggttaagagcatgatttcccaggatgcagtaaagaagaaatttacggaagtcttagggcagaaagcaccgcagtttttggcatccattacgaatgtggttgctggatcagcacagttaaagaaatgcccggcaacaacgatcatgagcgcggcgtttgtggcagcaacctacgatttgccgattgacagcaacttggggttcgcagcaatcgtgccctacaacaacaataagtacaatccacagacgagacagtgggagaaacatccggaagcacagtttcagatgatgtataagggatttatccagctggcgatccgctccggatattacgaaaagatgaattgctcggttgtctacaaggacgagctggtttcatacaatccgattaccggagaagttgaatttgtgacggacttctcgaagtgtacgcagagagccgaaggaaaatcagagaacatcgctggttactatgcctggtttaagttattgaccggtttcagaaaagagttgtttatgacaacagcagaggtcgagaaccacgcccgcaagtattcaacagcatacagatatgacctggaaaacaataagaagggcagtaagtggacaacagattttgaggcaatggcattaaagacggttatcaagatgctcctcagtaagtggggtattttgtctgtggatatgcagagagcaatccaggacgatcagaaagtttacgacgaggacggcgatggaagttacggcgacaaccagccggacatcgtagaggcgcaggacccgtttgataagatcgagcagaaagaagaggaacggcagatcggtggcttagatttggaagaggttgaataggaggaagaagaatgcagctgacatcagaaaattattatagccaggaggctaaccaggagtacatgagcgtatcgggatataaggattttgccggaacctacggcaagatgccttgcgagttctacggaatggagaaactgaacggacgctgggaggatgaaaaaagtacagcattgctggtaggaagttacgtggacagttattttgagggaagcctggaacagttcaaaaaggacaatccggaaatcttcactcagaagggagagttaaaggcgaacttcaagcaggcagaagagatcattgctcgtatcgagcgagacgaatacttcatgaagtatatgagcggtcagaagcaggtcattatgacaggagaactattcggggcgaaatggaagatcaagatggactcatacattccgggagtggctatcgttgatttgaaggtcatggcatccattacggatttgaagtgggtaaaagacatcggctacctcgattttgtccgttactggggttacgacatccagggggcggtctaccaggaaatcgtgagacagaataccggcgagaagttgccgttctttattgcgggagcaacgaagcagacagagccggacatccgtattatccacgtaacagacaactatctgcaggaggcattgcacatggtagagatgaatatgccgagaatcctcagagtcaagaatggagaggttgagccggacagatgcgaattgtgcgattgctgcagacacaacagagtcttaaagaagccgatctcgattatggacttaacagcaggcatttaaggagataggcggtgactgaatggcagacaacagaaagtattactacctaaagctgaaagaggacttttttgacacggacgagatgaagattttagagagcatgaaggacggatatttatacagtaatatcctgctgaaactctatctgaaaagcctgagcaattccggcaggttgatgtatagaaatgtgattccgtacacgccggaaatcctggcaactttgacagggcaccaggtaggcaccgtcgagaaagcattggatgtattcaagaagctggatttaatcgagatgctcgataacggagcaatctacatgatggatattcagaacttcatcggccagtcgtccagtgaggctgacaggcagagagaatattacaaccgcatgaaggctgagaaggaagcactggcaggagaaagcacagaaacgccggaacttccggagccgaaagaaccggtactgcctgcagaacagaagtcaaataaggcgattggtaattacaccacggatttcgaggaactatgggaggcatacccgaggaaggttgataaagggcaggcatacaagaagtataaggcccgcctggaagatggcttctcccacgagcagttgtatgaagcggtaaagaactatgcggcacagtgtaagaagcagagaacagagacaatgtacataaagcacggcaagacattcttaggagagtcaacgccgttcctggactatctgccaaagggcaagccggttcagagcgaagctgagtacgacgacaatgagaatccatttggaaggagtgagtgatgatggatttggatttgcagaaggttttgcctgcagaagcattcgagacagaacagaatgagggcgactacatcggcaaagacggactgctttactgcggagtctgcagaaccaaaaagcagaccagattgcctgcatcggactttacaggcggcagggagatgatcgttccatgtatctgtaagtgcaaggttgaggagaacaagcgtaaggaagaggaagaaaagaagagacaggaaatgcagcgcttggaaaggctgaaagccagtagtcttatggacgccaagctgaaagcaacaaggctggacggataccaggtggacggagacaatcagaaaatctacaacctcgcaggcaattacgtgaaaaggtttgatgaaatgtacgagaaacgccaagggttgttgttttgggggacggtcggaaccgggaagagttacacggccgcctgcattgcgaatgagttgctggatcagatgatcccggtggttatgacatcattcgtgaagatactgcagaacatccagggcaaccccgacgaggaagaaagaataatggcgggactaaatgcggcaaagctgttgattatcgacgacctgggagcagagagaagtaccgattatgcattagagaaggtgtacaacatcatcgacagcaggtatttatccggaaagccgttgatcctcactacgaatatgacattgaaggatatgcaggagtcagaggacatccgatacagacgtatctatgacagaatatttgagatgtgctttccggtaaggtttgcaggcagaagttggagagaaaaggcggcgtcgaagaggttcgatgccatgaagaatttaatggaggaatgacagcatgggattgattaaggtggcagaaatcagcattgacaagctggaagatcgcaagacggttacggcaatcctgcacgagaacggttataccgtcgggccaggaaagagaaaaaagacagagaccggaaagcagttagattactacttgaaggtgtatgtggaggaaggcacagataaggcagaactctacaaagcaacaagcggaaaaacgaaggtggcagccaagaaggtgacggataagatgtcggccgagattggcgacaaggcataggaggcagaaagtggatgaagatatgaagcagattcgtttcacaataccaggacagccattcgggaaacagagaccgaagttttcaagagcaggggcgtatgtcaagacgtacaccccaaaagagaccaccagttatgaaaacctggtgaagctgttttataacgaagcagccaaaggaaagatgtttccggaaggggcaatgctggatgttcggataattgcatattacgaaattccgaagtccaccagcaagaagaagcgcagggaaatgttggaacacaggatcagaccaaccaagaagccggactgggataatatcggcaagattgtttgcgacagtctaaacctggtagcgtaccacgatgattcggcagtcgtggatgcacaggtaaggaagttttactcagaaacgccgagggttgatgtgatgataaaggtcgtaggaccggatcaaatttaggaggtagacaatggcaggaagaaagaaaaccgaaacagtggaagcagaagttgttgagacagcggtagtaccggcaggaaaaatggagttcagactgattaacccgacagaggatggttttctcagacgcattcagtggaacaaggaagagttggaggctgcagtaagagccaagattgctggttacgagaatgtggtttacacagaggaaaacattaaggcggcgaagaatgacagggcagagctgaacaagctcattaaggctattgaggagagaagaaagcaggtaaagaacatcatcaatgagccttatgcagtgttcgaggcagagctaaaggaaatcacggcacttatcaatgagccggtcgcactgatcgaccagcaggtaaaggcgttcgaggagaaacagaaggaagaaaagaaagcggctatcaaggctacctacgatgaaaatatcggagatttggctgaggtattgccatttgaaaagattttcgacagccgttaccttaatcagacatataagctggcaaccgcacagaaggaaatcgtggacaagatcgacacggttaagacggatttggagactatcgacagcctggatagtaagtataagctgaatgcgaaggatgtgtatatcaagaccctggacctcagcaaggccctggcagagaacaagaggctggcagacctggaagaaaaactggaagcggacaagcgccgtaaggctgaggaagaggccgagagaaaacgccaggaagaaatccgcaagcagaaggaagctgaggagcaggcaaagcgggaggcagaagaagcggagcgtaaagcggcagaagctaagaaagcacaggaagccgccgcagaagtcgaacagacagaacctcagtccgaaattggcaaggtaatcgagtccattgagagatcggcattctcccaggcaatagctagagaggtgcaggcggcaccaacagagcaggcagttgatccgttcgctccgaaggaagaacctaagcaggaaaagaagtatagagtacgtttctttgcagacggaactaaggagcagttgggccagctgattgcttttatgaatgagaacaatatcaaatacggcaagattgcaaaggagagtaagtgatgaatgattttgacaagaaattggatttcgacagcaataccttcgagaatatgaagcacgatatgaattttgtcctgcagagacttcttggaaacatgattgagaagcagtccaacgaaggaagcatgacaatcaagattgacgttaccatggtaaaggagtttatcccgaactatgacccgaatatcaagggagaatccagggagatcagcaagccgcagttcaagcacaaggtcacatctgcagtaaagattaccgacgagaaaggtggaaatctcaacaacgagatggagatggttatggatgaagagaccggctgctatgtgttacagccaatcgcaaacacccagcagagaacgatttttgattcagactttatgcaaggccaggagcaggaaggcgaaggtagcgaggacattatcgacggtacatacatcgatgcagatgtaagaccggcgttacctggaccggcagacgaagagaagcctgcggaggaagaggaaacagacacccagcctgcagaggaagaaacacagtcggaagagaacggcgaagagccgggagatacaccagccgaggaacctaacgaggaagagccggaggatattaccgacgacatcctgggcgatgcagacacagaaggttacgattacgaagatccggaggagtagatatgggactgatgaaaccaagagtgagtagttatgtagacagaggcaatgaattgattgcaaagggcaagaccaagcaggcaatgaacctggtgagtcacggtctgcagtattactcagagagggttatcgacagcatatctccatacgccaagaacgacgcgggactgatagttttagtcctgcgccacctggcagatgaagtcgagaagaacaacccaggagcaaaggaactggcggctggcatggagaagtgcgtaggcaaaccttccctgcaggagattgagagaattaagaaaccgaacagaaagtaaggaggcagaatgaatacaccggagagcgatatggagcagatgaaatttgcgagagaatgggtaagagcgcacgctgcaaagaagatggcaaagtatgagaaaaagctgagaagagctgcaaaggatttcttcgggcatccggtagcaatcgcatatttgaagcctggcgtgatgtttgagattaaagataccggagaaaaggcaaagattgtagcggacgaagagaaaggataagcgatatggcaagaggtttcttatacgtgtatgagcggatatacaaaggagagactgagatgcagactgagttccggaagataccggtcaacggtaagcgaacctcagtagcagatcagaagagagtccggaagattatctcagacaacgcacacagaatagcacaggaatgctcggtgctggtgagctatcccaaaatgagaattgagggtactgcagtcaacctgggggatgtgcatataatgctcccggactgcagaatcatcagcatcgaggaattgaagaaaatcgagcgggggggtgaaataggtgcgaaggcgcaaagagaccgaagaggaagcggtaaagaggcggcaacaaatgtatggatgcaatgggaagtgctgcgatagagtaattgatccggaaacgggcgaaggccagtatttcatatgtggtggcatagatacctgcgacgaaacaagggtaggcgagtttataggaatggtaggagcggtactgtttatcgtcctggtaccgattatgttcatagcaggaatcatagccttgatatgtataggttgaatagaaaagaggtgagaatgaaatgtcatattacagtaattatggttacgaaagtaacgacggcggatggggaaaaattatagcgattataattcttcttttctttgtggcctgggggatggacagttgcagtgtgagtatggatcgacagagtaaccacatggttacgataacagacatcgaaggggactatgtgtacgacgaaaatactaaaattgtgtatatcgagagtgtgaaatcagagtacagaagagctgcacacgcaacatatagaccatacatcagtccatcgggaaactactacaaatacgaaaacggaaaactggtggaactaaaggaagaatcaaagtagctaaaaaagaaaggagtgataaaatcccatgaggtcccatgatccgttcgggacttgcaggaactgcgggtgtcatattatgtgggttaagacaaaggctggaaagaatatgccggtagaccctacgatgatcagctaccgcaggccaggagcaggagtaaaggcaaaggagaagatagtaacgccggaaggcgaggtcgtatgtgctgataaggtatcatccgagagtgcagaaggctttggctacatatcacactttgccacctgcaaggcaagaaaccgttgagaaaaagaaaagccgccccttcgacaggaacgactcgtgactgagaatattatactcgcaaatgcgagaaaagtcaaggaggcgacattatggcaacggagaataaggagaaggcaaagggcgaagaaatcttccccctaacgcaggaacagatcaaccaaatagctgctatcggtgccaaggaaggtgtaagggcatacaaggaagagcagaagaaggaagagcgtaggagaaagaaggaagatagcaaagtcagaaagacaaagaaactgctcagctcgtatagaagaatcaaggcgacattatcggatggagagcagttcactccggaggagcaggcagagctgagatggaagtttattgaggaccttatgggaaacacaagagagatagcaggaaagtccgagaggacaatcaaagatacggagcgcaagcgtgaagaggatttatactgtgtgttccggatagaaaaagcgaccgaaatgtaccgtgaggagtgcgaaaagagcggaagcgaagaggcgaagcgtcgttatagggagttaagcatgatgtacctggacgaaaaaccttacacggtacaggagatttcggaagtagaaaacataagtgataagaccgtctacaaggacataggaatagcttgtggcattgtggctatttacttactgggtgcggatttctaaacgctccctgtggttgtaaaacaacctggtagaaaatgagtaggttgcataaagaattaccaagtggtaatatgctaattagccgataacccaaatgtcacccctaaaaatagccagttgtatttcttcccaacggcaggcacggcagggcgaaatccctgccagttagccgaagaggaaatatgaacaatcggttaaataaggctatttcagtgtacttaggcaggtctgtatagtataataaaactataaacaaccagcataaaaggagtgattgagatggcaatttggattagcaggtatagcaacaaggaattacagagtggtaagtattacccggtaggaataagcatcggaacaccgaagtttccactgggatacacgctgagaaagcagtgctactcactggcaccgaaaggctatatgctgaatatggagcttgaccgattcaagcctgcatattacgagaaattggaaggtatcggcacagacagaatcatcgatatggtcgagaagatgaatgcggaagcaatggcagaagggaaagaacttgtgcttctctgctacgaagatgtgagagttccaggagactggtgccacagaaccgtattcgctgagtggtgggcggagcagactggagaactgattgaggagttatacgatccgtcagagccgaaggtcaagaagcctgcagccaagaaagaaaacaaggaacctgtcaagaaggcagtcgaagccaggaaggaagaacctggttacgagcagctgagtttgtttggtttggcagggatttaatcataacatccggaactggtgtaagtagcacgtggctattccatagttaaggtcctgttcatcgcagggttccggtccaaaaacaacggcatcgcatccgaaagggtacggtgccttatttgttatcacggaacgtacctcagtgtccttcgggtctgaggcctttttgtgcaatatgctgaggcaggtatcaaaaatccccgggtcagtaccagggaaccgcctcggctttttgtatatattgaacaatttttagggaaggagacaaggatatggcattttttatggaccccggagcgatgttcctggggtgcttaggtccgtcggagcagaagtttctcgttactctgatagagactgcagcaaagtccggatatacaaggttcgttgagccatgtgccggcacctttgcaatggcgaacctggcagtacagaatgggtttaagccggagcagatcgagaccagcgacgtcaatatgatgtcaacagttctcgggtatgcgattaccggccagtcattagagccgctggaaatacacgcacaaggctttagtgacgaagaacttcttgacccggcaacggcattgtatgcgcagctgtacctcagaacctcgaagaatgcgggcaatgactatttctatcagatactcacagacctacgcctcagacgagaggaacacatcgagagtattaatcggcagatagaggtaatcaagaatctgctcggtggcatgagctacagaccgttggatatgtgggagcatctgaaagaggtactggatgatccgcacgctttggttattgcaaatccaccgacctacttctccggctatgagaagttctacgacacacagggcaagatgacctggaaggaaccgccgtatgaactgtttgatccggagacaggacaccagcagttctacgacctctgcatggatgcaaaggcgttggttatttgctaccaggagaagagagcgggcgaagcggtaggatatacgatatatgctcgctccggcacgagagcagatttgaatgcttacatcactacgaatcgagaggaagaggcaaccgctcttgcaaacggcaagaagataaaacgtccagcagagagtaagttgcagccgttagactgcagtatgcttccgagagattatgtgatccaggaagatagcaaggtacaggttatcccgattaagtcggcagaggctcagtattacagagagttatggactcacaactttgtcggttcatcggcgacgttcaacagggcattgctgattgatggctatgtggctggggtattcggcatctcgaagatggcggcagacagcgtattcgtttggtacgtgatgaaggtgccacacaagacataccgcctcggcaggctgtgctatatgctggcgcagaacagagattttgtagatacactcctggacaatatcgaacaggagaaggtcacaaagatgcgcaccgcaatgcttaccaggtatccggagaacaaagaggtacgaggcatcatgaaactggtaaacagggttgaggacaagaagaacggctacaagctcacgtatgaggctgaactagtagagggaagaaccgaacagcagacgcttcaagaatggctaaggagggaaaacgaatggcagaagaacagagcaaaggcatccagcaaatcgaaggatgcgaagtaatctatgatatgggttccggcttggtgatcgccaaggttccgctggataaggttaaggagcaggacatcaacgccaggataatgaaaaacgagatgcaggatcagttgaccgctaatatcaagaagcgaggacagctggaaagtctgcctctttttgttttggtggatggcaagctggaaatcatcagcggccaccacagagtaaagagcgcacgtgctgcagagatgaaggaaattatcgctattgtcgatgtgtccggtctctcacgaagcaagattgcggcaaagcagctggcacacaatgcaatttccggtttcgacgacgacagtacgttgagagaaatcgtgaagatgatagacgatgtggacgatatgattgagtcattcgtcggcaaggagatcatggaagaaccgctggaacagtacgacaagatgctgagtcctgcggttcagtttgattttaagaatgtgacgtttacattccttccgcaccaggtaaaggatatggacgcactggttaaagacctagaatcaaaggctccggacattgtgggcgtggcatcctacgagcagtgcaagggatttgtggagacacttagcaagtatcagaagtttacggacatccgaaacgtcggtgcggctatccactccatgatcgagaacgccgctcagaagatggacgactgcggtttcacagaggaaggagaatggacctacctcgctaaactgtttggcagtaatgcggtaccgggtgagtccgcttccgttattcagcaggcaatcaagaaagctgagaaggaagggacaatcacgagtaagaacaggtggcaactgatcgagtacctatgtgctgactacctcagtggcaggtagttaatgtatggcagctaagccaaaatacaatgccccttaccacgataactgggcgtggtctttggctgcaatgggtgccaccaacgaagagatcgcccttgccatgggagtctccgaacgaaccattatgcgatgggccaaggaacacgaatcattcggcaaggcgcttggagaaggtaaaggcgtatcagatgcgaaggtaataaggagtctctacgagagagctaccggctatgagtacgaggaagagaagaaaatcattgagtatgacaaggacggcaatgtgaaaccggtcaagattgaaaagaccaagaagcacgtaccgccggatgtcacggctcagatattttggttgaagaaccggcagagagaccgctggcaggatagaccacaggactatgtggatcagaccagcgacaatgatgcggaggttcagatttaccttccggataatgggagggacgattgatgaaagagaaaatcgtattagctccgcagaaaggaccgcaggaaatgtttttagcgacctctgcggatatttgcatttatggaggcgctgcaggcggaggaaaaacctttggactgctgttagagccgcttcggtacatgaacaatccggactacaacgcaactatcttccgacgtgactacacgcaggtaacatctccaggaggcttatgggatagttcacgaaagatttaccgctacgtgaaaggttcccagccgttaaagacaccaaaactacactggactttcaaaagaggcgcatcggtcaatttcgcccacctcggacgtgatgaagattgcgacgactggcagggttcacagctcacgatgataggatttgacgagctgacgcactttagcgagtaccagttcttttatatgctgtctcgaaaccgtacagattccggtgtaaagccgtatgtacgagccacctgcaacccggacgcagactcttgggttgctgagttcatttcctggtggataaaccaagagaccggctacccaataccggaacggtcgggagtgatccgctggatggtgcgactgaatgaggttgttacctggtttgacagcagggaagaggcagtgcagggagctatcgagaacggtgtcaagccggaacaggctgagacgatgcctaagagcgtgacgttcattgcgagtacgctgcatgataacaaaattctgatgaagaatgacccagggtatttagccaacctgcaggcgatggctcttgtgcagagagagcgactactgcatggcaactggaagattaaagccgccgcaggtttgatgttcaagcgagtaaaggtaaatatgctggaagagataccgcccgatgttatcaagtgggcgagaggctgggaccttgcggcaacatctgaggatgaaaagggagacccggcatacacagcaggtgtgctgatcggaaagagaagaaacggacggtacattgtggccgacgttatcaatcgccggttgagttcgtccgatgtgagagaaattataaggcagacctgcatagccgacagggcgaaatacggaagggtagcaacaaggcttccgcaggacccaggccaggcaggtaaagaccaggcacagagttttatgaagctcttggctggttttactgttaagtgcattcaagagtccggagacaaggtaacgagagcagaaccgttctcggcacaatggttaggacttgaaggcatggataagggcaatgttgatgtgctgatcgcaccgtggaatgaagagtatttcaacgagtgcgagaacttcccacagtccaaattcaaggatatggtggatgcaagttcatcggcatttacggagttggagagtggtgctacatactcagcaccgcctaaggatagccagttaggcaagagcagttattggaataagtgaggtgagaacagatggctaacaaagaaatcggtcgcataggtcagcgacgctacggaggaacaatctatgaggagttccttcatgaactgagaggcacacgaggaatagaggtctaccgtgaaatgtcagagaatgacgatgtggtaggcgcgatcctctttgctatcgagatgctggtaagacagtgcgactggaatgtagagccgggaggcgacaccgcaaaggacaaagaagctgcagagttcgtagaaagctgtatgcacgatatgcaggacacctggacggacacaatttcggaaatcttatctttcctcacttacggttggagcttccacgagatcgtgtataagcgccgtatgggaaatacgaagaacccaaccacgaagagtaagtacacggatggcttgattggatggaagaaattgcctatcagagcgcaggaaacgctctaccgatgggaatacgacaacgaggacaatctgctgggaatgactcagatgccgcctccggactttggtacctacacgataccaatgagtaaggctttgctgttccgtacaaagagcaggaagaacaacccggaaggacgaagcattttaagaaatgcttaccgatcctggtacttcaagagaagaatccaggagattgaaggaatcggcattgaaagagaccttgcaggactcccggtaatgcacggaccggaagggttagacctttggaacgatgatattgaggacaacaagcagacacgaattgcgttggaaaatatggtaaagagtattcgtcgagacgagatggaaggtgtggtacttccggcaggatatgagttggagctgttaagttccggcggcacccgacagtttgacacgaatgcgatcatcaaccgctacgatacccgaattgcaatgacggtactggcggattttattttcttagggcattcagagaccggttcctgggcgttgagttccgataagacggagttgttcgctatggcaatcggtgcattcctagacatgatctgcgagacattcaacagccagggcatcccgccgttgatcgatattaacggtgaacattttgcaggcatcacggagtacccaaagatgtcccacggcgacattgcagatgtggatgtaacgaaggttgcagcattcatcaaggatatgaccggcatcggaatcctggtaccggacgacggactggaagattacattcgccaggtcggacacctgccggagagaacaacggacgacaggacgatagaccagcggcgtaagcaacaggcggagcagaaccagccaccggagcctgagacagccgcaggaagcgatggaaacgacgaaggcgaagaaatccccgacaatgtggcggaagccgctaaaaggcgattaggaaggagcggtgcaaatggcaataaggttcatacggccaaagcgaatacgcaaggcaaagacaccgggcagtcaagaagtcctacgcagacttgaagagtacctgcagaacgaatgtgacgaaccggttgaaatcctatgcgggttttggcaggatcagcaggatgccatcacgtaccaggaactccgaaaggcagtagcggacggaagcctcagcaaagagacattagaggcttggcaacaggattactcagtgcttgttgccgagagattacagtcaatgtggacgcaggcaatagcagcgggaccaaccgggcaaccaatcctagacggtctcgcttttgagtttagcactcagacacctggcgttctcgactggatcagtgaaagaggagctgagtttgttacccgatgcacagaagaacagaaggacgcaatagcggcactcctggaaaagaaaatgagagagagccatacagtagatgaactagcaaggctcattcgtccatgcatcggtctgacagagggtgacgcaagagcaaacgccaggtattatgacaatatcgtggctacgatgcgaaaagagcatccgagaatgaagattgagagcatccgccggaaggcattggacgcttctcagaaatatgcagaaaaacagcaccgggccagggcattcacaatcgctcagaccgagagtgcttttgcttataaccgtggagccgatgaaggcatacgccaggcacagggcgaagggtatcttggaacgatggtaaagagatggagtacatccggagacgattcggtgtgcgacatctgcaatgcgctggaaggtgctgaggtagatatggactccgactttgatttcaaaggaaaggttctgtttgcaggacaacatatgttaccacctgcacacccgagatgtgcctgcgctatcgagtatatcgaagtggctgcaccgagaggaaggaagtgagaaagtgaagaagttctctgatttcatcaagaagtctgcagaaccgcagaagaaagagcctgccagcaatgtgattaaaggcaggtttaagattgccaagtccgacgacgacaagcacctggcatttggctgggcgaatgtggctatccgtgctgacggagaagagattgaggactggcaggaggacatcatcgagccggaagaattggaaaacgcagcatatcagtacgtgttgctctatcgtgaaggtggagaaatgcacgaaagaggcggcgctgcagtcctggttgaatccgtggtattcacggaagagaaaatgcaggcgatgggaatcccggcaggcactcttccgattggttggtggatcggcttcaaagtaaccgacgaggatgtatgggaaaaggttaaggacggcacatatccgatgttctcaatcgaaggagaagccgagagagtcgaagtagaagatgaaaacaccttgtaaaaatggggcgtattgagtttttcagcagcctcaaccttataattccacatacgagagtgtaataagggcataggtagttcaaattattccgttattaggagaggcaccgcaaaggtgtcttttttaatatacaaatcttgcggaaaggaggaagcaaagtggcaacaaagttaaaaaatctcagaatcagcaaggttgattttgtagatgaaggtgcaaatccggatgctcacattaagctgacaaagagcaaaagcgaaaaggggcagtccacaggagagaatggcgataagaatggttttgtcagccgattgttcggtttcatcggcaaaaaggccggcatgaaccaggaagagatcgacagtgcagtagaggaagttctgaaaggcaactctgttagtttcaacgagcgtttcaatgaaatcaagaacagaaagattgctgatgaaatttgggatatatgctacgcactgcaggcaagcctctgttcgattctgaatgacgaggagctggatagcaccggcgcagcaacagcgatgaatgagagccttgacgagttcactacagtagtgaaggaagcgattagcaactggtccggcggcaaggtaatcaacatcgtaaagagtgacgaggtgacggagagtgacctggcaatgatgaagtctgcggctgcaaggctgaatgacaacatcgagaaggcacagaccgccgctggaaagcctgccggagaaggagatgatccggaggtagacacagaggacaaaaaggaccagggcaaaaagaaacagtcgaaaggagacaacgaagatatgaagatcgacaagagcaaaatgacccaggctgagcttctcattctcgaagatattgagaagagatacggcgtggcagacgacccggctcagacagagcagactccggagggaaaacctgcggtaacaaagtctattgagaagcctgagcagaaccaggaaacacctgcagatggcgaggacatctacaagggactcaatcctgctgttaaggcagaaatcgaagcactcagaaagttccgtgaggatgctgagaacagagaacttgaagccgtagcaggcaagtatgaaatcatcggcaagaagaaagaggagcttgtacctatgctcaaatctctcagagctaccggtggaactgcatacaacgatatgatcgccgttcttgatgccaccgtggaagcggtcaacaagtccggcgttttttccgaggtaggcaagtccggccacggctctgtgcacgtaagtgatgcagagggcaagatcgaaggtatcgccaagagctatatgcagaaagaaccttccatgagctatacggatgcgctggctaaggcttgggaagataacccggaccttatggacgcatacgacgctgaggaaggattttaaggaaggaggaaaagaccatggaaaagagaaacttcaacggctcacagattaaccagtctgtgacaatcgcagagcaggccggtgctgctatcgacgatgtgagaaacctcattctcaaatatgacgagaatggagatgtagtcgtagcaaccgacggaacagcacctatcgtaggcattgcaattattgaggcaggctataacgacatctccggagcagagtccggaaaggttgcaaagggcgaccaggtagatgttcagattaaggacatcggctacattcttgctggcggagccatcaagaagggcgaagaggtaactgcaaccgcaggaaaagcaacaaaggcagctgacggagattatgtgatcggcgtggcgctcagcaatgcagctgagaatgactatgttagagttcagatttccaagtatcagaagaatgccgcaaaataaagaaggaggaaatggtaaatgaaaagaacaacgaaaagcatccaggcggaaatcgcaaagggtgcatttagaccgcacacagcgctttcaacaatggcgctggcttactatcagcaggaaacaacatcttttgcaaagaatatgtttcctgtttgcccggtgcagctgtcctctgacaattactatgtatttgacaaagaggatttgttacgtgataactggaatagaaaaccggcatacggttcagttgacccggcagtaatctcagagcatacagagaactatgcctgccacgtagatcagatgatgatgggtattgataatatccgtcagacagaccttaaccgcagacagggacctcacaccaaagacccacgccagcagagaactaaggtgattgcaacacaggcaaacatccaccaggatgcagagttttcaaaatctttcatgcgcaaaggagtatggaaaaacgaggcaacaggcaccgattccgtgtctgttacatccggacagtttatcaagttcagcaacggaaacagtgacccgatcgctttcttccagaacaaaatgactgagatcaatgaggaaaccggccgcacccctaacagacttggattgggtgtaaacgtctacaatgcgttaaaagtgcacccggcaatcctcgagagggtaaaatacggcggttctactcctaacccggcaaaagtaaatcttaacgtactggcacagctctttgaaattgacagaattgtcctcgacagaactgttcagaacaaagctggattaggacagaatgcagatatgggatatatcggggatccgaactcattcctgttagcatatgcgacagacacaccttccgtcgaggagccttctgcaggttacatcttcacatgggatatgctggagaatggaattttgcttccgattctgaattatcctggcgcaccgggaacacattcagagctcgttgagggtcttatggcatacgacatgaagaaaaccgcagatgatctcgcattcttcggttgcgacgctgtataaggaggttcgccatgaaattgattgcaaagaaacgctgcagttatggcggcagaaaattcttcgcaggggatgaaatcccggcagacattgtgttaaatgtcgagagggaagaaaaactcggcgtaatctcaatcgcaaatgacgaagcaggggtaccggaacagtccggtgccctttattcgcaggagcaggtagacaagatgatggccgatgcagtcgccaatgcaagcaaaggatttacgcaggagcaggtggacgagatgatccagtccgcagtcgcagagcttaaaccgttcaactccgacaatgccggttttaccgtgacagtcaagggcgagggtgacaatgtgacggcggtttcctgcagtgcagaggatattcagtctgtggtcgatgtactgcagatgaatgcggacgatggagcaaaggcagtagccaacgtacagtccgacagcgttctgattttgcttcacgccttagacacacgcgctacggtcaagaaagcggctcagaaacagcacgacactttattctccgctgacggcaattcaaacgaatccgtaggcggtaacgcaaccacagacagcattacggagggagctgatacctaatgtcaaaaggtgcatacacatatgagccgggaaacatcacagagtttggcaaagaccgtatgaggtttgagcttggagacacgatggtagagggcctggcagatacgacggcattgaccgacgaggagatacaagcagcaatcgacgcatacccgaaaaagtggaagcgtgcgaagctgatgctccttgaaagtttgtgccgtcgctttgcatatgaggtcaatacaaagaccggccctctcagcctggatatgaacggcagggcgaaactttggaaagaagattacgacaagctgaaaaaagaggtccaggcagagtcagtgtcagtgccacggtttggaaatggggtagatggtccaccttacttccacaccggaatgcacgaaaacgagagggtgtggaacggatgataaatgcgagatttatgtatttaaggccgggaaacctattcaaggattttgttgtcgagtcaaatacgcaggttgtaacagcgagcggaagggtggcaaacgcaccgaagggagacggctcaaagatcatcagaggatgtcttgctgagtccacaaaggagcagaaggaatctcattcaacgagagaccgtgtttgcacccatacgattgtgcaggcaggtagtccggaagcaaagaagtccgataaactcatactcggaaatcgcacgttttacattatcgacctggacgaggtgggtagcttaggtatatccacaatctactacgccgaggaaaggaaggatgtcaagtgaaactgtggaacgatggaaaagcagggagtgcaggaagtgccataagggcaacagtcaaaggacaggtagtcaaaatcaaccgacaagtcgtagccaggggcgttagggcagtgaatgctatgagaaacgcagaactggaagtgctaaaaggtcagagaagcgggcgaacatatcgcaaaccgcacagcaaagcgacctacacagcttcggcaccaggagaaccaccggcaagacgtacaggaaatctccgtatgcactggaatggccaggtaaagagcgaaggcagtaccgctggtggtggagtccaaatcattgcagagctggaaagccaagagaagtatgctggctaccttgaaaacggaacgaagaaaatggcagcaagaccattcatagacaagatcaaggagaaggcaaccccggaaattgagaaaatttacaaggagccgtatggctaaggaggcatgatatatggcactggtagtagaacagccgatagcaaccttcgatttgagcgagattgccaggggcgatttggcctacggcaagcatcgcacatggccggaaggtaaagccggatttgtaacatcagccaccgagaaggagctgatcgtccagtatcatccgggtatcggcaatgtaactaatcacttccggattcctattgacgaagcagtagacggtcagtgggaaatccgatattcacacgatatgtcagaggttaagacctacggcatcgaagagcagggcactgaggaaggagcgacagagtgaagctggaagaactgattcagaaaaggttcgtcagtacggcaacacttgtagagaggcttacgacctacaacggtgtgcctgctgtttttagtccggaagcgccgggcgacgaacaggaagggtggggcggtgaaacgcagtaccctatggtaacttacaactatgacctgcaggcaaacgaagaacgaaacagcgccggtagtctttcggtatcgatattctgtcagaatacggcggatatattcccggaggacatagcacctatcgtgaagaaatgcctgcgtgatgtgatccttcttccggaaggcggtacgccgtactgctttacttgggcgagaacggatgcgtttactatgggcgaggatgcaggaaaagccggtgttgtaatcggctgtgaagtcagatttgacatcctggaatatccgtctatggagacgtccgatccggacccggtaatggcggttgataagtacatcaaggagttgtacccgggatgcctggttatgggatacgaccggatggaggagataacagaagcctcagcggatcagccggtggtttactgcagactgatttcagctgagaagcaggaagaaacgaatacagtagcttggatggacggtagaattgccgtccatgttttatgtccggaaagcacagtgagattgaagatggcagcagatattgccaaccacctgtcactagacggagaggtaattatgctggactattcgcctatgttcattaagagactgcaggtgaattacaaatctgactacttgaaggaaggccaggtattcatcacaggtcactatggattgcttaggtacaaggctaagcctcacgtgcttatggcagctcatggaaattacagttaaggaggtaaagcatggctaaggaaacagcaactccggcacctgctgaaacaaaggcagaaaagaagccggagaaaaaggcccctgcagagtccgtttacacagtaagcgagcttgcaggcaacgcaagaagcgtattcggcacaatgcaggaatgcgttgtagccgctctgaaaactgacggcaaagccgagtacacagtatcagaggcaaaggaaattgtaagcaagttcttacagaaggaggttaagtagaaatggcaggaacattcattttaggcgaaactaaggtgcgtcctggtacctatttcaacattcagaagaaaggcggaaatgccgctgctggcgttatgaatggtgttaccgcagtaatcttccgtgcagatttcggtcctctcaacgaggcaatcgagttatctgcagaggatggctacgaaggaacattcggtaccgcacttactacggatgcaatgaaagaggcaatcgccggtggcgcaaagacgatcatcgcctgcagagtcggtaacggcggcactcagggcagtatcaagttgcaggacagcgaaagcacagatgcagtaagcatcacagcaaaatatcccggagcaaaggactttgtagtaacagtccgtgaaaagctctcagacagcactctcaaagagtgcattttttatgccggtacaacagagtttgagaaggtggaatttgccgccggaacagacgaagctaatgcccttgtggatgcactggcatcttccaggaatttcaaggcagaggttatcaaatccggcaccgtaacattacagaacgtgtctcagtcccagtttacaaagggaactgatccgcaggtaacgaatggggactactccaatgcgtttaagcaggtagaggcgtatgagtttaacacaatctgtgtcgataccgaggacacttcggtacatctgcttctgcagagcttcatcaatcgtatttttgatgcggcatctcttacacaggcggtcgttgctgagaagcacacggtagacctggaaacaagggaagcacacgccgcttcattcaatgacgagaagatgcactacgttctcaatgcccatgtgaatgagcagggtacggagatcgacggttatcagactgcagcacgtattgctggtatgatcggcgcagtagcggcaaactcttcgctcactcatacagtagtcagcggcttctccgagatcaaggaaaagctgacaaacactgaaatgattgctgcagagaagaaaggttgcctggtactcagctataacaaggctaagcaggtgtggattgataatgcaatcaataccctcattacgccgaaggacaaccaggacgatggctggaaaaagattcgccgtgttaagactcgtttcgagcttatcagacgtatcaataccacctctgacaacctggtaggcaaggtagacaatgataccaacggtcgagcaactgtaatttctcagctgcaggcagtcggtgatgcaatgagagaggaaggcaagctggtagcctgcacagtaagcgagagttctgcttacacagcagacggagactccgcatggttcgacatcgatgtgatcgacaaggattctatggagcatatctacctcagctttattttccgtttcagcaccaatgagtagaaggaggtaaaaagcgatgattagaaacgagagagccgccggtgattcaagacacgcacgtaccggtaaggacggagcgttctacagcgaggacggcgttttacttgcgaccgttgatacgttcacttccaacgtgaactacaacaatgctaagtacagtgtgcttggagatgcacaggaacatgagacagccaacacatttgctgtcagcctcacgatgtctcagatcgtagtagaggacgaccagttctttgtagaggtcatggaggcattagagactcagatcccgccgcactggaacttccagggttcacttctcggacgtaatggttctgaggagcgtgtggtttacaaggagtgtattccttccggacagattgacattcagaatgtcactgtcggcgatgttatcaagagaaactggaacttctttgtcaacagaccgcctaagttacagtcgttactcggcgtagacagataaggagtaccacatacgaaaccagtaggggagccggagcggttcccctttatttaatcaaaaagaattggaggacattcaaatggctaaagaatttgtaaaaggcgtaacagtaggcgaggcaacagctgaggagaatactcagcctgcagtaagtacagtggagacaaacgaagaggaaacaaagcaggtaatcagagcgaatgaggaggacttcatcgcaggtctgattgcggctgcagatttcgcttccgatgaagaggaaacacagagaattgagattgtcagaaacggcaagctcgcttttgcattctctatcagacctctcggctcagaggagtacgacaagtgccgtaagaaatttacaaagtatgttcgtaataagcagctcggtatcaagatgccggaggacacagaccgtatcaagtaccagtcagcaatcatccacaaggcgactatcgcagaggatagagagaagttatgggacaacaagaaggtatggcaggcgcttgaaagcaaaggatttcagattatgtccggcctggatgtaatcgagtacacccttaaagcgggcgagaaagaccgtattattgatgcgatcgacaccctcagcggctacgagagcaacattgaggaagtagcaaaaaactaattgaagccgggggcaagatgtgcttgttgcatcacatattccaaaagacaggaataacccccgatgaattttacgagaaaccgaaaggcgtgcaggcgttcatgcttgcgtctatgcggacaaccctagaatcacagaaaggaggtaatgacggtggcggaaacacttagaatcgaaattcctattgagacggtcgataataccgatccgggagtctccaatgctacgaagaaattcgagaaaatggaacgagcggccaatagtgcgaatagttcagccaagaaagcgagcgacacagtttccaagtttgacaagcaagctcagaaaaccgaaaagagcctggcaagctgggcgaaagaaaagtacgaagtcctgcttgaagcgaaggaacgaatcagtccggtactctctacgctgggtaatgggttaaggagttttgcagggaaaacgtggagcgttacaatgcgagcgattgacctcataacctccccggttcgagggatcataaacctgttgaaaaatccgattttccaagtcggagcggtcctgggagtcagtatcggtctgaaagacacgatagagacatacaaggacttcgaggccgcaatgtcacaggtccaggctataagcggagccaccagcacagagcttgtcaaactgacgaataaggcgaaggaaatgggagcaaccacgaaattcacagccgaagagtcggcgcaggcgtttaattacatggcgatggctggatggaaaaccgacgatatgctgaatggtatcgaaggtattctcagcttggcagcagcttccggagaagatttggcaacgacatccgatattgttacggatgcgctcacggcgttcaatatgaaagccggtgatgccggacacttctcagatgttttggcggcggctgcatcaaatgcgaacacgacagtctccggaatgggcgagactttcaaatatgcaggctctatggcaggatcgctcagttactccatagaagatgttgcccttatgacaggcttaatggcaaatactggaattaagggaacaatggccggtacggcactcaactcaatattcacgagattatcgacgaacaccaacggagcggctgatgctatgaaagacttaggcatcagcttttttgattccaacggacaagccagggatttatccgatgtgatgggtgagttaaggacggctacggcaggtatgacagctgagcagaagtcaaacctggcaaatacaatcgcaggaacacaggcacagaaaggtttgcttgctatcttgaatgcctcagaagaggactataacaagttggcagacgccatcaacaatgcagacggagcggcagcgaatatgtctgaaacgatgatggataacctgcagggttctatcacgttactgcagagcgcagtagacggagtgaaaatctcatttggcgagagactatctccatacgtgagaagcctggcagactggcttaccgatcagatgccagcggttgaatccggtcttgatgaaatgatggactgggtagatacaaaggtggaccgcatgaagaagaaattccacgacttaacagagtcggaagaatggaaaaacgcagatttcctcggcaaggtgaaactgagctgggatgaatttattgctgatccgttcaaggagtggtgggacaccaaaggaaaagcaaaatttgctgatttcgccggagacatcggaaaaggcatcggcagcggaattaagatcggcgttatgacaatgctcggtattgacatctcggaaacattcgacgagggaaccagtatcggagcgtcgttcgccaaaggcttctcagagggatttgatttcgatgccgtatctgcgaagttgatggacggactcggtaatttggtatcaaatgcgggcaaactgcttccgggcggtaagtctgcagatttgtcgtctgtattctcagcggtattgctcggtaagattgccagtccgtttatcagtcttggcaagggagcaatcagcatgggaaaagcaggaaagacagtattaggttcgggaaccggagagatgggacttggggcagcaatgcttggttcgtctgcaatgggtaccggacttctcggaaagtcggcaatgctggcaatcaacctcggagcaggaaacctggccgggggagcatcactaagcgcaggagctttatctgcagtcggaatgggtgcaggagcaggagcgattgccggtggtgcaacgctcgtaagtagtgcaatggatttgtataaatctatcaagtccgacaataaggacgagaaagccgcttacggtggttcagccgcttggaaagcaggcggcgtagcagctggtgcggcggcaggtgcagcacttggttctgtaattcctggtcttggtacagcggtcggtgctttaatcggtgccggtgtcggaggtatcgcaggatggatcaagggcaataaggtcaaagaagagtaccaggataatgtcgaagaaatgcagaaggaagccgagaaagctcagaagattttccaggcaaccggtttgtcaatcgaagatgtacgatttcagaataaggctctgcaggacgctatgaacgatagcgaggtttctgcggagcagttttcagctatgttccaggaagagtgcgaaaacgtggcaaagaatgctttcggaaagattaagttatccatggaagaggtcaagagtattgcaagtgatattacattcggcgatatgacggacggactgaacaccttcacaacagcaaccagcgacacacagcaggcacttagcgacctgcaatcatcagtatcgaccttgaaaaaggagaactggaaagtcagcttaggaatgaaactggatgaactgcagaaggacgattacaagagtgcaatcgaaaacttcatcagcgacagccagtcctatattgacaacaaccattacgaggcgacagtcgctttgaaactgctcactggaaccgacgcagacaccagcggtatcgacagttactacggcagtatgaagaaacagctggacgacttgggaaaagaactcagcggaaaagtggatattgccttagaggatagcgttatcagtcttgacgagtctgcagaaattcagagcttgcaggatcagatttcggctatcacaggaaagatttcgcaggccaggacggatgcggaatttgacacattgaagattaagtattccggcgcagagctggatatggatagtttcaatgctttgcaggaagagctgcagacgcaggtaagcaatgcgtcggatcagtacgagcaggcactcacgctcacgctcacaaatctgaacctgcagctggcagacggagctatcacgcaggaagagtacgatgcggccgtgaaagaggcgaccgatggctactacgcccagctgaatgagattaacgcaagagtatcttcgttcaacctggaaacgattgccgaggcgtgggactcctcacttcaaggttatatgccggagattgagggaagcacgaaggagaagttggaaacagctttgaacaatgcgttgctggcacacccggacgtacagacttggactgcagctgatgtggcaagctggatggggttagacaagctcaatctcgatacggcagttcagacggacattgcgactcagattttgcagacggcacttgcggtaccggatggcaccaaagagaagattatgcaggatttcaaagattctgtaccgactgcagaggaaatcaaggaagcaatcgactgggattcaatgactaatgaggactggacggaacttatggagtctatcacaggcccgacggaaggcgagtcaatcggcttgaatacagaggatctgaaaaagaagatgtcggactactacggcgagtatttcgagagcgtcaaaacgtcctattcagaagcacttcacaacgccctggagaacagcggtagtgaagaaacactcagcacattcatgcaacagtatatgcaggatcagatggccgattttgatttttcaacggtcatggagaattacggtcctatctcgaacgagtattttgctacgctgcagtcagagtggcagacagccggtacaaatctcggaacatcactcaacacgggagcgtcaacgagtcttaccaatggctcggcgggattgagaaccagcctgcagacctctcttaatacagcaacggcaagtccgttcagcatcagtccgacggtaaacgtaacaccgaagtacaacctgttgacgctgccgacaattccgacaacgacatccacaccggcgaaacacgctgcaggtggtcgagttggtggcggtcctcagctgtcatggttggcagaggaaggttgggacgagtttgttatcccgacaaatccaagccgaaggacaagagcacttgaattgtacgagcaggcaggcgaagcactcggcgtttctaagcacgcagagggcggtcgtatagaaggctcgaatttgagcgatatggtatcagaccataatttattcactgaggcgacaagaaacgcatcctatggctataacgaaaccacagaaggtaattatgaggacaactcagcagaaacatttgctccggtaagttcagaggttccgacctctacaccacagaccggtccgatcagtgtaaatgttgcggtaagcccgaatttccaaatcgaggcaaaggaaggtcagagcgaggaagatattgttgccgtaatcagaaggcacttaggcgagatcgcagacgaacttggcggaaacatcgccgacaagttgagtgaggtattcgccaatatgccagtatcaagcacgaaaggagcgtaggcgatggatattaaactgattccggtggaaaagggttcaaagtttacgttcccggctctacccgaaaaggtacagggcaaatatgcagccaagtaccaaagttttgacatcatctccctgggtaccgtaaaggtacctaaggggacggatgtttcagagttttcgtgggacggtgtatttttcggagcgtcaaagaagaatgaggcaatcgtcaaaacgaatgcctggaaaagtccaaacgagtgtgtgaaaattctgaatgactatatgttgaatgagacagtgcttacattgatcgtaacggaaacgtggataaacgtggatgttacgatttcttcatttcagccgagaccggttggagcgtatggcaatgtcgagtattccattacgtttgtgcagaagaaaccgctgaaaatctacagcacaaatgaactgaaaattgcggcgtttgtaaggaaaacgaagccgagagccagttcatcatcgagcggaggcaattatacagtagtctccggagatacgctgtggggcatcgcctcaaagaaaatgggaagcggcaccaagtggacgaaaatttacgacgcaaacaaggatacgatagagtccacagcaaagaaacacggaaagagcagttcggatcacggccactggatatggccgggagaagtcctgacaatcccgggataggaggcacgctatgattgatttggcgaaaatccagtaccgggtcgtggttatggacgaaagcaagaaccagtacaacattaaggagtacattgaaaacctcggatgggaagagaacgacggcgagttatccgtcagaacctcatttgtggcgaagaatgataagacatccaagggttatctgtcgaagataatcaagccggggtgcctggtcggagtattcgcaacagacggcgcttcccaggacgaggaagtagcacgagggtacgtggaaacgtggaatccggttgaaaagagcggaggacatacgctgaaatgcacctgctacgacgagctttacaagctgcagaagagccaggacaacagatatttcccttccggaactggcacaaagtcggcgatagaagggatttttgatgattgggagataccgcagggatcatatcaaggaccgaatgcttcacacggtaaaacagtggagaataataagtatctgtcagacattatcatcaatctgctggatgatgcagcgaagaaaggcgaggagcaatgctttgtgcaggccaggaagggcaagacatctgttattccgagaggaagcaataagacggtgtatgtattccggacagataatacgcagatgttcagtcagagcataagtacagcagatatgattaccagggttaaggttgtagggcaggcagacgatgatggaagaaccagcgttgaagccacggtaaacggcgaaacaaagtacggtattcgtcagagaatttatacgagaggcaaggacgaaagccttgcggacgctaaatctgcagcgcaggaaatcttagacgatgaaggaaaaatcaagaaggagatcaaagtgcagtccccggatgttccgtttgtccgaaaaggtgacctggtgtatgtaatgagcgaactggcccagtcgtattactacgtgaagggcatccagcacacggcagacacctacagcatgacgatggatttggagcttgcagaaccaaagaaggaaaaggcaagctctgagaaaaagaaagattacaacgtgggcgacatcgtgaatttccacggcggaacccattacgtgagcagctacccaggctcaaaaggctacaaagccagggcaggaaaagcaaagattacgattaagaacggttccggaaaagcgcacccttggcatctgatccacacggacagcggaagcaatgtgtacgggtgggttgatgacggaacctttgattaaaggcaggtgatatagatggaccaatttgacggacacccaggaacagcaaaactggcacaggtgttagataggcgaacctcgcagaaaacagagtctccgttgactttggactttggagaaatccaggcgaacggaagtttgaaaacgaacacattcccggtgccgataccgaagggagactacacgatctgcaggctggctgcaggattaacactttcaacctcggaacagagctggctcaacaaagcgccgtcgggtgttcctcttcacagccacagtgtaacgataccggcagtgaaagcaggagatcgagtgctggttgcctggattcagagtgaagcagtcgtaatcgatgtgatcgagaaatcataaaggaggcgaggcaaatgtcacagccactatttccggttgttgaggtaccggattttatctcggaggacagccagtacgacactcagtacaaaaggagtatgaagtgggacccggaactgggagacttcgtgagagatggggcgcaccggatcaaggaatgcgatggcaaagaagccttcgccatttggtgttttaagattgcacagacagagcggtaccgctgtttggcgtaccccgattcaatcggtaccgagatggaacgtgccatggataatgacgatgaaaaaactgtcgagtctatggtggaaagaacaatcacagatgcgattatggtaaatcccagggcagaaaatgtccgggattttcaatttacctgggaaggcgatcagatgcacgtaaccttcaaggtaaagggtagcaactgggatgaagaaatagagattagcttgtaaaggaggcggagagtatgcagccggaatttaacagaccggagttcctggaaggaaactcggcagaggaaattcacgagcgaatgatgaacaacttgccggacgacatcgacgatatgccgggtggttttccgtatgatatgacaatgcctgcagcattggaaaaagacgaaattatcaatttccatatcgtaagggcactgatgattgcgtttccggaatatgcctgggatgaatggctagaccttcacggtcgccaggtgcatcttacaaggcacgaagcggaaccggcttttggctatgtgaaaatcacagctgcagaaggaaccgagattttatccggaacggtattctgtacggcggcaaccgaaaccggcccgtcgattgagtatgccaccacagaggatgcggttgttggaagcgaaagatcagtgcttataccggtatcagcggttgaagcaggcacaggttctaatgtagcggcgaatacggtcgtgctgatgatggtacccgataagaatgtgaccgagattaacaatccggagcctattcgtggcggtactgaaagagagacagacgatgatttttacgacaggatcgccgcagagtacgacaacagcatgacctacctggggaacgatacggactataagagatgggcgaagcaggcaggagcaggagatgcgatagttattcctgtttggaatggtcctggcacggtgaaactggtgctggtagacggaaacggaaaaccagccaatgcaaagctagtgcaggatgtgtataactacatcgtttctccgaacgacaggtcggcaagattgcttcctaccggaacagcagaactgacttgtgcggcagccacaacggttgccgtaaattatgttattacaggactcagctacgatgaaacaactggcatcgagcaaattaaggcagactttacggaagccgtgagagcggtctatgcacaggcgaaaaccgaaggagttctgaggtacaacgacgtaagaccgttgatttctgcaatcgcaggagtcgaggactttgaaacattcacaatgaatgggaaaatgcagaacatcactctgaaaagcgaggagtacccggacaccggtacccttaattttagttagggggtgtgaatgtggaaaagtttgatttagagaatttcccggtcagcgagagcgcgaagaacatgatcgcctcagtgtcagatggcttttacgacaattcctatgttggaaagtggttgtacgaggttatgggccaggagtacgacacggcaagagaaatagctgaggatattctgaaccagctatttccggaaactgccacctggggattgatgtaccatgagattaagtggggactgccggtgcgagaaaatcttccatacgaggagaggcgacagctgatttaccggaagagagactatcgggcgccaatgacaccgtatcggatggaagggtacttaaaaactgctaccggatttgatgtacgaattgcagacatcaatgatcctggagattatggttttgtggcaccacacccgaatgtgttcaaggcatacttcatgggtgagggaacacttgcatcgaagcgggcgagagccatgctgaatgagctgaaacagtcacacacgatgtttacaatgaatgaccgaaccgagatcgtatcagacaatcggaacttagaggagatgaatctgaaaaaggtaatcttccatatcgcagagtcgttttggtatagcgatctgctggatggaagaaaactgctggacggttctagccttctttatccgtatatgagatacaatctgatgcttggttttaagtatatactcggtggttttacaaccccgacagacgcagacctgcagaaggtaaaattcagagcaaaacaggaaacagaaaatgatgtcaaggcaggagcaatccggatcgcctcggacatcattttttggaatacgcacctattggatggttcgtgggatttggacggctcacacaggctcgatgttacacgaggctatcaactgggcgttgcaatcgttgcgatggttgtcttcgcccataacgaggtcacagacgtattgaaagtacgaagtgcttatgacctgcgaacgggttcagatgttcgggcggcaatacgctcggagttcgaggccgacttttggaataccgtctatttggacggaaaactgttactcgacggaaatacgacgttggagtacagaggcggtaataaacgacttgaagcatcagttacacaccacatgggaatcaaaagagaagattcggatgtatcggtgcaggtcattaccaaaacaaggaattactggtttttcgatggcagcaatatgctgaacggtaagaaaaatcttaattcaatttatagaaaggagtatatccaatgagtacagaaaagagcaaaaacgtggtgatcacgaagaaagccagggagaacctggttaaggcacgtgccggagccattacgcttccaaagattatcggtatggcgtttggcgagggcggtgtaaacagttccggcacggtcatcgcaccggcggaatcccagtctaggctcaataaggaattgttccgcaaagccattgatggttacacattcccgaacgacacaacctgcagatacgaatgtacccttgcagagagtgaacttgctggaaaagagatcagcgaaatcggactgtatgacaccaacggcgacattgtgtgcatcaagacctttaccaggaagggcaaggatgatgatgtagagcagacatacgtgcttgacgacatcttctaggccaggaaggaggcaaaacgtgaagaattacacaccgacaacgagaaatttttctcagtccgtgccgaatgttgaggttacggacacgaaccatgcagacaacatcaacgcagcatctaaacagctgattgagaatgacaattatctgaaagacagaatggatgatgaaggtttttctctcgtggatggtgttctgtgtcagacatttgaagaataaggaggcatacaagaatgagtaaagtaacaaaaccggtagtgctggacgaaacagcaaagcaggttgtagctcagatgcagttacagaatgagattttaacatcacttgccagcggcatcaattataagccgacatccattaaggatgtgcttaatgttgtgcgcgcaggccaggcaagtaaagtgttccaggtgggcgatcagattatcgttccttggacggacatcgcaacggggcagaaatacgatgtaccgcttgatattgtagcttttggaacatcagcattgcaggatggtgaggaacttccgagcatgaccgtacagtggcactatgctacaccgttcggggtgcagttcaatcagtaccaggcgtttttctatgcgacagaaggacttgctgcaggaacgtactatattgagattggcactacatggggtgacaaaggatattgcgtagccggaaaaaaataccagtttacgctcacaaagcctgtgccagcaggcggtcagcttgccggattcagaggcgcaccggatcaggcaccttctacttggaaagtatattcatacaacagtaagacggcggtggacgctattgagacggtttcggtaacagaaggaagttccggaacaagcctcggcgtcttaaagttcggaggagacggaaaactcaactgcttgcagagaacagcatacggctacaacagatggtcccagtcagcaatgaggcagtggcttaactctgataagggagtaggcgagtggtggactccacagaatgattacgacagatgcccggatcagcttacagcaaaggccggcttcttaacaggttttggcgcagatttccttgaagtcctcagaccgacaaaggttgtaacagcgctcaatactattacagacgctacgagcagcaactcagttgatccgctcgaaacaacgtatgacaaaatctatctgcctgcgttggagcagatgtctattgagcctcagctcgctggcgaaggcaccacatgggactattggaagagagcgtccagcatgacaacgaagatgaagcagtatcagacataccctcagattcgtacatttgcgattgagaatcacacttcaccgcagtacgtccgcttgcgctcggcttatcgtggcaattcgtgctatacgtggtgcgtgtactctagcggcaacgtcagcaactacggcgcgtactgggccattcgctgcgccccggcttgtgatttctgctaatcagcaatcagtaaatcccggcacccacggatgccgggtataatttcagagaaaggaggaacatagcgtgtcagtaccagttggagaaagaagagaaagcagactggaagtattcgtgcaggcgttggacttagtaacttacactctcagaatcacgaagaacgagaaaatttttcttccggaataccaaagacaagttaccgacgacattatcgagactgcaaagagtatctacatcgatgcttgggatgccaacaatgttagggtaacgacgaaagatgattggagagcccgcagggagcttcaacttcgtgcggccagggaatgcaatagactcctagctctgatcggaattgcgaaatcctcgtttcatctcaaaaataagcgagtcaagttttggaccggtaaggttttgaaggttcgaggcatgatccgcagttggaatgaaagtgatagtaaacgctactcccaaattgcggagtagtttttattatacggatgtaggctaaacgcagaacgtccgcttgcgctcggctaatcgtggcaattcgtacaatacgtggtacgtgaactctagcggcaacgtcaacaacaacaacgcgaactgggccaatcgctgcgccccggattgtgtggtattaaggacataaaggctattccgtaagaatggcgctccaaccaatcaaacacaaggagcctgcatccggccgtaaggcgaacaacactgtagcgatgcggtcagccggagaacgactgttacccgctgtcaacgctatggacctatctataagttttatggatatggaagaagtaatcggctttgaagccttatatgattcgatgcacaagtgcaagaaaggagttatttggaaagagtccgttgcacattatgtattgaacagcttggaggaaacatacaagctcaatgagcagttggaaaatggaacctacaaggcaaggcagatagcaaaattcacgataaccaggccgaagaaaagagaaatcatcagtgtatgtttcagagaccgcgtttatcagagaagtttgaatgacaacgcactgtacccaataatgacaaattcgttcattcgtgataattgggcctgccagcgtggcaagggtaccgatgatgcgagagacaggatgaaactatttctgcagaggatgtaccggaagtacggtacagaattttacggtctgcagatagatgtgcatgggtattatccgaatatgcggcacgacttaaccaacgcaatgttggaaagaaagttggaaccggaaatagcaaaacgagccattgatgtactcgacggacagtacgccggagatgttgggtataacccaggaagtcagatggttcagattgttggcatatcggcattggacgatcacgaccacaaaatcaaggaagaattggatgtggacgagttcggaagatatatggacgattcgcttgcgttccacccttccagggaatacctggaatactgcagaaaggtgatcggcgagatattggctgagaaagggttagagttcaacccgaagaaaacgaaggtattttgcattacagacggtttcacatttttaggattcaagtaccggctaacagataccgggaaggttattatgataatcgatccgaagaacgtcaaagaaagacgtcggatattacgaaggctggtgagaaaagccaaaagaggcgaactcaagaaggctaaggtagacgagtgttattacgcttggagaaaccatgccagcaagggcaatagttttaagctcctgcagcgcatggataaatattataaatcattatggaggtagccaaatggaagtaaagaagaacggcggcgatgtcgccaaaatgagagctgacgagaacatgaaggctgagctggccgatcagaatgccaagattgattacctggcaatgatggcagacattgagttcccggaagcaggagactcagcaaccagcaccgaagaaagtgaggaagagtaatatggcaaaggctaaagaagtaacagaagcagtagacacatctgcagaggagacgatccaggaagaagtgcagcacagcgactggttctacaaagtcaaggactattacgacacaaagagatggaacctggttatggtaaagaacgctgtcaagaaggacaagattaccgaggaagaatacgaggaaatcacaggtcgtaagtataaggcatgataccctacgcagaattttacaactatgaccgcctggaaagcgcggccgtagagttaggcttgctcaataccgaggcagacgaagagaatctgctgaacctgcataatcagttggtgtggcatctgtaccggttcgataagaacccacgtgcggatgccattctttatgcagtaatagaggccattttgggtgaaaaggcggcagatattacggacgtaccgtgggaactacggtgcgtttgggaaggaggtaaaagagccaatgtctttgaatgaaattcttgcaagtggtggagcgctactgctgttcttgacactggtgcagattacgcccatcaaggtaaatccgtggtctgcagttggaaagattatcagaaacggcatgagagccatcggaaagtcgatgaataaggacgttatggataagctggaatcagtgcagaaagagttaaaagacctgggagaaaagcacaacaagctcgaaaggcgtatggataaagatgatgcggacgaatgccgtacaagaatcctgcgatttgccgacgagttgagaagggatgtcaaacattccgaggagttcttcaatcagattttggatgatatttcggactatgagcgttattgcgcagagcatccggaatacaagaacagcaaagcggtaaatgccattgccgagatagacaaagtttatcagaagtgcatggaaaaaaattcatttttataacaggaggaaaagaaacatgaagaaaattgattgggttagaaaactcacaagcagaaagttgtggactgcggtagcgtcattcgtatctatgatgatcctggctactggcggtacggacaacacagcaacacaggttacagcactcattatggcaggagcgtcagtggtggcatacatcatcggcgaaggcttgaccgattcagccaacatcggctcaaacagtgaggacgaggagtaatctgagaacatattgtaagcacagggcggtcgaaagactgccctattttgttaggaggaagaaccatgagtttagtagttggaagcgcaagaattgacgagaacggtcacatttcgggaggaaagccgggagatcagactggaaacgaggtatcaacccaggcgtattacgtccattcaaaaggctggtactgtctgagaccgaagagcaccacggtagcaaatgccattgcggaagctatgctgcagggatgcagaaacaacaatatcggatattgtcaggggcacaggagcaatgtaatcgaacagctgagaaaagccggaaagctcgcaaagatttctgcaaaaacagaggcagactgcagttcactcgtgagagcgtgctgcatccaggctggttttgatccgggaaatttcaacacagcgtccgaggtttcggcattgaaagcaacaggacagtttatggaaccgattgcggtaacttccaaaactgaactgttcaacggcgatgtgcttgtcacaaagaccaaaggacatacagtggttgttgtttccggaaatccgagacgtgtaaacgcctattaccctaagtataaaggggcatcgggttctatcattacggcgcttgctgcagtgggcgagaaagacacatcaaaggcgcaccgggccaagattgcagccgcaaatggaattacaaattacgcatataccgcagcgcagaacaccaagatggttaatcttctcaaaaaaggaaagttaatcaaagcgtaagttctgaaaaggcatcacatcggggtggctgaaaagctgccccttattttgatttaaggaggagttttctatggaaaaactatttggtattgatatttcacactggcagggagatatgagcatcgagcaggccaggaacgaaagaggagtgagatttgctatcattaaagctgcaggagcagatgatggcaagtacaaggatagcaagtttgaaaattactatgcacagtgtaaggctatcggacttccggtaggtgcatactattacggtaatgcaaagtctgttacggaggcagaacaggaggcagaccatttcctgtcagttattgcagggaagcagtttgaatatcctatctactacgacgtagaaggtaagatgcttaacaatagcagaggtgtccttacggatattgtaattgcgttctgtgacaggtgcgaaaaagccggatattttgtcggagtatatacatctgattcgcatttccaggcacacgtagacgatgatcgcctgcagagattcactcattgggtagcgagatattcttcaaatgagccggtaacagttcacgatatttggcagtacggaggagagcataactacattgctgacaagacaatctgcggaagaactgtggaccaggatttttgctatcgtgattttgaaacagaaatcaagaaggcaggactcaacggattttctgccagcgcaggagatgaaacgaaggagccggaggtttcagaaccggaaggcagtaccctcgatctgctctacagaacgatgaaagacgagttcggcggtggtgacgcaagaaaggcggctctcggtagcagatacaatgaagtgcaggatgtgatcaatcacatcgacaaagcatccgtgcaggagcttgtagacgaagtgtgggccggtaagtacggtgacgatgaagtgagaaggaccattcttggcagtagatggcaggaggtccaggacgcaatcaacgccggaaataagaagtattacaccattaagagcggagatacgctttccggcattgcagcgaagtatggaactacagtcaatgcgattgctcagctcaacggcattgagaatccgaaccttattatcgcaggagacaccatcagagtaaaataacaggaggaaacggtggcattatgaaaaactacatcggcgtgaaaattgtaaaagctgagccgaaggagaagaacggagtacctgggtatgccgtgaaatatccggatggttatgtatcatggagtccgaaggaaacctttgaaaaggcgtaccgtgaattggactgccaggatttcatcaattcagcagagtaagcaagggagcctatgatccgcaggggttgtaggctctttttttattgcagaaaagcggaacaagaccgcaggtaaaatcaatatacaaaataaccaaaatcagaccgggtattttgacgaaaagttcccgagacacgataggcgattttagtacctatcctatgtctaaagactaaaagccggtatcgaaccgtgtacgaagtcatagagctatatgttttcagaggtgtaattatccacattatccacacgcatttgtggataaaatacgcttttgagagtacgcaaatgagcatatattattctatctctaatatctattatctaatctctaatatctagtaaagaatccttgtagaaaccttagaagaaatcatgtaagaaatcttacaatgcaccaagcaaccatgcgggtttatggtcctcgcaaatgaaaatagggagtaatgcaccaggtagcgcagatgatccggaaattgcagaagttctcgtgagtgcgaaaacattttagcaaaaactcgtaaaatagaagtatatctattgacaaatacgcaagtgcgagttataatataaccataatcaaacaaaaccatttgattaaatccgaaggaaggaggaattaccagttgggtaagaaaggtaagaagaaagacttttccacaaaggaaaaggaactacttgaaatcgaaaaccttaaattacagaagagagaaaagcaggccagcataatctccaccatagtaatcatgattgtgtcagtgattacggcaattctgaaatggttaggtttgattgattaagtagttcccttaacggtcgggaggcagcaacaccgcctctcaactgttaagtctatcataaaggaggctgatttggcaatgaagaaattgagacagttcctacagtcggtgttgttcatcaactttatggtcggcatatacgacggtatgagagcgaagaatttggtggcaattttgataaatggagtagtggtactggcactgatcgccggagaaaagaaagagaggtaaacgatatgaagtgggacgtaaaacacgatagagcaaagaaggtattaaatcatttcctggataatgcaggatattggaccgagacagagagcttgacagaaggacttaccgaggatgaaatccaggaagtaagcgcagaggtagcaacgatgattcagagcatcacaaagagatacaagctggatgttatgcttcctgcagagccggtagtcaaggatgaaccggcggtcgaggagaaagctgaggagccggtggctgagagacctgcagaagaggtcaaggaagaaaagccggtcgaaaagccgaagagacgtggcagaaagccgaagaaagaggaggttgcgtaggacggcatacgagagaaagacaatagacacctgggagctgcagttaaattatgggtacggatgggagtacaccttgaccgaatacacaaagaaagaggcaagggagaggctgaaagaatacagagagaaccagccgcagtacccggcacgactggtcaagaagagagttagaaaggaggcgattgcgtgagcacagcggcaaagctgacagcagagcaggttgagaacctggcaaaggagattcgagagtttctgttggagcatgggttatggcaggacgttgatatttacttcaacggaaagaagtacacgagttacgatccggagaacggaaaatattattacaacgacagggagcatctgatcgaagtggcagaccagccggagagacattttgaatatgttaatccggaacacattctcagcaggagttttgaaggaccggtatgtgagatgctgtactacggcatccttccttcggtcagaaaagaatttgacaagatattcgagagatacggcttgtattatgagttcgggcatcactggaatttcagttgctattacatctgagaaaggagaaagcgcaatgaatattggcgtggaagtattaaaggaaagcgtaatcagagtgcagtcacagttaaatgactggatggattgcgtgtttgttgtaagcaaagatgatgaagagaaggcgagagaggtattggagaaagcctgggacagtttttgggaagatggagacggctggtgctacggcaattacctagaagataagctggtaaatgccggtattgcattcgatgcgtactacgcagatgcggaggaatgaggacatggaagaatacaaggacatatcaagaggcttgaaaacgcttctcgacaaggcagaagaaatggggtggaactgggaagcctacattgagccggacagcagaagaacctatgttgaaattgggcagtcgtcacctgcaggcgaagatttctccatgacgattgatttcgatgaagagaaccaggcggatagtttcaaggacagcctggaatcctactacgaagatttcgacatcgacgagcatattgaaatgtggatagaagccaagagaagcggaacgagtggagttccttccacaagggagcttgtaaaggatgcagaagccattgacggcatgatattggaactgtcgcaggccttgcagaaagtaaacatcccggtactggttggcagttacacgccgccggatgaaaacggagaaggcgagaagatcgtccgtgagttctacggacaggggcatatcttcaaagacgaagatgcgttttaccacagaccggatgatccgtgctacatcccggaattatccgatacggtgtacacgagaaacagcatcctgcaggagtgcaaccagcaggacgatttggcagaggaagttttcgaggcactggactggcagcacgtaagtagcttgctggaagattggcagagaaatggagagttagatacctgcaaagaatgcggaaagatgtttaactgctacggagtaacgaagtgtccgtattgcggggcagattatgaaggaggcgatgaataatgggttacacctggttgggaatgcgaaagctgacctgggaagaagttctgcagagacacgagaagggcgaactggccggatgtttcagactgtacgacgacaacagcgaggctatgatcgacagaggctatgactatgcaggcgacatcctggcacaccacaagaaaggcggtgagttcggagaagatattgacacagtagacctggaactggcagacggaaagaaactaacagcaccggcggtcgtggatgtatcggcactcggatgtatggatgagctggaatatgagttgtggcacgtgatcgaggactacatggttcagttcggtatcagaacgcaggacgacgaaccggactgggcgacagtcaaggcggtgcaggaaagcattttaacagcgtttatagacgcaggcgtgaattttaagtttggatatgaagaaagagttgcgcaagcaataaaacaagcgagaaaggacgaagagaaggtatgagaagtgcaaaagaaattatggagtcattggaaatcgcaaagggattatgcgaaggaaaaacaaacgagagctggaatgctagaaaagccggcagagttatggcagaactgattgcacatttcaagaaaaaagagatagaggagcagtacgacagggttcagattattgcgacggttgttatatctaaagaggacatagacgacatcatggtgtcagcactggaaggtggaattacttactgggttgataaagtagagccaaggtgtgggatagagtttaattttgcaagcgatgttatctcaaaaggcggttcaatcctcattcacgataacgaggaagatgcgacgtatgaattaacaaaggtgaaactcctgcagggaattagagcgtatgcagaacagcctaagagcagtgatattttcgaggtgatcgatcatgaattacatattgattgcggtatggtagatgcggaggttgcggatgcaatcattcagtacgctttgtttggagaaataatttacggttaggaggcgagactatggcagcattagtggtatttacgttcttggtaatcgttggagttggaaacagaaagtaggtgtaagcggtgagtaaaggaatagtgacagactatccggaaatctgtttcatctgcggcagaccgtcggaagctgagcatcatttggtgttcggtaccgccggtagagaactgagcgagaaggacggattgaaagtgccggtatgtaacaactgtcacaatatgggagaaatcctaatgagaatacacggaaacccgatggcagagagaatgtcaaagattatcggacagctggcctgggaaaaagaatacgccctgcagaaggcagacgaatttgcgcgaataatcgatacggatcggaaagaaggcgaggtaaagcagattattcacaagggcggcagggagaccttccgaaagaggtacggctgttcgtatttgtagaaaggagcggatcagatgttaggtggaggaccatacgaagcgaccacctgcccggaatgcggcagtacgatgtggaatggtagatgtgaaaatccggattgcaagtatcactggcacccggaagaagaggaggatgcagaatgaatacagaattagtaagagcagtgttcgactgtggaatagatgatttgagactgttagacgatgcggaatgcgatatgtatgcagtgataggtagaatgcgagaagagggcatagaactgacgatgaacaatatcatccggcaggtatttgaagaaggcagatatattcttaccaaggcaagagaggaaaagatagccagcttgccagcagagccgctgaccgaggcagactttgaattaagagggaacctggaaagactgaacccggaacaggatttcagcttttggataaatctgcaggacaccaattttagaggcaagtctgaattgcaggagttatacgaatcaatgttcacagaagagctggagcagtgcgaaaatctgaccggctatccgattgaatggtaggtgatgatatgacatatagagaaaatgcggcggtactggaaacgtacctgcataatatccggaacattgaagaggcgccacctggtccggcagagctggaagcattggatgcggcagtagaggctatgaaagctgcagttgaaaacgtggagtacggagcatttgcctgggacaagcagagaggtatgtttgttcagataggcagaccagtaccagtaaagcagttgtgcttgaaccggtaccaggaaagagcaagaaacggagagataccgagctggattgatccggagaagttcaagattttggagagaacggtcgcagagattgcaggcgactggaaggaggcagaggatgaataaaacagtaaatttatttgtgttagctggatgctgggaatgtccggacgacattggagtaactgtggttgcgatttccagtgacgagaaacagctgattgatagactggatcagatagcagacacccaggcaaaggagtatgtgagcattgaaggtagcattctgatggaagagcatacagacactaggtacgaaatcagcggaggtatcagcggcaacgcaaggttctacatcacggaagagcctgcagtaatcaacgaggcacttatgggcgagatcagcagagcaatgagtaagaacgacagaacagaggatgtaaagaattatctgcaggggttgtttgaaaacggaaacctggatgaagaaaaatacgaggaactggtagacagcgaagagttcctgcagaaggcagtcgaattattcgataagatggaggattgcaacacgccgttcaatacaacgatggagttggcggtaggcgaagcaaggaaggagatgacaatatgaagaatacattaggagacttgaataaccacctgttcgctcagctggaaaagctgggagacgatgatcttacaggagaagagctggaaagtgagttgaagagaactgatgctatatgcgacattagcgagcagatcatcaaaaacggagagctgcagtacaaagcgatgaagcacatggacgagtatgggtacgaaagacagaaggcggttccggaaatgctcgaagttcatgcggggggggcgaaccataaatgagaggctggcccgaagaagtgattgcctggctgcgtgagaatgttccaggcagaaccacgaaacaggttacagagctgataaatcaacaggggttcgataagaagtacggaatggtattttctgatgcggtgataaagaatgcgaagaaccgatatggcattaagagtggaactgccggcgggtttccgaaggggtactctctcaaatatccggaaggaatggaaagttacattcggagcattgcggcagggagaaagacgaaggagattgcagaactggtgtcagcgcatttcggaatagagttcagtgagaaacagtgcagggcatacaagaagaaccatgacatcatcagcggtgttgactgcaggtttgataaaggacacgttccagccaacaagggaaagccaataagccaggaacaatatgagaagtgcagggcaacgatgtttaagaaaggtgatgtcccggcaaaccacatggaagtaggtgagtacacgcatacgacagacggctatcttatccggaaggttaaagaaaccggtccgcaattggagaggtttgagtttgttcatagagcagcatgggaagaacacaacggaccagttcccgaaggtaagatggtatcgttcctagacggaaacaaggacaactgcgacatagaaaacctggtactgatcgacaatgcagagaacctggaaatgaacagaagccagttaaggttcgctgatccggaaagaacaaagaccggcgtgcttgttgcaaaggcaagagtaacagtcagacagaagaaaaggagaaaatagatggagattaaagcggcgaatgcagaggagacgatccgctgcatcctggacgaggagaaaatgacccagcaggatttagcggacagaatggggattacgagacagaacatcagccagtctctcaaccgaaacgctaagagtatgagatacgatagcttctcaaagatggtaacagctctcggttacgagattgttgtaaaaaaactttaataaaatacgcaaattagaagtaaacctattgacaaatacgcagttgcgaagtataatatatacataatcaaacaacaaataaaacacacggaggtagtggttatgtataacagagaagattatagagaagcactggaagaaagagagaaatgcgacctgtattcagatgaatggagattttgccaggcaaaagttcagagcattgcaacagctatggtagctgcaggtaataactggatggtgggcgaaatcatcgacgagctttacagcctgagtgactgcggttgtgaactcaccgacgaggcagttcgatttgacctttggattcttgaaagcaacggcctcgaagagaaggctgaggaaatgaaaaaaatgttctaggtaaatttttttacctgcgcaactcgcaaatgagtgtttcacgtgaaacacaacacgcagatgaaaggagcgtatttgtatgaaggaagtattaaagaagttgagaaacttagaggcagaaatggaggaggcagagaaacagtcggaatactggatgcaggaagaacacctggatacggaaaaatcagacagctacgaagctgaggcagacagactgtatgaggaagtgtataaactgagcaaccaggtggcagatttcatcgtaagcctcacttccggtcagattgacaaggtaatggcaatgacgatgatgcgtcagagaagagaagatgtcgaaagaatcttggaagcagcataggaggtgagcggatgtacgactacgacggagacatgggttattttcagagacagctggaaaaagccggaatcagccaggaagaggttgatatgaataactacgcaggactgacagcaagagagttgcagagcattgttgatggtgcgattaagacaaagcagattagagaatcaaagaaggaggcgtaaggctatggcatcattagaggttaagacagaatgggcagtgtataaggattgcttcctgcaggtggcaagataccaggccgataacagcagggcaattgagatttggaacaacgaggacggacctattgcaagaatcacggtatgtatcacaggaagcggacttgcagaggatgagacagtgatcgacacgaataattgcccttgggcgatggagtttatcaagcagcacggtttcgggcaggccaccggcagaatggtaaaaagcggttactgcacatatccggtagtaaagctggatattgagaaaatcggtgagtatttggaggtggcgtaatggaaagagtgtatttcagtatcaatgaggccggagcaaagacggcaaacgatatgatgtcattcagcgagtataagaccgggagcaagactgctggttacaaggcacaggtcgataaggcatacgagctggcagagaaggtaatcgaggcaagaccaaccgaagaggaaagagtgtcgaagctctgcgagagatattcgagacgactggctcagaacatcaacaaggatattcagatcggcatgatgtgtccgtcagtaatgatttccggagcaggaaacttcccagtcaaaaagaaggaaaagcaggtagcggcatgggataagaaccatgcggactataaagaggttgaggcaatccttggaaagattgaggcaattttttatggcaaggacgttatcaagtctgatgacgagaacgcaatcgagaagctgcaggataaggttgacggattgagagaggaccaggagagaatgaagcaggccaacaaagcaatccgtatgaaggacaaagaaaaaggcgatgcaacgctgcatgacatgggatatacagacgaacagatcgcccagctgagagaaccggacttctgcggaagaatcggttttccggactatatgctggcgaacaacaacgccaatatccgaagattggaaggaagaatcaagagcctgcagaaaacgaagtcccagggaacacgggagagcgagaataagtttttcaaggtcaaggagaatgtggaggctatgagaatccagctgttctttgaaggaaagccggaaccggaggtaagagatattctgaaaagcaatgggttcagatgggcaccgtcggtaggtgcatggcagagacagctcaacaataatggaaaatatgcggtagagagagttatcagagagctggaagaaatggaggcggcagagtgaacatgaagttagaaccgagaaaggctacagatcgaggtggctggttgtgtatgccactggtaataaacggaccggagggaaaacctggttggaaaaaggtacgttgcccggaatgcgggacactctgctggcagagaccggaggacgcaggagttgttaaggcatcacaccttgacggtgcggtatgtactaagtgcgcattaagaaaggcgggtgatgtagtgtgacattacgagaggcaagcaaaggagtagttaaatccggaggaggaacctataacattggcttcaacggtggagacgagacgcagtttgacgctcagaacctcaaagaattgcaggagtgctggtcggagttctgtaaggatgaaaaaatcagtcctggatgcgttgattacgtggaaagggtgagttagtggaaattctgacaagagccatagcaaatgaatacagagacagagcgttgctcctgccgtctaacggactgcaggacattggagaaagaagaaagttgcgggaagaactgcaggccaggtgcaatctaacagagctgcaggcggtgaatatcataaatggctttcatatcccggactatgtgagaatcgcagaagtgagagcagcaaaggaggcagaagaacatgagaattgagaaagaaggatttgtgttacacctggaaggaacatggtgcgaaatctcaaataagtacgctgttttggaaagcggagatgtagcagtaaatgaagaggacattcctgcagggtttgcagaaaagaaactggatcgctatatcgaaacgcacaagatcagaggatatggaaaggttgacggatgcgtaaagagagttgcgtgcgacgaaagaacgaaggagtacattcagttgcaggcagtaaagctggacgatgatacatacatggtgcaggagtttgataatgagctggtatttatgggcgagttatggagcggatgcaaatatccggatgaagtgcttgactggatgaagagcaactatgagattgagagctgtctgaccgcagaggtgtatcgtagcagtttaggagattgcacgaataacggcatatcttcttacgcaagagaattgtatatcctggacgcacagaaaggcccttttgagccggacgacatcagacagtgcgtgtatatcgaaaagcgcgagattatgggacaggagtatgttgactgcaagcctgcatactgcaggaagcgctggtatatggggggcggcaatattctttacacatcggacagcagattcaaacagattaccgggatcagctacccgatagcgattcacgacagatacgaagggaggtaggagatatggtaattgtcgggtattatgcacatggcaataagcattatgtggctttcaaggatgaagcagatacgaaaggcagatttatgattacggacggattccacgacagaccggttacggaaagaaaccagggaaagtatgaagggtacgtgaaaatcgacaaagcagagtgcaatatcaagaagattatcggccgtattcgtggtacaagaccgcggcatccgcttctgagattactgcagaaggaagcggggtaattttttaccctggaaactcgcaaatgtgagtgttaggaaaaagaaattcgcaatagtagaacgcatgagaattaaatggaggtagagaagatgaatgaaatcagattaaaggcttacggatttagcatggaggcagtaggcagtaaaaagtttatcgcacaggaacgagaggcattcttggattttacagaagaaaaggtatcaaaagcagcaatgaagttatccgggaatgacgctcgggcagaggttcattcacaggaagtaagaaacagggaaaacgccgaacatggcgaagatttggtaacaatgacacataagacaacgcagcctatttcgttagaatggatacaggaggttgtaagacttgggcgtgccagggattatttttcagagggcgacacgatcgatattgaatttgacggagaagttatccagcatgacatcatcggaattgacgcagagaaacttgtagacaagagccttgaacacagtatcacaattcagatgcacgaccttgtgatggaggaaagaccgttcgatacaacaggcgattatggcagtaatgtgtgggagacatcagaattgagaaagtacctgcatagtgaagaatttcgtgagagatacaaaaagctcattccttacctaacaaaggtagtgaaagagaataacagcggagatgatacagaagatctgtttttcttactgtcggcggacgaagtagacccaaagaaaacgccgtataagtattacgaagatgttactaaccggcagaagaaaaatgcagacggagaaacagattatcaccgcttgcgctcggctagtcgtggctattcttactatacgtggtacgtgggctctagcggccacgtcctcgacaacatcgcgtactgggcctttcgctgcgccccggcttgtaccattgcataatcatataatcccggcacccgcggatgccgggaagaaaaaggagagaaaagaacatggcagaaatacagaatatcagcattgaacttgtaaaggtccacccaaacaatgtgagaaaaacgtataacgatattgaggaacttgcggagagcatcaaagcgaagggaatacttcaaaatttaactgttgtgcccgacccacaggaacctggaaagtatttgaccgtaatcggaaacagaagattgacagcagcacgcatggcgggacttgaaactgttccctgcattgtttcggatatggacgaaaaagagcagacatctgtaatgcttttggagaatatacagagaagcgatctgaccgtatatgaacaggcacagggatttcagatgatgcttgacctgggagaaacagaggacacaatcgctgaaaagaccggctttagcaagaaaacagtcagacatcgtttgaatatcgcaaagctggattccaagacgctgatggagaaagagagacaggatggataccagctgtcgcttacggatttgtacgaactggaaaagatcaaggacgtaaagacaagggacaagattttgaaggattccacagattcgagagatttggcaagaagagcaatcaatgctcagaaggagcagaaacgccaggaaaacatgaagttgtacgtggcaatgatgaagaaactgggattaaagaaagctccgaaggaagcggacagtgagttttacacagataagtgggaacgcatgaaggactacagcctcgacaaggagccgcctaagacgatgaagttcgaggataatggtgagccgatgttttacctggaaagatatgggacattgtacgtgctccgcaagaaaaagaaggaaaagaaggcacttacaccggcacaggaagcggaaagacagaataagcgcaacaagaagcagattaaggcaattcttaaagaagcagccaacacgagaaaggcgttcatcgaaggtattttatccggcagaattaagaaggttacgaacgaagaaaaggttgttgcagaacttttcgagcagatgatgagttgggagacattcacaggtcataacacattgaaggagtttttcttgggagacaagtgctacaacgctcagaaagaagatgtagaagccgcagagaaaaaaatggaaggactcagcgtacttcacaaactgctttgtatggtatcggcaatggttgcggatgcagacctggtagattggaattacacatacagcaccgggaaaggtgagaagacaaaagcattttataaggtcctggaattatacggtttccagtacccaaacgatgaagagaagggcgtggttgaaggaaccagtgatttatatgtaaagaaagaaggtgcaaagtagtatgaagagaggacagatttactatgtcagaagcaattacaaagaagaaggaagtgaacagcgggggggcgcccagcagttatagtatcaaacgataagaataatgcaaaaagcaacacggtcgaagtggtatatatgacgactaaaccaaagactgaccttccgacccatgtatatattgagtcagcacttagaccgtcaacgctcctgtgtgagcagatttccacagtttcggaggaaagaataggagaatggattggagaactgacagacgatgaagtgaaggagttggatgtcgcattggcaatttcacttggaatgaagtgcaggccggggcaggcggacgcagatacattggagcggttgaacaatctgcagatggaactggaaagaaccaagacagaactgaaagaagcgaagagcggaccggactataagatgatgtacgatcagctgatagagaagatgttgagcaggaggtagagaatgcagaacagacccgaagtaacggcaatgctgtcgctgtcaatccagcgacacatctgcccaaacagtgatccgagaatttactgggccagggaagtgacatttgattatgccaccacaaatgcggtgcgtgtggattttatgaagtttaagccggtaaacaatacggtgtccggtatcgagaagggagatttctactgctacgaggttaagtcctcggtagatgatttccattcaaagaacggtcacaacttcctgggcgactacaactactacgtgatgccggaagaggtgtacgagcaggtaaagaaagaaattccgtaccaggttggtgtatatgttccggatggaatgaattaccggggcgagtggtatggtctcaaagcaattaagaaagcaaagaggaaagacaggagcagaccggtatcagaaatgctgttgatgatgttccggtctgcagcaagagacaggagataattagaaaatgaggacaggaatcgtagaggttgaaataccatattcgtgcaggacttgcggatattgcgtggcggtacatgatactgacgagaaaatctgcatgttgttaaaaccgactggaaagtattgcggagtgacgacggcgtataaaaataaggtgactgctgaaatatgcccgatagtcaaatgataggtggtgacaggattgaagctaagaagatgcaataaatacatgtttcggaccgtgaagtgtagcaaatacatgagaaaagtgaatgatggaaagtgcataacacttctgacgggggataaaacggaaagcggaatgcctgcatatttctacacagattattcggaagaaaaagaaaaagacagatttagggaagttccgtcagaggactggggtggcggaggttttatgaaaacatattacgaaccgtcgataaaggagtttgttggaattgttataggcatgaaaatgattacagtaaaagcagaattgttttgcgacacaaactatgggtatgatggctctgaaagggactacataggaagagatgtgaaagagcaaatgaaagttgctgtagtagcctatggatgcaacaaaacaaggcttgtaccgatggatagctttgagataatcaaaggtgaaaaggagggcgatgaatgctgatattaccgatcaaaaagaagtggtttgatatgatcgtctccggagaaaagaaagaggagtacagagaaatcaagccatattacgacagcagatttatgaatgcgttcgggttcctgctggcaggcggacagatggtatatggagaggcagcgccggaagaaatccggaagccgtggccggtaccagtagtattcagaaatggatactcgaaggactctccggaaattgtttgcaaatgcactttgcaatttggcgaaggtaagccggaatggggagctgagccaggaaaaatgtattatgtgctgaaaatccaggagacaggaggtaagcaggatggaagcagaaacgacatatagaataacggtaagcgagaaagacacagaggttcttggcgagttgatagctattttggatggttgcccggttgaattatcaaatgatgattacgtggaaattatcagagcaatcggtactggcagcaagaatgtggaagcggaagcaatcgaactctcgtttacagaagggagcgaagaatgagtgcgtttaatatgggtgaaaagctctgcaaagaatacggctgtttatgcgctacgtgcgaacatagacatacatcgtttaagaagtgtgaaaccagttgcctttgctgcgacccggatatgccgctcgattcattcgagtacgatacggaggcatacggaggaatatcaaaatgcgcgagttattccaggaagaaggagacaaagtagatgaacaaggtaattttaatgggtcgccttacacgtgatccggaggttagatattcccagggagagcaggctatggcagtagcgagatacaccctggcagttgacagaagaggaaaaaaccaggaaaactcagcagacttcatccagtgcgttgcattcggcaaggcgggagagttcgctgagagatacctgcataaagggacaaagattgtgctgaccggcagaatacagactggaagctacacgaataaagaaggccagcgtgtatatacgacagacgttatagcagaggaccaggaatttgccgagagcaaaaacaccgagggcggtggtacatatagcaatcagccagcaccggcaccacagcagaatgacggtggatttatgagcgtggacgaggacagtgaattgccattcacataataggaggtatagacgcaatgcaggacaatatgagccaggaagatgttgggaaggtagaggcattcatacaaaacgaagaaccatgtgatttttgcacgcttagcgaagaatgtccgaaaggaatgaggtgctatggcggagaaccgatagaaccagcctgcacggatttaagcgatcattttgtagagatgtgcatagataaagaagcaatattagagtacctggaaggattggaggaatgattgtgaaacagtacacattgaatcgtaagacgtacaaggacgtaaagaaaatggatcatcagcagatggaccagttctgtcagaatttatacaaggcaggccatgcagacggaatgaaggatgcggaaggattgacagagagtgaggttcgagatgtgatcttgggtgtaaaaggaattgggccaaagaaagcagaggacatcgtgaaagctctgacggaagcacagaaagaaaggagttaattgacaaatggataagagtaaggtatatttggaagtaccggagttcactggcgaaaatgttccggtagcggttgcagcaagagtgatgaagaaagaccagcagtttatacgccagggtattatccttggatttttgaaattcggagttgcattcaagaaagaaggaagcagccagtacgactactacatttccccgatgaaattttgggaagagacagggtttgtatatgccggagaagagtgttaaaattgccgtgagaagcgctcgcaagtgcgaaaaattgctggataggaaacacgcaggtaacaaaaacgtcgatgcgtgcgataaataggcgattcactgtttctgttgaggaagctcacaaagctggtaagttctaagtagtatcgtatttaattgaaaagcagggaatatactttaagcggtatgttccttgctttttattctataaatttcttgattttccagtgaagatctttctcaaagctttgaaaaaatcccttgccaagccgcgcacattcatgctatgctactttacaatagtgcagtattgcatggagaggaatggaacggttatgctaaagatcattgatgattttgtctggggagttcccctgatcgtgctgatccttgcggttggcatatttctgacgatccgtctgcggggacttcagatcacgaagctgccgcttgcggtcagacacattattgcaaacgaaaaagacggcaaggacggagaggtgtcgagtttcggcgcactctgcacggcgctgtcggcaacgatcggtaccggtaatatcgtgggagtggcgacggcggtcgtggcaggcgggccgggcgccttgttctggatgtggattgcggcgctgtttggcacggcgaccaagtatgcggaatgtcttttggcgatcaagtaccgcgtggtggaagcggatggacatgtggtcggcggaccgttttactatattgagaacggtatgggcagaaaattccgctggctgggacagatcttcgcattcttcggcgtgggagtcggtctgctcggcatcggaacctttacgcagatcaacggaattaccggtgcggtaaagggcttttttgatccggagacggcatgttcggtgcatctgtttagcaacacctattcgtggagcgttgtgatatccgggctgatactgaccgtgtgcgtggcactcgttattatcggagggattaagcggatttcctccgtggcacaggtggttgtgccgtttatggcgcttgtgtatgtggtgactgtgctgatcattctgctgacgcatttgggagagattccggcagcacttgccaccatagtacaaagcgcgtttggactccgtgcagcggcaggaggaacacttggcgcaatccttgttgcgatgcagaagggaattgcgagaggtattttctccaacgaagcggggcttggaagtgcgccgatcgctgcagctaccgcgaagaccgatgagccggtggcgcagggactggtatccatgatgggaacggtgatcgatacgctgattatctgtacgatgaccggattgtccatcatcatcacggatacgtggaacatcggtctggacggggtggatgtcacgacaagagcgtttcagatcgggcttccgttcccggaacgcgtctcctcgtttttactgatgctgtgtctggtgttttttgcatttacaacgatccttggctggaattattacagcgagaaatgtctggaatatctggtgggcaaccgtcccggggtgttaaaatgctatcgctggctgtatattctggcggtattgatcggaccgtttatgaccgtgtcggcagtctggacgattgcggatatttttaacggactgatggcgctaccgaatctgattgcactggtagcgctaagcggtgtggtggcagccgagacgaagcagtattttgcaaaacagaagaatttttgatggttttgccaaaggacagagtaagttgttggatactctgtccttttttctgctataatagagaaaaaaggagggcgcagatggacgaagcacacgtgtatattgcaattgatttaaagtctttctatgcatcggtagagtgcgtggaacgtgggctggatccgcttacgaccaaccttgtggtggcagaccccgagcgcacggaaaagacaatctgtctggcggtatcgccttccctgaaagcctatggcattccgggaagagcgaggctctttgaggtcgtacagaaagtaaaagaagtgaatgcggggcatccgaaagagcggctgacctatcagatcgcaccgccgcgcatggcgctctacatggattacagcaccagaatttacaatatctatctgcgctatgcggcgccggaggatattcatgtctattctatcgacgaggtgtttatggatgtcacgcattatctggggacataccacatgacagcgagagaacttgcggcgaaaatgatacaggatgtctttgctgagacgggcatcacggcaaccgccgggatcggaaccaatctctatctgtgcaaagtggcgcttgatattgtggcaaaacatgtaaagccggatcggaatggtgtgcgcattgcaaaactggatgagatgagttaccgcagactgctctggaattatcgtccgctgacggatttctggcgggtaggacggggctaccagaagaagctggaggagaacggtctgtatacgatgggagacattgcgcgctgctcgctgggaggagccagagagttccacaacgaggaattgttataccggctgttcggcatcaatgcggagctgctcatcgaccatgcatggggctgggagccggtgacgatggaacagattaaggcgtacagaccgcaggtgaacagcataagttcggggcaggtactgcattgcccctacgacgcaaagggtgcgcggctggtggtgcaggagatggcggatgcgctggcgctggatctggtggaacggcgtcttgtgacggatcagcttgtgcttaccgtcggctatgacattgaaaatattacaaacccggcactttatgcagactatcgcggagagattgtggcggaccgctacgggagaaagattcccaagcatgcgcacggtacggtcaacctgaaaaccagaacctcctcttcacgtaagattatggaggcggtgatggggctgtatgacgacattgtgaatccaaagcttctcgtgcggagaatcacgcttgtgggcaaccggctggtggaagaagcccgcgccgaggcggaagaacaatacgaacaactggagctttttacagatacaggcggacaggaagaggagaaaaagcaggaagaactgcggctgaaaaaggagcgcagcctgcaggaggcaatgctttccgtgaagaaaaagtacgggaaaaacgcgatgcttaagggcatgaatctgcaggagggcgcgaccgcgatggagcggaacagccagattggagggcataaggcataatggactgggatcatgcggcagaggaacacaaatatgacgatatccggatgcttgtgcatcacagatcgcgcgtgcatccgccgatgtccctgtgggaccgggcggcgcagttctctccgtttgccgcgttgagcggacacgaggacgcgatccgcgagacggcacgcctcacgacggagcgcatagaactttccgagagccgcaaggaggagctaaatgagcagctcgtctggctgcgggaacacccggatgcgagagagcgggtgacggtgacctattttcgcccggacgcgaaaaaagcgggcggtgtctatgtgacagtcaccggagcggtaaaaaagatagacgaatacgaaaagacgctttggatggaagatggaaccgtcatagcgattgaggaactgtctgcggttgagataccggggaaggaccgatatgaggaagaatagaaggagcagcatgaagatggagacacaaagatacctgtatgagacacatatgcatacatcggaggcaagcgcatgcgccggcagcacgggtgcccagatggcgcgcgcctacaaagaggcagggtacaccggcattattgtaacggatcactttttttacggaaatacttcggtggaccgttccctgccgtgggaggagtgggtacggcgcttctgtctcggatatgagcatgcaaaggcagagggggaacgcatcgggctctcggtgttttttggatgggaagcatgttatgaggggacggagtttttggtatacggactggatcaggcatggctgcttgcacacccgcagattaaggatgcatcgatcagggaacagtacgcattggtgcatgagggcggcggcatcataagccatgcgcacccgttccgggaggaggactatattcccgagatccggctgtttccggaatatgtggatgcggtggagggcgtaaacgccatgcattccagcagggcgagcgactgccacaagaacccgctgtttaacgagcgggcgctggcctatggaaaagagcacaatctgccgtttactgcgggatcagaccagcacaccacgcatatgatcggcggcggtatggtctttcccagaaaactaaaagacgtccatgactttacccgcgcggtgcttggcagagaggcggtggaactgttggacggctgccaaagcgagtgattacgagcggttcttttcccggtattctttgggcgacatgcctttctgccggtgaaaggttttggaaaaatagagactgttgtcaaaccccagcgagtttgcgattgcggtgattgacaggctggagtgctccaacagatagcacgcctgcttcatgcggaaatctgtcagatattccttgggggagagtcccagaacagcctcaaacgagcggaacagatgactgcggctcacgccgacatagccggcgatatcctccacggtgatggcgtaggaataattcgaggagatgtactcaatgcctttttgtacatagctgttcgcggaattctggcttccggcgtgcgtggcgccgtgcatgaaaagggcgagcatggtatagagacgtcccgtcatctccaccgcgtgctcgaattcgttgccgcgcgcatcgtagatgtgtaaaatctgccggtgaatatcattgccgcgtggggtgccccggataaaaggattctccggggagaaatccgtggccttcaggatcatggaggcgtcgcttccggtaaaaccgacccaggcgtattcccagggatcctgctcatccgcacagtagacaacctcggtgttcgggtagaccaaaaaggtgtctcctccggacagatggtaagtctgaccggcgacgcggtaggtgccttttccggaaatgatatagtggatcagatagtgatcgcggataccggggccccattggtagagggcgtcacatttctggaagccgacgttgtagacggagagggaaaccagttctttttcggtcactttgtaggaatttttgtaatgatgcggcatagagcacactccttgtctttcggacggtaaaatccggttcatataagtttattataaaaacagaaaagccgaaaagcaacattattacatatatttcatacattttgggctatacattttacggaggatagagtaatataattttcgtaaggcagatggaacaatgaatcataacggggaaaggtggaatcattatgacgattttagtaacaggcggagccggatatatcggcagccatacatgcgtagaattacagaatgccggatatgacgtggtagtgctggataatttaagcaatgcctccgagaagtccttacagcgtgtggagacgctgacaggaaagccggtaaccttttataaaggggatatcttagaccgtgatatcttaaataaaatctttgcggagcacaagatcgactgctgtatccattttgccggattaaaggcagtgggtgagtccgtggcaaagccttgggagtattacaacaataacattgcaggtacgctgacactggtggatgtgatgcgtcagaacggctgcaagaatatcattttttcctcctcagcgacagtatacggcgatccggcggagatcccgatcacggagaactgcccgaagggtcagtgcaccaatccgtacggatggacaaagtccatgttagagcagatcctgaccgacatccagaaggcagatccggagtggaatgtgattctgcttcgctactttaacccgatcggtgcacacaagagcggcacgatgggagagaatccgaacggtatcccgaacaacctcatgccgtatgtaacacaggtggctgtcggaaagttaaaagaactcggtgtattcggcaacgattatgacacaccggacggtaccggcgtgagagattacatccatgtggtcgatcttgccatcggacatgtgaaggcactcaagaagattgaggagaaagcgggactctgcatctacaatctgggtaccggacacggctacagcgtgcttgacatcgtgaagaattttgaggctgcaacaggtgtgaagattccttatgtaatcaaggcgagaagaccgggcgatattgcaacctgctactgtgatccgtccaaggcaaagaacgagcttggctgggaggcacagtatggtatccgtgagatgtgtgaggattcctggagatggcagaagaacaatccgaacggatatgaagattaagatgtgaagcagcggacggggctgccacacgatattgtattttaaatgggatacgttttgcgataagaaaaggagactatcgcgttccagatgcaatctgggacagcaattctaatcgtaaaatccggtatttctaaccatgccgcgtcgaacattctggatgatctgtgtttttccaagtttcggacattccacaaggtgtgttcgtaatccgcagacaattttaggacttttgtgtgtgccccttgttggcaccaatgaacaaaacataaccgcgcgaagccgatgtctgagctgccatctgccttattttcaatagcagatggcagcgagtttcggttcacgcggttttatattgtctgtgaagcggtgccactaggggcaccagaaagtccgctcattgtctgcggatttgccggacacaccttgtggaaagtccaaacatggaaagacacagaattcgatgtccaacgcggcatggaagaaatattcggattttcctccaaagaattgccgcccctggttgcattctggaactttatattctccaatattcttatcataaaacgtatcacattaaggtgcagagcatgacaactccgttttctggaaataaaaaaagaaagcgtaaacgctttcttcttcgggttgggctgttattactaacagtagcagttcctaggggaatcgaacccctgttttcgccgtgagagggcgacgtcttaaccgcttgaccaaggaaccatacggtataccaaatatattatgaaattgagcagttcctaggggaatcgaacccctgttttcgccgtgagagggcgacgtcttaaccgcttgaccaaggaaccgaacaaatgctattataacaggctttcaaaaaaaagcaaccccttttttgaaatttttttaaaaagctgaaaattctgtacaattcgtgggaaaaggagtatggtgaattgtgatagagtaacgcggtaaagtgcaggggagtaaaagcagaaacgatacttcctgccgcagaaagagaggtttgtgcgatgtcgctggagagagcaaaggcatatttaaaagaatataagatggaagatcagatccgggagttccccgtctcctcggcaacggtggaactggcggcggaagcgctgcacacggaagcagggcggattgcaaagaccctgtcttttctggtggacggagaggcggtgctgatcgtgtgtgccggagatgcccggattgacaatgcaaaatacaaggcatttttccatgcgaaggcgaagatgcttgcgccggatgaggtggaggaacggatcggacatgcgatcggaggcgtctgcccgtttggaatcaaggaaggcgtgcgggtgtatctggacgagactttgaaaaaatatgagacggtttttccggcgtgcgggagctgcaacagcgcgattgaactgacgataccgcagttggagcagcttgcaaaaccggtgtgctgggtagatgtctgcaaactgccggcataaaagcctgtattttcgagaaaaagcttgcatttcccataaaaaagtgctactttaatatatgataacacgatgacttgattgagagaggacgaaagccctctctcaattcacgtttatgccctgtaaagtctgtgtaaaggccgggtgggcagtttgttacaattaaaattgaatatggagaaagaaggtgtacacatgtcaaagcgtgaaacatacgaagcgcgcaccgaagaactgatcactccgatcttagagcgcatgtattttgaactcgtggatgtggagtatgtaaaagaaggcggaacctggtatctgagagcctacatcgacaaggagggcgggatcaccgtcaacgattgcgaggcagtggcgagagagatgaatgagattcttgaccgcgaggattttgtggaagattcctacgtgttcgaggtaagttccccgggacttggcagaccgctcaagaaagaaaaagattatgtccggagcatgggaaaggagattgagatccgcacttaccgtgcaatcaaccgggaaaaggaattttatggtattttatctgcatatgatgaaagtactgtgacaatagagacagaaaacggagagaaaatgacgtttgagaagccggatatcgcgctgatccgtctggcattcgatttttgataaaatatatgctaataaccactaaggaaacaggaggataataaaatgagtagtaataatgagttattagaagcattgaatatactggaacgtgagaagaatatcagcaaggagacactgcttgaggcaatcgagaattcattggtgaccgcctgcaagaaccatttcggtacatccgagaatgtaaaggtgacgatggacccgcagacctgtgagtatcatgtgttccaggagaagaccgtagtagagcaggtggaggatccggtagagcagatcagccttgttaatgccaagatggtggattccaaatacgagatcggagatatcgtgaatgtcgagatccagtccaaggagttcggacgcatcgcaacacagaatgccaagaatgtcatcttacagaagatccgtgaagaggagcgcaaggttttatacaaccagtattacagcatggaaaaggatgttgtgaccggtgtggtacagcgttacatcggaagaaatgtgagcgtcaaccttggcaaggtggatgcgatcctgaccgagaacgagcaggtgagaggcgaggtattccagccgaccgagcgcatcaaggtctatatcctggaggtgaaggatacgtccaagggaccgaagattctcgtgtcaagaacccatccggagctggtaaagcgcctgttcgagtctgaagtgaccgaggtgagagagggaatcgttgagattaaggcaatcgcgcgggaggcaggaaacagaaccaagattgccgtctggtccaatgacccggatgtggatccggtgggcgcatgtgtcggtatgaacggtgcgagagtcaatgcgatcgtcaacgaactgcgcggcgagaagattgacatcattacctggaatgagaatccggcaatgatgatcgagaacgcattgagcccggcaaaggttatttctgttatcgcggatgcggaggagaagtcggcgaaagtcatcgttccggattatcagctttccctggcgatcggcaaggaaggacagaatgcgagacttgcggcaagacttaccggctttaagatcgacatcaagagcgagacacaggccagagagtccggcgacttcatggattatgagagcgagtacgaggacgacgagtattacgaggatgacgagtacgcagaggacggcgaatataccgaagacggcgagtatgccggggacggatatgctgaggatgcggatgccgagggagaatacgctgaggaatccgaatttgcggatgagacagacacagagaatgaagaagagtaggcaggggttgatcagagaatggcaaacaaaaagattccaatgcgccagtgcgtggggtgcagagagcttaagccgaaaaaagatatgatccgggtaatcaagacggcggcggaagatgagacctcctcacagattgtacttgatgccacggggcggaaaaacggcagaggcgcttatgtgtgtccgaacagtgagtgcctgcgcgcggcaataaaaaacaagggtctggaacgatcattaaaaatgccaattccaaaggaagtctatgatacactgacaaaggagatggagaagtttgaaaccagataaagtgttgtcgatgcttggcattgcagccaaggcgggcggtgtggcaagcggagagttttccacagaaaaagcggtgaaggatggcagggcatggcttgtcattgtcgcgtcggatgcgtctgagaatacacagaagcatttccgggatatgacgactttttatgaagttccgatgtatgtgtacggagaaaaagagacattgggacatttcattggaaaggaattccgcgcatcgcttgcagtgacaaacgaagggctggcccattcgatcgaagataaattgaaactgacgttaacaactgaataatggaggaaacaggatatatggcaaaaatgagagttcatgaacttgcaaaagagttaggaatagaaaacaaacagattattgaatttttaagtacgacggagcatgcggtaaagtcgcacagcagcagcattgaggatgatgtgcagaaaatggtgcgcgacaagttccagaaaaaggcagcaccaaagacggagacagcgccgaaggcggaggcagcgccgaaggcggaggcagcgccgaagaaggaagcagcaccgaaggcggaagcggcaccgaaggctgctgagaacgcggagggcagaccggagcgtccaaagaagaagtccagcattaccgcggtattcaatccgcagtacagcaagcagggaggcggacgccgcccgcagggagaccgtgaccgccgtccgatgaacggggaccgtcgtccgatgaatggagaccgccgcccacagggaggcagaccggagcagcgtcaggcaagaccggcaaacagctttgatgtcaagagagcatttgagcgcgcaatcaacccggaggctgcaaaggcagccgaggaggcagagcgtcaggcagcggagcgcgcaaaggcggccagaacggcagcgccggagaaaaagccgcaggagacagcagcaaagcagccggaacgccgtgaaaatgtatacgagaatgtgtatgagaacgtatatgcacagaatccgcaggcacgcccgcagggagaccgtgaccgccgtccgatgaacggggaccgtcgtccgcagggagaccgcgacagaagaccgggagcaaacggagaccgccgtccgatgaacggggatcgtcgcccgcagggagaccgcgacagaagaccgggacagaatggatacggcaaccgcggcggcaataatggcggaggaagaccgtacggcggaggaagacctggcgcaaacggtggtcagggagacagaaacggaggccgtggcggcaatggttaccgcggtggcaacccgtccggcagactggatcgtgagatcgaccgtatgaacaaggagaccgcagcatccacagaggaactgcgcggcaaggagtccagagagcgcgagaaagaccgcaacaagaacgacagacagagaaacgattacgatgcacttggcggcaagaagcaggagcgcttcgtaaatctggagaagaacggcggcaaaaagaagccgaaccagcagccgcagccgaagcaggaagaggatgtgattaagacactcgttctgccggagaagctgacgatcaaagagcttgccgataagatgaaagtgcagccgtccgtgatcgtgaagaagcttttcatgaaaggcacgatggtgacggtgaaccaggaagtggactatgagacggcggaggagatcgcgcttgagttcaactgcatctgtgagccggaagagaagatcgatgtgatcgcagaactcttaaaagaagaagacgatccggaagagacacttgtggcacgtccgccggttgtctgcgtcatgggtcatgtcgatcatggtaagacatccctgctggatgcgatccgctccacccgtgtgacagacaaagaggcaggcggtatcacacagcatatcggtgcatctgttgtttcgatcaacggtcagaacatcacattcctggatacaccgggacatgaggcattcacggcaatgcgtatgcgtggagcaaattccaccgatattgcgatcctggtagtcgctgcagatgacggtgtcatgccgcagacgatcgaggcaatcaaccatgcgaaggcggcgggagttgagattatcgttgccatcaacaagattgataagccgagtgccaatatcgagcgcgtgaagcaggagctgtccgagtacgaactgattccggaagattggggcggaagcacggtattttgtccggtatctgcacatactaaggaaggtatcgagaaccttttggagatgatccttctgaccgcagaggtacttgagttaaaggcaaatccgaagcgtaatgcgagaggccttgtcattgaggctcgtctggataagggacgcggtgcagttgccaccgttctggtacagaagggtaccttaaaggttggtcagccgattgcatgcggaagctgctacggcaaagtgcgtgcaatgattgacgaccagggaagaagagtcaaggaagcgggaccgtccacaccggtggagattctcggactttcctcagtaccggaggcaggcgagacattcgttgccatggatacggagaaggaggcaagagcatttgccgagacctatatttccgaaggcaagaaccgtctgatcgaagataccaaggcgaagatgtcgctggatgatctgttctcgcagattcagtccggtaacgtcaaggaactggatattattgttaaggcagatgtacagggttctgtggaggctgtaaagcagagtctggagaagctgtccaacgaagaggtagtagtaaaagtaattcacggcggtgtcggcgccatcaacgagtccgatgtcagccttgcatccgcatccaatgcgatcatcatcggattcaacgttcgtccggacccgatggcgaagacaacagcggacaaggagaacgtcgatatgcgtctctacaaggttatctacaatgccatcgaggatgtagaggcggcaatgaagggaatgctcgacccgatcttcgaggagaaggtgctcggtcatgcggaggtgcgtcagattttcaaggcatccggaatcggaaatatcgcaggttcctatgtgcttgacggtgtgttccagagaggctgcaaggttcgtatttcccgcgccggagagcagatcttcgagggcaatctggcatccttaaagcgtttcaaggacgatgtgaaggaagtaaaagccggatacgagtgcggtcttgtctttgaaggctttaatgacattgcagagcttgatatcgttgaggcatacacgatggtggaggtaccgcgttaacagacgttttgcgtgtatggaaggagctagaaattgagaaaaaacagtattaaaaatacccggatcaacggggaagtgctgcgcgagttgtcgaatatcatccgcggggagatcaaggacccgcggatcaatccgatgaccagcgtggtcaccgtggaggttgcaccggatctgaaaacgtgcaaggcttatatcagcgtgctcggggatgagaaatcccagaaggcaacgctcgcaggtcttagaagtgcggagggttacatccgcaggcagcttgcccacagcatcaacctccggaatacgccggagattacatttgtgctggatcagtccattgagtacggtgtgcgcatgtccaagatgattgacgacgtgacaaaggatattcctgaccggatggatgaggcggaagaggaaacagaagaatgacgaattttgatgattttctggcagaggttcatacggttgccatcggcggacacatccgtcccgatggtgactgtgtgggctcctgccttgctacttataattacattaaaacatggtatcccgacattgatgtgacggtttatctggagccgattcccaatattttcaaatttatggcgcgctccaatgagatcgtctccgatttttccggggatacggtatatgatctgtttatcgcgcaggactgcggggatacgggacgtctgggcggtgcggcgcatttctttgagcaggcgaagcataccgtctgtgtggatcaccacatcagcaaccagagctttgcacaggacaactacatttttccgcaggcaagttccgcgtcggagcttgtctatgaactgcttccaaaggagcgcatcacaaaggagattgccgagtgcatttataccggaatggtacatgataccggcgtcttccagtattcgtgtacgtcgagaaagacgatggagatcgctggagcgctgatggagtgcgggatcaattatccgaagattgtggatgataccttctacacaaagacatataaccagaaccgcattatggggcttgcactgctaaagagcaggctgcacctgaacggaaaatgtatttccagcgtgatcacggaggaggagatgaagcagtacgatgtgctgccaaagcatctggacggcattgtgaatcagctccgcgtgaccaaggatgtggaagtggcagtctttttgtatgagacgggagacggcacgtttaaggtgagcaccagatccagggaagtggcggatgtctcgaaggtggcggtaaagtacggcggtggcggacacatccgggcagccggattttccatgactggcgatgcagatgccatcatcgaacagattgtttcggatctggcagaacagataaagtgagaaaaaagcagtatgatgaatggaattatcaatatctataaggaaaagggatttacctcgtttgacgtcgtggctaagcttcgggggatcttaaagaccagaaagatcggacacacgggaacactggatccggatgcggagggggtgctcccggtgtgtatcggcaaggcgacgaagatctgcgaactgctgacggacaagacgaaggaatacgaggctgtcatgctgcttggaaggacgacggacacgcaggatgtgacgggcgagaccctgacgcagcaggaggtgcgctgcagtgcaaaggaagtggaaaaagcggttctctcgtttgtaggtgattatatgcaggtgccgccgatgtattctgccttaaaggttgacggcaggaagctgtgtgatctggcacgggccggcgtgaccgtggaacgtgcggcgcgtccggttcatattttttccgtcgagatcctttcgatcgaactgccgcgtgtcaggatgcgtgtctgctgttccaagggaacgtatatccgcacgctctgccaggatgtgggggaggtgctcggctgcggtgcgtgcatggaatcgctgctccgcacgagagtcggagagttcgcgcttgcggacgccataaagctgtctgaggtggaggcgtacgtgattgcacacaggtcggatgcggcggagacagaagagatgcagcttccgttccttcaggcggtggataccgtctttctaaaatatgagagcgcgacggtggacggacagttccgcaaatatttatataacggaaaccggctgcgcccggagatgtttttggaggaacatgagagcatgagaacggcgccggtccgcgtctacgacgatgaaggcgcatttttcggcatttatgaatatcaggcggaaaaggaagactataaaccattaaaggtgtttaagtagatcatgaaatatatcaggaacacaacggatttttatatagaagagaatacggtgctttctctcggcaagtttgacgggattcacagggggcatgagcagctgctgcagtattttgcaaagaaaaaggatgaagggctcgcgggagcgatttttaccttcgacattccacctcgcagaaatgtgcagaatgtggaggcgaaggtgctgaccacgaacgaggaaaaaaggcacatgtttgagcgcctggggattgattatgtggtggagtgcccgtttacgcaggagatcatgtgcatggagccggaggatttcatcgcaaagattgtgcggcagcttcatgtaaagtgcatggttgtgggggaagactttcatttcggacataatcgcaggggcgattaccatatgctgcggcagtatgccggaaaatacggatacgaagtgatcgttgtggagaaaataaaagaagacagccgggacatcagcagcacgttcgtgagggaagagatcgcagccgggaatatcgagaaggcaaatcatcttctgggataccgttactttgtgaccagcagagtcctgcacggcaaccagatcggaagaacgatcgggattccgaccatcaaccagctaccgccgaaggagaagctgctgccgccgaacggtgtctacgtgacggaggcatacatcggagaccggtggtaccgcggcatcagcaacgtggggtgcaagcctacgattgagggagagtatcctgtcggggtggagacacatctgctggatttcgcggaagatgtctacgataagatggtgacggtggagttcttaagcagagtccgcagcgagcggaaatttgcatcgattgaggcgctcaaagagcagatgcagaacgatgttgcctatggccgtgcctattttgaaaaacacacctcgtaataattattacataaatgttacaaaaatatgttgacatcgtaaaaaatcgttgctatactggacgttagatttaaaaatgagcacaaactagaattgcgcagaagacggcgcaagaatggagagtcatatgaaagcacgattagcgagaatcgcaggtttggtcctggcgggaactctggtggtttccacagcggcaatagatcagaagtcaaagaatacagatgcggataccagtgcaaccgtggcgtccggtgttaccagcgcactgtccggaagcctcagtgatgcggcgatgggggtggccggtgtttccggaatggacgttgcaagaacggcacagggacaggaagcggttgaagagggcaccgaatcagcagaggcgggtgtggatgcatcgacgtcttctgccgctgccggagtatcggcagagcttgcagacgcagcaactgtggcctcacaggcgcaggacgaacttacagagacggagagcacagaggagcagacagagagtacagagcaggatgccgcacagcaggcggcgagcgcttacggatacaccaatctcggtgtggcgaatgttgagggcaatcttaatgtccgtgcagcggcaggcactgatgcagatgtcgtgggcaagatgccgaacaacgcaggatgtgagatcctcggcgtggaaggcgaatggacacagattaagtccggttccgtggaaggttatgtaaagtcggagtatcttctgaccggagatgcggcgcttgccagagcggatgaggtaaagcagacgcttgccaccgtgacgacgacaaccctttacgtcagagagcagccgaacaccgactgcgcggttgtcacaatgatgccgcagggcgagggactcgaggtgctcgaggtgcttgacggatgggtgaagatcaacgtcgacagtgatgagggatatgtctcttccgattatgtagagatctcgacagagcttttaaaggcgatgaccatgactgagatccggtatggacagggtgtttcggatgtgcgtgtatcgctggtgcagtatgcgacacagtttgtcggcaatccgtatgtatggggcggcacaagtctgaccagaggtgcggactgctccggttttgtcatgagcgtatttgccaactacggcatttcccttccgcattcttccggcgcgcagtcgaattgtggaacgaagatttcggcctctgaggcacagccgggagatctgttcttctacggaaacggaagccgcatcaaccacgtggcaatctacatcggcaacggacaggtggtacatgcaagttcaccgaagtccggcatcaagatttccggtgcctattaccgtacgccggtcaaagttgtgcgtgtgatcaataattaaaaagttgtttacaagcgtatgcagctatgctataatgcgagagtatgagttcagcccatattcggtaaatggacactccaaccttttactgagtatcatacacagtcgggcgatgggccaaaagggcccggtatggcagaagccatccaaacagaatattataaggaggatcagaacatgatcgcaaaggacaagaagcagaacattatcgcagagtatggaagaacaccgaatgacacaggttcaccggaggtacaggttgctcttttgacagcacgtatcgaggagcttaccgctcacttaaaggagaacccgaacgatcatcactccagaagaggtcttttaaagatggttggtcagagacgtggtttacttgcttacttaaagaaagtagatatcgagagatatcgtgctttaatcgagcgtttaggtctcagaaaataagatgtccaaagcgggcagacatgcccgcttatcaatagagcggagagcttccccgctctatttttactgtatggaggcacttccgtgcagcatggcaatctgacagaagcgtatccccgagaccactgaaatatagatacgtgcagtgtatgtatttcagtagtttcggtgcttctgcagagtagttttgcgggatccttccggcagaaccgaagaagagaatgaaagagaatcagaaaaggagaattcgcatgtacaaaagtttttcgatggaacttgcaggcagaacacttaccgttgatatcggaagagtctgcgcacaggcaaatggagcagctttattaaaatatggagagacgaccgtgctttctaccgtgacggcatcggacaagccgcgtgacggcattgatttcttcccgctttccgtagaatacgaggagaagatgtattcggttggcaagatcccgggaggattcaacaagagagagggtaaggcatccgagaatgcaatcttaacctcccgcgtaatcgaccgcccgatgcgtccgttattcccgaaggattaccgcaacgacgtgacgatcaacaacatggtaatgtccgtagatccggcatgccgtccggagatcgttgccatgatcggttccgcactggttaccacaatttccgatatcccgtttgcaggtccgtgtgcaacaacgcagatgggtatggtggacggagagttcatcgtgaatccttcccagaaggagtgggacaagggtgatctgcagctgaccgtggcttccacagcagagaaggtgatcatgatcgaggcaggcgccaatgagatcccggaggacaagatgatcgaggcgatctacaagtgccatgatgtaaaccagacgatcattgcgtttgtcaacaagattgtggaagaggttggcaagccgaagcatgagtatacaagctgcgcaattccggatgagatgtttgcggcaatcaaggaactggttcctccggcacagatggaggaggctgtattcacagacgagaagcagcagcgtgaggagaatatccgcgagattacggacaagctggcagaggctttcgcagacaatgaggagtggcttgctgttctgggcgaggcagtttaccagtatcagaagaagactgtccgcaagatgatcttaaaggatcataaacgtccggatggacgtgccatcaaccagatccgtccgctggcagcagaggtggatctgatcccgagagtacacggctctgcgatgtttacacgtggacagacacagatttgcgatgtggtgacacttgcaccgctctccgaggttcagaagatcgacggactggatgagaatattacgacgaagagatacatccatcagtacaatttcccggcatattcggtaggcgagaccaaggtatcccgcggaccgggacgccgtgagatcggtcacggtgcgctcgctgagaaggcacttatggcagtgcttccttccgaggaggaattcccgtatgccatccgtgcagtgtccgagacattcgagtcgaacggatctacttccatggcatcgacctgtgcgtcctgcatgtccttaatggctgccggagtaccgctcaaggctatggtggcaggtatttcctgcggtcttgtgaccggagataccgatgacgattacattgtcctgacagatatccagggtctcgaggacttcttcggagatatggacttcaaggtaaccggtacgcataagggtatcaccgccatccagatggatatcaagattcatggcctgaccagaccgatcgtagaggaagccatcgcaagaacaagagaggcgagaatctacattatggatgaggtaatgtccaaggcaatcgcagagccgcgcaagcaggtgagcgagtatgcaccgaagatcgtccagatccagattgatccggagaagatcggcgatgtggttggacagagaggcaagacgatcaatgagatcattgcccgcaccggcgtgaagatcgacatcacagatgacggttccgtatccgtatgcggtacggaagcggagatgatggataaggccatcgagatgatccggattatcacgaccgatttcaaggagggacagatccttaccggaacggtagtgagcatcaaggagttcggcgcattcttagagtttgcaccgggcaaagaaggcatggttcacatcagcaagatcgcaaaagagcgcatcaaccatgtggaggatgtactgacccttggcgataaggtgaaggtggtatgccttggcaaggataagatgggaagaatcagcttctccatcaaagatgttccggcggaagcataaagcagtcatgcaccggtaattgcataacagaaatgaagtgccttttctatggctttgcataagctataagaaaaggcatttttttatgaatcgggtcagaaaaatcatccatacggattatgcatataaagcaggtttgagcgggaaaaatgtaaccgtggcgattatggataccggaattgttccgcatgtggatttcgggaacaggatccgctattttggggatttctgtgaaggaaagacgggactgtacgatgacaacggccacggcacgcatgtgtccggaatcgtggcgggcagcggcgaggcatcgagaaaagaatacgggatgccggtttgccacggcattgcaccgcaggcggatatcgtgatgttaaaggtgctagacgccaaggggaacggaaataccagggatgttctggcgggaatggagtggattgcaaagaaccagcaggaatatcagatccgcctgttgaatatttccgttggaatgcttcaaagcgcgggagagcgggaacagcaggaacttcttagcgcggtggacgatctctgggacagggggatcatggttgtcgcggcagccggaaataacggccctaaggaaaattcggtgaccattcccggaatctcaagaaagattgtaacgatcggaagcagtgacgacggaaagagcgagccggggaagcgggggcttaagacggggtacagcagcaacggtccgacggcatgctgtattgtaaagccggaaatcctggctccgggcacggcaattaaaagctgcggcagggaaaaaaacggataccaggtaaagagcgggacttccatggcggcgccggttgtcacgggtgcactggcgcttgcatttcagaagtatccgtatctgtcgccggcggagatgaagctgcgcctgtacgagagagcgtatccgcggggagagcagcttggcagaaaatgctggggaatgattcatgtcgaccatctggtgagaggctgaagaggagcgggaggctgaagaaaatagaatgctgcaagacggaaaggaagggaaggggaggtgacgtgaccggcggttgacattttatatgaaaaaacgtaagataaaaaatacggttttgaaagggaggagacttatgaagaagattgcacaccttctgatgggaagactgaccattgtcggggtttcgatattgctgcagatctgctggctgtttctggtgctgtggaaattcagctatcagttcacctatgcgaacctgataatccgcgctgcggcgattgttctggtgcttgtgattgcgaacaagtgggagaatccggcgaataaactttcctggacgtttctgattctgttgtcgccgatccttggaatcatgctgtatttcctgtttggacgctccggtctgacgaagcacaccagagaacagatggatgccgtgaaccgggaagtggatgcctgcatgccggtagacgaggaggcggtcaggctgctgcaggaggcggatccatcggtcttacgacagtcaaaatatattgcggactggggacattttccggtctaccggaataccgccacaaagtattatgagagcggggaggcgatgttcccggatatgcttgcagcgttggagagcgcggaacactttatttttctggagtatttcatcatcgaggagggacatatgttccaccagatcgaggatatcctggagaaaaaggtcaaagagggcgtggaggtacgcctgatctacgatgatgtcggctgcatcggcacactgccgccgcggtattataagcagcttcagaaaaagggcatcaagtgcgctgcctttaatccgttccggccgttgctctcggtaatcatgaacaaccgggatcaccggaagatttttgtggtggacggcgcggtcggttttacgggcgggatcaatctggcagatgaatatatcaatgaggtaaaacggttcggctactggaaggacaccggcgtgcgcatcgagggcgaggcggtctggagtctgaccagcatgtttttgtccatgtggaattacatcgtccattccacggaagattacagccggtttatgccggcacagcatcagaaagcaccctttgagaatgacgggttcgtgcagccgtacggtgacagccctctggatcatgagaatgtgggcgaaaatatttacctgaatatcataaacagggcaaagaattacgtctatatcttcacaccgtatctgatcattgaccatgagatgctgacggcgctctgcaacgcggcgaaggacggtgtggacgtgcggattgtgacgccggggattccggacaagaagatgattttcctgctcacgcagtcctactatgcaccgctcatacaaagcggggtaaaaatttatcagtacacgccgggatttattcacgcaaaatgttttgtctgtgacgatgagatcgcaacggtgggcagcgtgaatcttgacttccgcagcctgtatctgcatttcgagtgcggcgttttcttctaccgctccgcggttgtggcacaggtaaaggaagactgcctgaatacgtttgcgtgctcagagcagatgacggcagagttctgcagaaaccggccggtaccggtacggcttctgcagagtgtgctgcgcctgctggcaccgctattataatagaaaaaagtcaggtcagaagatagaaaagcgccatcttgaaataatcgcggtatgaggcggcgtgaacatccgcagtgtaacggatattcacggagccgagttccctgccgcctgcggagtagacaaccctgccggccacgtcaccctttctgacaggtgctgtgaccgtctcggggagaatctgctctttttttacatcagagaggtcctcgccttttacagacaggtaggagaagggagagtcgtaggcgagaccgacggcggtttcggtgccctttgtcacgggaagatcgggcagagcgtccgtgttttcatccgtgtacaggcggcattttccgaatccgtaatttaaaagcgtggtggcatctgcaaagcgcactttgtaatcgggcgctgccatgacgacggcgatcagttccagaccgtctttttctgcggtggcagacacgcagtatttggcgagactggtggaaccggtctttaatccggtggcatactcatactgccggatgagtttgttggtgttggtcagaccgaattccgaacttccctttgccgtgacatgggtgatgttttccatccagatggtgcagtagttgtggatttcgggatggtttacggtgagttcgcgggacataagggcgacgtcgtaggcgcttgtcatgtgcccttccgtatcgagaccacagcagttgacaaaggtggtgtctttcatgccgagccctctggcacgctcgttcatctgacggacgaattcggattcggaaccgcagagatattccgccatggcgacgcaggcatcgttggcgctcgcaacgctgatacatttgatcatggtctctacggtctgggtctccccaggctctaagaacacctgtgagccgcccatgcttgcagcgtattccgacacggtcaccgtgtcggtcagggagatctgtccgcgctctatggcatcgaaaatgagaatcagggtcatgatttttgtgatacttgcgggatgccggatttcatgtgcgtttttttcgtagaccacagttccggtggacgcctccatcagaagaacgctcggcgccgagacggaaaggtcggcttcgctgttttccgccgcaagaacgggagaagagagagtgagggtgcagcataacagaaaagaaagaaactgcttcaaggtattctccaggattctttttgttactattgtagaggaagaacctgtacattatgcagcgtgcacaaaaagaaattggcatcccgcgggaaactctcatttgaaacactaattatagtagaaaagattgtgcgaaaatactaaatataggaaaaaaccttgaatttttcggggaaacaatgtaaaattgatacgttgaagatgtggcagagaggttctgccgccggagaggataagagaatcagatggaaatgaccgtaaaactgcaggtatttgagggacctttagatctgcttttgcacttgctcgagaagaataaagtaaatatctatgatattccgattgtggagatcacgaatcagtatatggaatacatcgcagagatgaagcgtcaggatctgaatgtggtaagcgaatttcttgtcatggcggcgacactcattgacatcaaatcccgcatgcttcttccggctccggagacggaggacgaggaagaagaggatccgcgtgcggaactggtacagcagcttttggagtacaagatgtacaaatgtatggcatacgagctgcgtgaccgccagatggatgcggagcgtgtcctttttaaggagccgaccattccgccggaggtggcagagtatgaggagccggtcaacatggaggagctcgtctcggatgtaacgcttgccagattgaatgagatttttaagtccatcatgaaaaagcaggtggacaagattgatccgatccgttccaagttcggcaagattgagaaggaagaggtatcgctttcggacaagatggcatatctggagaattactgcctgacgcacagccggttcagtttccgcagtctccttgaggcacaggcgggcaagatggagatcattgtcacgtttctcgccattctggaactgatgaagacaggcaagatatttatatcacaggaacacacctttgatgatattctgattcagtcaaagattgtggcatagagttggagttttcgggatgaatgaaaagaattacgaggcgatcatcgaggcgatcctctttacgatgggagaatcggtagagctggacaagatcgccgcagccatagaactggataaaaaagagacaaaagcgatcattgagaagatgatgaagcactacgagaatccgtccatcggtgtgaagatcattgagctggacgatgcgtatcagatgtgcaccaaaagcgagatgtacgaatatctgatcaagattgcgagacagccaaagcgccatgtcctgacggatgttcttctggagacgctgtccatcatcgcctataagcagccgatcaccaaggtggagatcgagaagatccgcggtgtttcctgcgatcacgcggtgaacaagctggtggaatacaatctggtatgcgagcttggcagactggatgcaccggggcgcccgctgctcttcggaacgacggaagagttcctacgaagctttggggtacagtcaatcgacgaactcccggtattaaatccggtgcaggtggaggaatttaagcaggaggcggaagccgagatgcatatgaagcttgatatatagaacataaaagaaatcctggtgcgaatctgtgagagacggataataaggaattgccgcaacaagcatagaccgctttgggtgataagtaatattatcagaagaccacaccgtgggatttcagatggaaatgcaggtggaaattcggttccaaaaatgtggcatttctaaccaactggatgtttgcatcttcgatgatccgtgtctttccaagtttggagcactccgcgggtcatgtccgcatcccggaagacaatttgtaggacttttgtgtgtgtcccttatggcacctctaagcaaaacataaccgcgcgaagccgatgtctgagtcggcatctgccttattttcaatagcagatgccggcgagtttcggttcgcgcggttttatattgtctgcgaagaggtgcccttagggacaccagaaagtccgcccattgtctccggtgtgccggacatgcacccgtcggattgtccaaacgtggaagagacacggaatccgatgcaaacattcagccggaagaaatgctcacatttttctccaacgaatttccatctgcattttcatctgaaatcccacggtgtagtctacttataatattacttatcaaagcaaagcacgatatgcttattgcggcagttcctttttgcgtgccgtttctgttctgcaaaaaatgagggacgcatatacatcagtgaagtcattttgggagaatggcatgtatcgacgctttctttctctattgttaagtatgagcttacttattttttcgcctgtgcgtgtccgggcgcaggatgtgccggcagagtcggaactgtacgcaaaatctgccgttttgatggatgcggattccggaagaattctctatgagaaaaacgggcatgaagcgatggcgaatgcgagcacgacaaagattctaacctgtatcgtggcactggaaaactgtgatccggcgagcgtggttacggtgtcaaaaaatgcggcgtcccagccgaaggtacatctggggatgcacgagggacaacagttttatctgagggatcttttatatggcctgatgctggaatcctacaatgactgtgcggtggccatcgcggaatttgcggcgggggaggtgcagggatttgccgcgctaatgaatgcgaaggcagaggaactcggctgtgaggacagctactttattacaccgaacggactggatgcgaaggatgatgccgggtttcatcacacgacggcggcagaccttgctaagattatgaaatattgtattaaggaatcgttaaaaagcgacgaatttctcgagattacacggacggcgcagtattctttttctgatgcagaggggaaatgcacgtaccagtgcacgaaccacaatgcatttttgcagatgatggaaggggcgctttccggaaaaacgggatttaccggaaccgccggatactgctatgtcggagcgctgcagcgggaggacaaaacgctgatcgtggcgctgctcgcctgtggatggccgaacaacaagacctataagtggtccgacaccagaaaactcatgaattacggattggagcagttcaaaaagatcgacctgctgcagattgagccggacgaagcggagcttgcgcccatagaggtgcgggacggacagggcggaaaaatcggcgaaacggtgtatttaaaactggttgtcaggaactatgcaggggaggagagtatcctggcgccgctaagcagtgaggttacgcttaggtatgagattgcagaccggctgtatgcaccggtgaagagcggagattacatcgggaagattcgttatatgctgggggaggagacgcttgcggagcgatgtgtggtagccggggagacaatcggaaagatcgattatccgtggtgtctggggcaggtgcttcggcttctctggatcgaataaaaaacacaaacaaaaagcgtcaaaaaattaacaatttacttgaaatattgcagaaaagcaattataatttaacatagcgtaatttgttgaatttttatacaaagacgcatggatttacatcattcactatgaagccgcatcccaaatggatgtggacaacaatttatagatggagggcaaaaagaatgaatagtagcaatgatagcctggctatgcagcgcatcaccaggttagtcgacgagaacagtttcattgagatcggttctctcgtaaccgcaagaagcacagattttaatcttgcagcaacggatactccttccgacggagtcatcacaggacacggcctgattgacggcaatctggtgttcatttacagccaggacgcttctgttttaaacggaacaatcggcgagatgcatgcgaagaagatcgctgcagtgtatgacatggcgatgaagatgggagcaccggtgatcggctttatcgattgcgcgggagtccgtttacaggagtctgtagatgcgcttgacggcttcggactgatctatgcaaaagaagttgcagcatccggcgtggttccgcagatttcagccgtattcggcagctgcggcggtggactggcagtggtaccggcactttctgattttgcttttatcgaagaatccaaaggaaagatgtttgtgaattctccgaacgcaattgacggaaaccgcatcgagaagtgcgacacatcatctgcggcattccaggcagatgagaacggctgcatcgacgcgacgggaacagaggatgagatccttgcagacatccgtgagctggtcggcatgcttccgctcaacaacgagggagatgtctacacagacgagtgtgcggatgacctgaaccgtgcatgcgagagcatggatgccatgaagggtgatccgagatatcttctcagtgagatttcggacagccatacattcttcgagacaaaggcaggctatgccagagacatggtgaccggatttatcaagttaaacggtatgacggtcggcgcagttgcaaactgcacaacggtatacgacgaagagggcaaagagagcgagaagtttgacaatgttctttccgcaaagggatgtgagaaggcagcagagttcgtatctttctgcgacgcattcgagatcccggtactgactctgacaaatgtcaagggctacaaggcatgcaagtgctctgaaaagcgtcttgcaaaggcacttgctcatctgacctccgcatttgcgggagctacatgtccgaaggtgaacctgatcacgggagaggcatacggtaccgcttatgttgctatgaattccaagtctatcggtgcggatttcgtatatgcatggccggacgcaaaggtcggcatgatggatgcggatcttgcagtaaagatcatgtacgcggatgcatctgcggatgagcttgcagagaaggcaaaggaatatgatgcactgcagggcagcgttatgacagcagccagaagaggctatgtggatctgatcgttgatccggcagatacgagaaagtatctggtagatgcgtttgaactgttatacacaaagtgcgcatatacaccggacaagaaacatggaacaaaatagaaaggtgaagtttatgaagaaaaaattatctcttatactttgtctttgctttatggctctgggacttgcagcatgcggaacagatccgacaacggttgactatttcggaatgacttacgatgaactgcagagcagcatggaacaggaagtttccgcgctggttggtcttacggacgacaacagaacctatatccagtcctacggcagcgatacggcaatgaaacttgtcgagagctgggatgaggcgacaagtgatgtcggcgcatatcagggacttggagaattcaatatcacaaaggcacagaaaaccttaacagtagatcagtatgtagagtatcagaatcgtgaagtcatcgtttcttacatctatacatacaattacgagaccgagcagccggagcttactgatgcatccgcggacaaggtatacacgctgggtgagaagatggagaaggctgcgttaaataccctgatgggaatgggaaccgtatttgtggttctgatcctgatcagccttattatttactgtttccgctttatctctgtaatacagaacaaggcggccggcaagggcaagaagaacgaggcagaggcaggcgctgtggtagagcagatcggacagcgtgaagagcagcttaccgatgatcttgaacttgtggcagttatttccgcagcggttgcggcaagcaccggtgcatccgcggattctttcgttgtgagatcgatccgcagacgctaattcgtataaatgaaaagaaatcatattaggaggatatttcaatgaaaagctatacaattacagtaaacggcaatgtatatgatgtaaccgtagaagagaacggcgcagtgagcgcaccggcagcagcaccgagacgtgcagcagcaccggcggcagcacctgcagcaaagccggctgctgctgcaggcgcaggcagcgttaagatcgaggcaggcgcagcaggaaaggtattcaaacttgagaagtctgtcggtgatgccgttaagaagggagacagcatcatggttcttgagatcatgaagatggagactccggtcgttgcaacgcaggacggtacggtagcaagtatcaacgtaagtgttggagatatggtagaagcgggcgcattacttgcaacattaaactaatttaggaggaagacaatgagctattttagtgagacaatggggaacctcctgcatcagaccgctttctttaaccttacctggggaaattttgtgatgatcattgtcgcatgctttttcctgtatctggctattgcgaaggggtttgagccattgcttcttgttccgattgcattcggtatgctgcttgtaaatatctatccggatatttttgcagacccggagcagatgagcaatggtgtaggtggtttattccactacttttatgtgttagacgagtggtcaatcttaccgtctctgattttccttggagtcggtgctatgacagatttcggaccgctgatcgcaaacccgatcagtttcctgcttggagctgcagctcagttcggtattttcggagcgtacttccttgcaatcatgatgggctttaatgataaggcagcagctgctgtttccattatcggtggagccgacggaccgacctccattttccttgccggaaagttaggacagtcgggactgatgggaccgatcgctgtggcggcatattcctatatggcacttgtgccgatcatccagccaccaattatgaagctgtttacaaccaaaaaagagcgtgccattaagatggagaacttaagaccggtttccaagctggagaagattctcttcccgatcgtggttacggtggttgtatgtacgattcttccgacgacagcgccgctggttggtatgctgatgctcggtaacctgttccgcgagagcggtgtggttcgccagctgaccgataccgcatccaacgcattgatgtacatcgtagttatcctgctcggtacttccgtaggtgcatctacgagtgcggaggcgttcttaaatacaacgacattaaagatcgttgcacttggactgattgcatttatgttcggtacagcagccggtgtcctgtttggtaagctgttatgcttcctcacaaagggcaagatcaatcctctgatcggatctgccggtgtatctgccgttcctatggcagcccgtgtatcccagaaagtcggtgcagaggaagacccgacgaacttcctgctgatgcatgcgatgggaccgaacgttgccggcgttatcggtactgcagtagcagccggtgtattcatggcaattttcggaatttagtgaaagagcaaatgccgtcatagacggatagcggtatcaaagtatccgctgataaggaggaaaaaatgtcagaagttgttaaaaaacctttaaaaataacagagacggtgctgcgtgatgcgcaccagtccctgattgcgacaagaatgacaaccgagcagatgcttccgatcgtagacaagatggataaggtcggatacaatgcggttgagtgctggggcggtgctaccttcgatgcatgccttcgtttcctgaaggaagatccgtgggatcgtctccgcaagttaagagacggatttaagaacaccaagcttcagatgctgtttcgtggacagaacatcttaggatatcgtccgtatgcggatgatgtggtagagtatttcgtacagaaatcgatcgcaaacggtattgatatcattcgtattttcgactgcttaaacgatgtccgcaacctgcagacagccgttaccgcatgtaacaaagagaaaggacatgcacaggtcgcattatcctatacacttggcgatgcctacactctggattactggatggagatggcgaagaaggtagaggatatgggtgctgattccttatgtatcaaggatatggcaggtcttttggttccgacgaaggcaaccgagctgattcaggcattaaagtctgcaaccaaccttccgatcgagctccatacacactatacttccggtgtcgcttccatgacatacatgaaggcggttgaggcaggctgtgacattatcgatacagcaatgtctccgttctccatgggaaccagccagccggcaaccgaggttatggtagaggcattcaagggcacagagttcgataccggtctggatcagaacctgttagctgagatcgctgactacttccgtccgatgcgtgaggaagcgttagagagcggtctgatgaacccgaaggttctcggcgttaacatcaagactctgttatatcaggtaccgggtggtatgttatccaaccttctgtctcagttaaaggagcagggcaaggaagacaagttcgaggaggttcttgcagaggttccgcgtgtgcgtaaagacctcggtgagccgccacttgttacaccgtcctcacagatcgttggtacacaggctgtgttcaacgtactgatgggagagcgctacaaagtggcaaccaaggagaccaaagacgtactgcttggaaagtacggtcagactgtaaaaccgttcaacccggagatcgtagacaaggtacttggcgaggagaagaagaacgccattacctgccgtccggcagatctgcttgagccggagctggataagatcgaggctgagatgaagcagtggaagcagcaggatgaggatgtactgtcctacgcactgttcccgcaggttgcaaccgaattcttcaagtaccgtgaggcacagcagaagaaggttgatgcaagcgtcgcagataccaagaacggagcatatccggtataatcaaaaaacagttaaaacaaaaagcgggtgagcagtcacctgctttttgttttaaaaatgggaaaattatgaatgcagggtatttgcagtaacatttcattgaaaaaaagagagtgtttcagtatcataggaatatgaatcgcaggatgatttgagatgcagtatcgaatgcaaaacagtaaaacaacaaaaaagaggatgacatgagaaaaaaagagaataggttgaaaacagcagcatttgttttgagcgcaggggtgttttttggtgtatgcccgtcgattgtgctggcagatgagccgggagaatggcgggaagaaaatggcagtctctattggtatgaaaatggcataaagcagggaacagaaggaaggggcaaggagatttatgatccggcgagcgatggctggtattggctggatgccattgatggggggaaaaaggcggtcggaaaggatgtgtatcaggaatcatgggcaggatcttatgcagaccatgaggacggcaccgggaaatgggtgcgctatgataccagtgggaaaatggtaaaaggctgggatgtgacggagagaggtacatactattttgaccagacgaccggagcgatggcaaaaggagaaacggagatagatggaataccatgtatttttgaccgggagacgggcattggctggaatctgcaatggcaggagagagagggggcacgatactggtatgaaggaggaaaacgtcagggactcgaaggcagagggaaggaaatctatgatccggcaagtgatgcatggtactggctggacagcgatgcgcaggggaaaatggcggtaaacaaggatgtttaccagccttatacaattcagggacaggatgagactggaaaatgggtacgctatgatgcagatggacatatggtaaaaggctgggacaggcagaatgaaaatacctactatttcgatcagacgactggagcaatggcaaagggcgtggcgaagattgatggtgtcagctattattttaatgaaacgaccggtgtttgtgaaggggagtatacaccatcagacagcagtgagccaacaaatgtgacaacttacacggcaaacgatcaggtcagtgaatatacagaaaatgagttggacgcgtcaggcaatgtggtaaaaagtacaacttacagtgcatcaggagtaaaaaaaacagaacgtaccgatgtatttgatcagtacggaaatcagatccggggaacttatgttatatatcggagaggggaagtttattcgacagcaacggatgagacagtgtatgagtataatgccgacggtcagccgttatccatgacatgttataatgattcacagatgttttcgcgggtactttatacatatgacaatggaaagactgcaaaagtagagtattatgttccgctggatggggaagaagaattaagtaattatgaacagtatttttacgaaaacggaagatgtgttcgaaaggaaaattatgtgctcagctatacagatggtgcgtggaatattagcttggatacatcggattattatgcatataacagcaatggaaatctgatccgtgagaccaataagagcgccagagggaatgtgaactactattatacatatgattatgatgcgagtggcaatctgattgccaagggctgttatgcaaaagatgacagtcagcagtggaaggaagtctgggcatatgagggaatgcttctggtaagcgattattattacagtgaagaagccctggaatattatattatctatgaaaacagacagcgcagcggtcatttatatcagaaaatagaaaaatcttatgcgggagatggaacgtattccggtaaaagggtatacacttatgaaggttagagggaaacggacaacccggtttccatcccttaccgtatgacaccgccggtaatccgttttctggagcagccggcaggcttcgttgcaaagttatccggcatccggtgaatgatgaaaaatcttcagatgataacaatgctgttggtttaatatatgcagcgttggaaaatgcgctgcatgtgaggaaagttccatgtacaatttcttgcaaaacacaatgtatttgatataataaaaacattgggcggatcacaattccgcagaagtgagggaaagtatgagcaatacaaatgacctgagtaaccgcatcaatgatgcttacagcaagttgagcaaaggacagaaacggctggcaacctacattacggacaattatgacaaggcggtatttctgaccgctgcaaagctgggcgaggttgtgggcgtgagtgagtccacggtggtgcgctttgcaacgcatctgggatataaggggtatccggaattccagagtgcgctggaggaactggtgcgcaataagctgaactccattcagcgcatggaggttacttacggcaggatcagccagtcgaagattctggagacggtgctgaaatccgacgcggacaagattcattccacactggaaaagattgatcagaacgcatttgaactcgcggttgacacgattctgcacgccaaacatatctatatcatcggaatccggagctgcgcgccgcttgccagcttcatggctttttattttaccctgatgtttccaaacgttcatctgattcagacaagcagttcgagcgagatttttgaacagatggtgcgcatcggcaaggaggatgtgatcatcggaatcagtttcccacgttattccatgcgtaccttaaaggcgatggaatttgccaacaaccggagcgcaaaggtaatcacacttaccgacagcgtgcattctccgatgaatctctattcttcctgcaatctgattgcggacagcgatatggcttccattgtggattccctggttgccccgctgtcggtgatcaatgcgctgatcgtggcgctctgcatgaaaaagcagaacgaggtggcgaaaacgcttgagatgttagaggatatctgggacgaataccaggtttacgagaacgatgagatcaattatatcgatgattccatcaagatgcggtatggaaaagtaggagatgcggaactgtatgagtaaggtgatcgtagtcggcggcgggccggcgggaatgtttgctgccattgcggcggcggagcggggacatgaggtcgttttgctcgagaaaaatgaaaagcttgggaaaaagctctacatcaccggcaaagggcggtgcaacatcacgaatgcgggggatatggacaccctgtttgccaatgtgatgacgaacccgaagtttttgtacagcgctttttacgattatgacaatcagagagtgattgatttttttgaggagaatggtctggcgacgaaggtggagcgcggcaaccgtgtattcccggtatcggatcattcttcggatgtgattgccacgctgcagcgggtactaaagcgcacgggtgttatggtgcagcttcatgcggaagtgcggcagatcctcaccggggaaggcgcggtgcgcggtgtgaagcttgccgacggaagcgttcttgaagcagagcgcgtgattcttgcaaccggaggattttcttatcagacgaccggttcgaccggagacggctatcgttttgcgagggaactcggacatacggtgacacagattacgccgtcactggttccgttctacgtgaaggagacctgcgcggcgaggatgcaggggctggcgctgaaaaatgtgcaggtgcgcatccgggacggaaaaaagctgttgtatgacgaattcggcgagatgctctttacccatttcggggtaagcgggccgctgattttaagcgccagtgcggcaatcaagccgggccgcgtggagaaggaactggcgatggagatcgacttaaagccggcactcacggaggaacagctggatgcgagacttctgcgtgaattcgaggaggcaaagaataagcagtttaaaaacgccgtcgtgcatctgttcccggcgaagatgattccggtgatgttagaagccggagcgattgatccggagaagaaggtcaacgagatcacgagagaggagcggatgggatttgtgcatctgatcaaggcgtttccgctgacgctctgcggtgtcagagatttcaatgaagcgatcatcacacgcgggggtgtcagcgtaaaggaagtgaacccttccacgatggaatcaaagcttgtgccgggattgtatttctgcggggaactattggatctggatgcgatgaccggcggatttaatctgcagattgcctggtcgaccgggcatctggcgggtgagagtatcgaatagaagaggagagaagaagagatgagtatgaatattgcgattgacggaccggcaggcgccgggaagagcacaattgcgaaaaaactggcgaaaaagctggcgtttgtctatgtggatacgggagcaatgtaccgtgcgatggcatactattttttacagaacggcattgcaccagatgatgagcaggcgattgcggcagcctgcccgaaggttgacgtgacgattgtgtatgagaacggcgaacagcaggtgctcttaaacggagagaatgtaaacggcgtcattcggacggaggaagtcggcaatatggcatcagcgaccagtgtctatccggttgtgcgcacaaagcttgtggaactgcagcggcagcttgcgacaaagacggacgtcatcatggacggaagggatatcggcacctgtgtgcttccagatgcgcaggtaaaaatatatctcacggcaagtgttgcgacgcgcgcaaagcgcagatatgatgaactgaccgccaagggaacccagtgcaatctggaagagatcgagaaagatattgaagaccgcgattaccgcgatatgcaccgggagacgtcgccgttaaagcaggccaaggatgcggtgttagtggacagctccgagatgaacatcgacgaagtggtggacgcaatctatcagatttatgcgagggtatagagaatatgaatgtaatcttggcaaagagtgcgggcttctgcttcggggtaaaacgtgccgtggatacggtatatgaacggattctggaaaaagaaccgctctacacgttcggaccgatcatccacaatgaagaagtggtgcgcgatctggaggaaaagggcgtcgtcgtggtaaacgatgtggacgaacttgcggggaagccgcaggggacggtaatcatccgggcacacggcgtggagagaggtgtctgcgagaaaatacagacgctcggtttttccatcgtggacgcgacctgcccgtttgtgttaaagattcaccggctggtggagcgctacagtggggaggactgtcacattgtgatcgtcgggaatgccagccacccggaggtgaaaggcatcaaaagctggtcgaatgcagaggatacgcgcgtgatcggaacccgcgaaggggccgaaaaatacgatgcttcccatgggaaaaaggtatgtattgtatcacaaacgacatttaattacaataaatttcaagaattagttgaaattataaaagaaaaaggttatgatataattgttttaaatacaatctgcaatgctacggaggaacgtcagacggaagcccgggcaatcgcggagcaggtggatgccatgattgtgatcggtggcaggaacagctccaacacgcagaagctatttgaaatatgtaaaaacgaatgcaaaaatacttactatatacaaactgtaaaggatcttgaccttgccgaagtcaggtctgtcgataacgtaggtattaccgcaggggcttctaccccaaacaatattattgaggaggttcaaaagaatgtcagaaatgagctttgaacaaatgctggaagaatcatttaaaacaataagaaatggagaggtagttgagggtaccgttatcgatgtgaaacctgatgagatcgttctgaatatcggctacaaggcagacggaatcattactcgtaatgaatacacaaacgaagcaaacgtagaccttaccacattggtatccgtcggcgacaccatggaagcaaaggttttaaaggtaaatgacggtgagggtcaggtattactgacatacaagcgtctggctgccgagaaaggaagcaagagattagaggaagcatttgagaacaaggaagtgctgaccgctaaggttgcacaggtactggatggaggattatgcgtaaacgtagatgagacaagagtatttattccggcaagtcttgtatcagatacctacgagaaagatctttccaaatacaaggatcaggagatcgagttcgttatcagcgagttcaatccgaagagaagaagaatcatcggcgacagaaagcagcttctggttgctaagaagttagagcagcagaaagaactgttcgcaagaatcaagatcggtgatgtattagagggaacagttaagaatgtaacagatttcggtgcgtttattgatcttggcggagcagacggtctgcttcatatttccgagatgtcctggggcagagtagagagcccgaagaaggtattcaaggtaggcgatcaggttcgcgtattcatcaaggatatcaatgagaataagattgcactcagcatgaagttcccggcagagaatccgtggaacggcgcagcagagaagttcgcaatcggcaacgttgtaaagggcaaagttgcaagaatgacagacttcggcgcatttgttgagcttgcaccgggtgtggatgcactccttcatgtatcccagatttccaaggagcatgtagagaagccgtccgacgtattaaaagttggacaggagatcgaggcaaagatcgttgatttcaacgaggaagagaagaagatcagtttatctatgaaggcactgctcgcaccggaagaagatgcggatgcagatgttgcagatgtagatattgatgcggttgcaaaggaagaggagtaatctctgatttcgatgattgtagagttacagataggcttgcacgttggtggaagcctatttctgtatttgcatcatgtagataacaaagagagccgagggataaaatatgctggaaacggacaattatgaaaagtttaaaaaggatattttagcgcttgcaaagattgatctgaattcttataaggaaaagcagatgcggcgcagaatcaacacgctgattacgaagaatcatattgcgacatatgatgagtatgtggcgctgatcaagaaggacaaagagaagtttgaacagtttatcaatttcctgaccatcaatgtgtcggagttttaccgcaatccggatcagtggaagattctggagaatgaggtattcccgaagctgattcagaagtttggcaagaatctgaaaatctggagtgctgcctgctcgaccggagatgagccgtattcgctggtaatggcattgtccagacacctgccgcttgcaaacatcaaggtgattgcgaccgacattgacaagcaggtgatcgatacggcgcggatgggactctacaatgagaagagtattgcgagtgtgccggatgacttgaagaagaagtattttaccaaggtcggcaattcgtatcagatctcggatgaaatcaagaaacgtgtggaattcaaggagcatgatcttttaaaagatccgtatccaggcggatgcaatctgattgtgtgccggaacgttgtgatctattttaccgaggaggcaaaggacgagatttatgcgaagttctataaggcgcttgcaacaggcggcgtgcttttcatcggaagcacggagcagatcatgaattaccgggagatcggatttgagagagacaagtcctttttctttgagaaggcgtaaggttacttcagagaacgcatttttctataaagcaaaaaagcggcaggaaagaagctgtgcagtatatgccagattctttcctgccgtttttggtggtaattatatcagggctttctgccatgtgtttatttgcggtgggaacgcatggtttctaacagatgcagaacatagtccatctgcatagcgggatcggcggcaaagtccgcggataattcaaaatagcatttcctgccgcgcggctgttcacggaacaccggggaaaacatggcgtcatactgcggaagaaagatggcatattttttgccgtagcagttggaagcgtttgcctgtacgcggtgttccttgtcgacagcagaagcaatgctcttgtgaactgcgatatcctcctcggggagatagtagtaatctttgggactgccgtcataaaagaagcgcagttctccctcgaagagacgcacgcgcagccgggcggtacttccgctcatggagagataacagtcatcgtaggagaaggagaccggtttgggaacggggtactgcagcgccagtgtaaaaaacagctccttgttgccggaggcaccgtccatcgaccggtactcggacgcctggagcgactgcagcgaaaatgcctgttcccagagtttcgggtaggagaggacgggcagaagcttcggcatatagagaacgtcctcatagttgtgctgtttcagcagtgcaagggaatcctttgcgggatgccgcacgtactctttgtagacttcgatcagctcgccgccggagtaggcatcgatgcggtcgatcccgagaaacagttcgatggatttctgtttgtagctggtcagggcaaacagaaatttgaaacgtgagacttccttataaagatcgatataactgtgcgcatcaaacggatcggaaaggtgcagcgtcttgcatttcgccttcagatatggaatgtcgaagccgataccgttgaacgtcagaatggtatcatagccggacaaaagatccagaaaggcggaaaggacatttttctgatcggcggcgttctcggaaaagaactggtcgatgcacaaaagactgccgcgccttgtggcgcagccgatcaggtagagatccgtgcgcgccggcgagaagccggttgtctcaatatcaaaaaaaatgcagttttctgtaaatacctcgttggaaacggggtctgaaaaatcaaaagtcagttcttcatgccaggttatcatctgaaaatcctctatatgtaatattagggtaaggggtattcgcgggcgctcgcatggagtagaaccgtccgcacttttgccgcagtgccagcccggaaaatcatagatttcccggactcgcgggcgttcgcggcaaatagcaatgtacgcttcggcaaaagtccggaaagcctgcggcttcccggactcgcgggcgcgttcacatggagcagaaccatctgctgcatgtaagcatgagcgtatgtttttgctccatgctcacttttgccttcacgtacattataacataaatgtggaaaaaatattgtgaattctttgtcaataggttcgtgaaaaaatacaataaattgctacaatttccgagtgattgtgctataatctacacgagggtattctatgacttttggcatagaatataatatagataagagaaagtggggcacgagaaatgggttctaagacatttaaaggcggcgtccatccttatgaaggaaaggaactggcaaaggatcagccgatcgtagaagttctacctaagggtgatctggtatacccgttgtcacagcatatcggtgcaccggcgactccggtggtagcggttggtgacaaggtgctgaaaggacagaagatcgcagaggcaggtggctttgtgtcatccccgatctatgcgtcggcatccggtacagtaaaggcaatcgaaccgcaccgtgtggcagtcggtgacatggtgaattccatcgtcattgagaacgacggagcgtttgaagaggtggagtacacgccgtgtgaagacgtgacggctctctccaaggaggagattgtcaataaggtaaaagaggcaggcgttgtcggcatgggcggtgcaggtttcccgacacatgtgaagctgtctccgaaggagccggaaaagattgaatatgtaattgcaaactgcgcagagtgtgagccgtatctgacggcggactaccgcagaatgctcgaaaatccggaagagctgatcggtggaatgaagatcattctccagctgttcgatcatgcgaagggtgttctcggcatcgaggacaacaagccggattgtattgaaaagctgacagagcttgtcaaggatgaaccgagaattgaggtctgtcctttacagaccaagtacccgcagggtggtgagcgtcagctcatttatgcagtgacaggccgtgccatcaattccaagatgcttccggcagatgcaggatgtatcgtggataatgtggagaccatcattgctgtttaccgtgcggtaaagcttggcagaccggtaaccaatcgtatttctacgattacaggcgatgccattgccaacccgggcaacttcttatacagcatcggtaccagctatgcagaactggtggaggctgccggcggatttaagacacagccggagaagattatttccggtggtccgatgatgggatttgcaatgtttagcctggatattcccacgacaaagacatcttcctcactgctttgcttaagcaaggacgaagtgtccaaggtggagccgtccgcatgtatcaactgcggccgctgtgtggaagcatgcccggagcagctgattccgtcaagacttgccaagttttccaataacggtctggctgaggcgtttgaatcctggcacggactcgagtgcgtggagtgcggaagctgcagttttgtatgccctgcacgcagacagctcgcacagtccattaagacgatgaaaaagcaggtacttgctgcaaaacgcaaaaaataattcaaaaaacaagaagagagaggtggattatcgtgagtgatttatatcatgtttcatcatcaccacacgttcgtgccaaagataccacaagccgtattatgctgtatgtgattattgcattgcttccgacaagcctgttcggaatttacaatttcggatataaggcattggttctgattctggtaacgattgcaagctgtgtggcatcagagtgggtatttaataagattgtacataaaaagcagacgatcgatgacctgagcgccgttgtaacgggactgctgctggcattgaaccttccggcaacccttccgtggtgggaggcggtaatcggcggtgtgtttgcaatcgtggttgtaaaatgtctgtttggcggactgggacagaatttcatgaacccggcgctgggcgcaagatgcttccttttgattgcatttgctgctgatatgacaaagtttggcatcacaaagaacgggattgaagtgtattccagcgtaacaccgcttgctgccatgcgtaacggtgaggcggtcaatacgatggatatgctgatcggacgcaccgcaggtaccattggtgagacatctgcgatcgctattctgatcggagctattttcctgatcctgatgggtgtgatcaaccttcgcatcccggcatcttacattattacatttgctgtattcatgcttttattcggcggtcatggatttgacggcagctatcttaccgcacagctttgcggcggcggtctgatgctcggcgcattcttcatggcaacggattatgtgacatccccgattacaccgatggggcagatcatctttggtatctgctgcggtatcctgaccggattgttccgctgcttcggcgcgaatgcagagggtgtttccttcgccatcatcttaagcaatatccttgtgccgcttattgagaagcacacagtgccgatggcattcggtcaggtgaaggaagcgaagaagcaggaaggaggcaaatagaaatgaacaagaagattgtacatgacgcattggttttatttgcttttactgttgtattaggtctgatcctcggcgtggtctacggcattaccaaaggcccgatcgaccaggtaaattatgagaagacacagtccgcttacaagcaggtatttgaggatgcggattcctttgaggagtacgctgatttcgacaccgctgcagcggaagatcttatggcgcagaatggatattctgacgatatcgaggctgtcaacacagcacttgacgcttccggcaatccgctcggctatgtgcttaccgtaacggcgaaggacggaagccagggcagcattacattctctgtaggcatccagaatgacggtacggtcaacggttattccatcacaagtatttccgagacaccgggacttggtatgaaagcacaggaagagccgttctacagccagtttgagggcaagaacgtagactcctttacggttgtgaagtcgacaccgtctgcggacaatgagatcgaggcaatttccggttccaccattacttccaaggcgatggcgaacggtgtgaatgcctgccttacatacttccacagcgtattagaaggaggtaactaatcaatgaacaagaatgtagaacgtttatataatggactcattaaggaaaatcctactttcgttctgatgcttggtatgtgtccgacacttgctgtcacatcctccgcaatcaacggacttggaatgggactttccacaacagtggtactggtactttccaatatgctgatttccgcattccgtaaggtgattccggacggcgtgcgtatgccggcatacattgttatcgttgcatcgctggtaacagtggtgcagtttatcatgcaggcgtataccccgagcctctccgagtcgctgggtgtgtatatcccgttaatcgttgtaaactgtattatcctcggccgtgctgagagctatgcttccaagaatccggtagttccgtctcttttcgatggacttggtatgggacttggatttacgatgggtcttaccctgatcggactgttccgtgagcttctgggcgcaggtcagatctttggtttccagattctgtccttaagctggttcacaccgatcaccatctttgttatggcaccgggagcattcctagtactggcatgtctggtagctgtgatgaagatcgtccgtgagaagatggcagccaagggcaagccgcttgccgagccgtccggatgtatcaccggagactgtgcaggatgcagtatgtctgctgcatgcaccggtaagaaaccggcagcggaagctccggcagaaaaagcagaataggaggatagatacggatgaaaacattacttttaattgcaatcggctctgccattgtcaataacgttgtattaagtcagttccttggtatctgtccgtttttaggcgtttccaagaaaacagagaccgctgccggaatgggtggcgcagttgtattcgttatcacgatctcttcgttcgtgacagcgctgatctacaaatatatccttgccaacagctatctgatgagcaagggcattgaccttacctacctgcagacgattgtatttattcttgtaattgctgcactggtacagttcgttgagatgttcttgaagaagtccatgccggcattataccagagccttggtgtataccttccgctgattacgacaaactgtgccgttctcggtgttgcactgacgaatgttaccaaggaatacggtattttggagagcgtggtaaacggttttgcaaccgcatttggtttcctgattgcgatcgttttaatggcaggtgtgcgtgagaagatcgagtacaatgatatcccgaagccgtttcagggtactgcaatcgtattgatttccgcatgtctgatgtcaatcgcattcatgggattctcaggaatgatttaggaggaaaaagaagatgaacgttacagcaattttatttgcagccttaatcgtgggcggcgtaggtatcttgattggatttttccttggtatttccggagaaaagttcaaggtagaggtagatgaaaaagaggaagcaatcttaggtgtgcttccgggaaataactgtggtggctgtggttatgccggttgttccggtctggcagcagcaatcgcaaagggcgaggctccggtcaatcagtgtccggtcggcggcgcgccggttgcagccaagatcggtgagatcatgggtgtggcagccgaggaaggcgagcgcaaggtagcatttgtaaagtgtgcgggaacctgtgagaaggcaggacgcgattacgagtataccggcaacgaggactgtgcagccatggcattcgtgccgaacggcggaccgaagtcctgtaattacggatgccttggatacggtagctgtgtaaaggcttgtccgtttgatgcgattcatatcgtggacggcattgcgcaggttgacaaggaagtatgtaaggcatgtggaaaatgtgttgctgcatgtccgaagcatctgatcgagcttgttccttacaaggcaaagcacattgtacagtgcagctccaaggataagggcaaggatgtcatgaaggcatgttccgtaggatgtatcggatgtcatctgtgtgagaagaactgcccgaaggatgcagttcatgtcattgacaacgtggcatacattgatcaggagaagtgtgtcggatgcggtatctgtgcacagaagtgtccaaagaaaattattctgtaagaatgattttctccgaaaatcatcctgtaagaatcgtttcttggaatgaaagtgtgaaataaaaacaggcgtgaagaattcgcggtaataagtacgaattcttcacgcctgttttgttgtttaatcttccagaatctcatagggaatgacggttcccatgccggagctggtgtgtacttcatagtcgtctgtgatgaaaatagcttccgtagcatcaaggctttcaacgagcgccataccgtcttccagcccgagggagaaacaggtggtggagagaccgtcgccgtccaccgatgcaccggtgatgatcgtgacctcaaggagcccgttatcgtaagggtaaccggtcgcggtgtccaggatatggtgataacgcgtcccatctacttcaaaatagcgttcgtagacgccggaggatacgacggtctgatcggtgatggagacggaggcaatcgcttcgttttcctcaccaaacggacgctgtatgccgatggtgtatgccgaaccgtccgtcttcgcgccgagcgcaagcacatttccgccgagattgatgtaaccggaagtaattcccttctggttcaggtaggctttcatctgatccgcgatatagcctttggcgatgccgcccagatcaatcctggcatcgggattttgcagagtcactgtgttgccgtcaatctgaatctcccggtaatccactgtggcaagagccgcctgaatgtccgtgtcggaggggatcatggagacatcggtctgatcaagcagcgctttggttgagatgtcccacagatcggaaagccgaccgatggtgatgtcgaatttgccgccgcttaagtcgccatatgagatgccggttttaagaagttcgatcgtctcgtcgtgtactgtcacgggagcgccgcccgcatcgttgattttggaaatatcgctgtctggaatcgtattggaaaaatatccctcgtacttttgcgcaagggcaaaacagtcatcgagcagttcctcgctccctttttcatagatcgagaccgagatgacggtgttaaaataaaatcctgacttggtaaccggttcgtccgccgtgcggctgcagccggagagcagcagatttgcagagagcaggggaaccagaagacaggagagtaccttcttttttctcatcataaaaatctccatttctgatgtttcccatccaatgtaccataaactttctgttcatacaatgtgaaaacatcaatttgccattttgatgaagatatgatagagtaatacagtatgagactctatgcccatttgggatgaatgattggaaaatgttacatataaaggggacgttagacagatggaacaaaagcattttcattttaatgagaaaaagagagttgtagtcaagatcggatcttcctcattgaattacggggagacaggcaatctgaattttaccaagctggagcatctggtaagagaactctgcaatctgcggaaccgcgggatggatgtgtgtctggtaagctccggcgcgattgccgtgggcagacagacgctcggcatggatgagcggccgaaggacatttcgacaaagcaggcatgcgcggcggtcggccaggcgcggctgatgatgatctatcagcggctttttgcggaatacaatcaggtggcagggcaggtgctgatgacgaagaacacgatggtgaaccctgtctcgagagagaatgcgaagaatacgttcgacgaattgttccgtcttggcgcaatcccgattgtgaatgaaaatgatacggtttctacttatgagatgcagtttggcgacaacgacacgctctcggcaatcgtggcttctctgatcggggcggatcttttgatcctgctctcggatatcgatgggctttttaccgacgatccgcacaagaatccggatgcaaagctcattgaagtggtggaggagatggatgcgtcaatctacggcatggcgaaaagttcgaccggcagtgatgttggaaccggcggcatggcgaccaaattgacagccgcaaagattgcaacgctctcgggaacagacatgattattgcgaacggcagggatgtctgcattctgcatcatatatttgatgattcctttaagggaaccatttttcaggcaaagaagaaagaatctttccggattgaagattttattttggagacgatcggttaagaatacaggaaaaggagcactatgaaccaggaacagattgacagaatcaatgcgttatatcgcaagtcgaaggcggaagggttgacggaggaagaaaaaaaggagcaggcgctgctgcgcaagcagtatgttgcggatgtgaagaaaaatctggcggcgcagcttaacaatatcgatatggtgaatccggacggttccgtggagaaccttggagataagtatggaaaaaagacaggactttcctgacgcagcgctgacacaggagaaggcgcgtcagcagataagggcgcggcacaaagcatggcggatggaactgccgcaggaggaagtgcaggaaaagagcagaaagatctgtgagaggctggcggcgtctgactggtatcataacagcgctgtcatctacggctattatccgctcggcgcggaggctgactgtctgccgtttctggcacaggcactttcggacggcaagacggtggcgcttccggttacatcaaaagagcggttgcagcgggactgcggccaggtgaagagaatgcaggacacacaccggatggagttttaccggatcagagagctttccagggtgcgggagggcgcctttcatgtgatggagccggatgagagctgcaaacggatcgggggagaggatgcggtggtgctggtgcccggactggtctttgaccgtaaggggaaccggtacgggtatggcggcggttattatgaccgctattttgcaaggtttccgaagctgtcccgcatggcggtagcgtttgaagggcagatcgaggaacagcttgcggtgcttcccaccgacgtgcggatgcatcggatttatacggaggagcgggaatatcggatctgacagaaaggatggaaaggatatggaactgacagaactttgtaagagcgcaaaagaagtgagcagacagatcggcaatctggacacgaatacgaagaacgaggtgttgcgtgcagcggcagaggcaattgtggcacatactgaagagattatccgcgagaatgagaaggatctcgcccgcggcagagagaatcatatgcccgaaggactgctggaccgtctgatgctcaacccatcccggctggagcagatggcggagggactgcggcaggttgcagaactttctgatccgatcggcgaagtcctttccatgaagaagcgcccgaacggtcttatgatcggtaaaaagcgcgtcccgctcggtgtggtcgggatgatctatgaggcgagaccgaatgtgacggtggatgcgtttgcgctgtgttttaagacgggcaacgcagtgatcttaaaaggcggcagtgacgccatttcgtccaatatcgtcattgtttcggttctgcaggaagttttggaggcacatggcattccgcgtgcggcagtatcgctgattgaagatacaagccgggagacggcggctgcgttcatgaagatgaacgaatatgtggatgtgctgattccgcgcggaggagcagggctgatccgcgccgtcgtcaatcaggcgacgattcctgtgattgagacgggaaccggcaactgtcatatctatgtggatgagagtgcggatttcgatatggcaatccgtattattttaaacgcaaagacccagcggatcggtgtgtgcaatgcctgtgaatcactcgtgatccatgagaaaatcgtggatgcatttatgccaaagcttgcggcggcactgcagcagaaggatgttgttatttatgcggatgagaaaagtcttgcagcggcagagcgccgggaggcggcaaatgacggagacctgaaaaaggaactgttgtcggcggcgacggaggaagactggggcagggagtatctcgattatatgatctccgtgaagacggtgtcgtccctcgacgaggcgatcgcacacatcaaccgctacaataccgggcattcggaggcaatcatcacagaaaactacacgaacgcgcagcggttcctggatgagatcgatgctgcctgcgtctatgtcaacgcatcgacgcgtttttcagacggatttgaatttggatttggcgcggagatcggcatcagtacccagaagcttcatgcaagaggaccgatgggactggatgcgctgaccagcacaaaatatattatatatggaaacgggcagacacgtccgtagatggtaaggatgaagatgaaaaagaaaatagacattgaaataatcgataaaaagcagatcccgcagagcgagccggagcgtcagtattactttatggacattgctaaaaattatgtggaacagctcgctgcaaaaaaaggcagtccgctgacctttcatgtcacgacgttcggctgccagatgaacgcgcgcgattctgagaagcttgtcggtatcttagagcgcatcggttatgtggagacggatacggaggaagcggattttgttatttacaatacctgcacggtgcgtgaaaatgcaaataacaaagtctacggaagactcggggtactccagaattataaaaagaaaaatccacatatgctgatcggactctgcggctgcatgatgcaggagacggtagttgttgaaaaattaaaagaaagctaccgctttgtggatctgatcttcggaacacataatatctacaaatttgcagagctgatcgtgacggcgatggaatcggattccatgacgattgatatctggaaggacacggaccagattgtggaggatctcccggtagagcggaagtattcgtttaaatctggcgtcaatatcatgttcggatgcaataatttctgcagctactgtatcgtgccgtatgtgcgcggaagggagcgcagcagggagccgaaagagatcatccgtgagatcgaacagctcgtggcggacggcgttgtcgaggtcatgctgctcggacagaatgtcaattcctacggcaagaatctgaaggagccggtgacgtttgcgcagcttttagaggaagtggagaagattgaggggttagagcgtatccgttttatgacctcccacccgaaggatctctcggacgagctgatcgaggtgatgggacgatccaaaaagatctgcaaacatctgcacctgccattacagtccgggagcagccggatcttaaagatcatgaaccgcagatatgataaggaacattatctggaactggtggacaagatccgcgcggcagtgccggacattgcgctgacgacggatattatcgtgggattcccgggggagacggaggaggacttcgaggagacgatggacgtggtgcgaaaagtgcgttatgacagcgcgttcacgtttatctattccaaacgtaccgggacaccggcggcatccatggaagagcaggtgccggaggatgtgatcaaggcgcgttttgaccgcctgcttaaggaagtgcagaagatctccgcagaaaaagcggaggcgctgaccggacagacgctgccggtgctgattgaagagcaaaacgagcaggatgcttcgcttgtgacgggaagactcagcaataactcggtggtacatctgccggggacagcggacatgatcggaaagattctggatgtaaagctgaccgagtgccggggcttttattaccttggcgagcgggcagacggaaatggtcagacggtatgaaaaagcgaatcagcagaaacgatgtgatttttcttgcaatactgcttgccgtggttacggtatttcttgtgatctatgagcggacgggaatgcgcgcggatgcgggtgcctgtgtgcgcgtcaccgtggacggcagcgtgtacgggacctatgcgctcggggaggagcaggagataccgattgtgcaggacggcgtgacaacgaatgtcctgacaatccgcgatggcagggcggacatgacggaggcggactgcccggacaagctgtgtgtccatcagaaggcaatctctaagaatcatgagatgattgtctgtctgccgaacaaagtggttgtggaggtgacgggaagtgaagaaaacggattcgactccattgcgagataaggtggcgtatctcggggtttttcttgcgcttgccttaatctgcagctatgtggaatccctgatcccgttttatttcggaataccgggggtaaagctggggctcaccaatattgtggtggtactgatgctgtactgtgtcggcactaaggaggcgtttgccatctcgatgctccggattgtactggcgggttttctgtttggcaatctgttcagtatcttatacagccttgccggcggaatgttcagctttctggtgatgtatcttttgaaacggaccggaaagctcggtgtgctgccggtcagcgtcgcgggcggaatgtcacacaacatcggtcagattgccgtggcggcgtttgtggtggagaatatcaacattttttactatctgccggtgcttttcgtggcaggcatcgttacgggactgctgatcggtgtggcagcccaggagatcatactaaggattggcggacggctgaaacgataaggaggaaatacgtgtgtacgcatatataaaaggcgtccttgcggatgtggaagaagagagcgtggttgtggaggcaggcggaatcggataccggatctatacgaccgggcagacgtttgactatcttccggctgtgggagaggaagtcaagctctatacgtatctgaatgtgcgcgaagatgcgatgattctgtacgggttcctgacgaaggatgacctgcgtgtcttcaagctgttaatcggcgtcaacggtatcggcccgaagggggcgctggcggtgctgtctgtgatgacaaccgatgatctgcgatttgcggtgcttggcgatgacgcgaaggcgatcgccaaagcgcccggaatcggtgcaaagacggcacagcgtgtgattttagaactgaaggacaagctgtcgcttgaggaggcgtttgaacttaaatccgagcatgtgagcagacagaacgagaacggaagcagcggtgtgaagaatgaggcggtgcaggcgcttgtggcgctcggctatgcctcttcggaagcgttaaaggcgttaaacggcattgagatcacggatgatatggatgtggaaacactgttaaaagccgcgcttaagaatatggcattcctgtagtaagggaagcggcaaggcggaagaaaggaaagctgggacatggagaagcgggtcatatccacgcaggtgcaggaggaagatcttaagatcgagaaaagtctccggccgcagacgctggacgattatatcggacagcagaaagcaaaggaaaatttaaaaatatatatcgaggcggcaaaggcgaggggagaatccctcgaccatgtgctgttctacggaccgcccggacttggaaagaccacgctcgccggaatcattgccaatgagatgggaacacatatgaaggtcacttcgggacctgccatcggaaaaccgggggaaatggcagcgatcctgagtaatctgcaggagggagatgtcctctttgtcgacgagatccaccggctgaaccgccaggtggaggaggtgctgtacccggcaatggaggattatgccattgatatcatgatcggcaagggagccacagcgcgctccatccgtctggatctgccgaagtttaccctggtgggagcgaccacgcgcgcgggacttttgtcggcaccgttaagagaccgttttggcgtggtgcatcatctggagttctacacggtggaggagttaaaaacgatcatcctgcattcggcattgacacttggggtggagatcgatgaggagggtgcttacgagatggcgagacgctcgcgcggaaccccgcgtctggcgaaccggctgttaaagcgcgtgcgcgatttcgcgcaggtaaaatacgacggccggatttcaaaggaggtagcgtcctttgcactggatctgctggaggttgacaagatggggctcgatcagaatgacaggaacattttgatgacgatgatcggaaaatttgcgggcggaccggtcgggctggacacgctggcggcagcgatcggtgaggatgccggaaccatcgaggacgtatatgaaccgtatctggtaaagaacgggctgatcaaccgcacgccgaagggacgggtggtgacagagctggcataccagcatctgggaatcgaacattccgtatagaaatagttgcttttccttaaatatgtcagtataatatactatatattgtagcggatacccgagtttggaggaaatggtatggcagagaagacaagcgccgaagtgatcatcggtggaaaggtatacacactgagcggttatgagggcgaggagtacctacagaaggttgccacctatatcaacaataagctgggcgagtttcagggcatggaagagttaagacatctatccggcgacatgaaggcgacgctgttgcagttaaatatcgcggatgattactttaaggcgaagacacaggtggagaagcttgagcgtgagatcgagcagaaggaaaaggaaatctacgatctcaaacatgatcttatttccaatcagatcaaggcagagagcgacgagaaagccagaaaagagctcgaggagcagaacaaggagcttttaatcaacaaggctaagctggaggcgagtctcgaggatgcgctgctcggcaaagtaccggaaaaagataaaacagaagaatagacaatacggggacgtaagagatttgctttcgtcccttattttcatataacaggtaagaaaaatgatgcagaaaagagaattggagctgctggctccggcgggatcatacgagacgtttgaggcggtcatacgggcgggggcggacgcggtatatctgggcggcagccattttggagcccgcgcatatgcgaataattttaatgaggaagaattgctgcgtgccatcgactatgcacatatccatggcagacaggtgtatctgacggtgaacaccctgttcaaggaggaggaactggaacagggactctatgagtatctgctgccgtattacgagcaggggctcgatgcggtgatcgtgcaggatatgggggcgtttgcaaggatacgaagcatgttccccgggatggatattcacaccagcacgcagatgactgtgaccggcgcggcgggtgcgacgtacatgaagcagctcggtgcgagccgggtggtcatggcgcgggagatgtcgtttgccgagataagagaaatccatgacaaggtgggaatcgagatcgagagttttgtgcacggtgcactgtgttactgttattccgggcaatgtctgctcagcagtatgctgggcggcagaagcggcaaccgtgggcgctgtgcacagccgtgccggcttccctatgaggtctacaaaaaggatcagaaatcccgtatcgcgtgcggcaattacgtgttaagcccgaaggatctgtgtacgattgatgccattcccgcacttgcagagagcggcatattctcctttaagattgagggacggatgaagcaggcggagtatgcggcaggcgttgtatccgtttaccggcagtatatggaccgttatctggaccggctgaatgaggagagagcgggcggctgcagcgaggatgaggcacgccggcgggcgaagaaggcttacgcggtaacggaggaggatcacagaaagctgctggcgctcggcaaccgcagcggttttaccgacgggtactatttccgcagaaatggcagggagatgattacctttgattccccgggacatgcgaagacagacgaggcactgcagaagacggtgcgggaacactatatcaaagtgcggccggagcaggaaatcaaagaaaaaatcaatggattcttaagattaaaaaaagatttatctgctacactgaaactgcaatgtgaaggatgtgagattacgtgtgagggggagcaggtattgcaggcgcagaaacagccgctctcgcgtgacagggtggacgtctgtatgagaaaaacaggaaatacaccgtttgcatttgaacagctggccattgagatggacgaggatgtttttctgccggtgcaggcactaaacgcgctgcgtagggaggcacttcttgcactggaggagaagcttctgcagggataccgcagggatggggcagcgtccccggaggcggagaagttaggctgtggcgcggacaaaaggacgcggcaggaggagcgaagagaagcagaggatgccggtaaaacggtcatcgtttcgttggagaaccggtgtctgctgtcggtggtgcttcgttcttcctttgtacatgagatttatgcggacagcagctgctataccagggatgaattatggatggcacttttaaaagatgcaggagaggcacacctggcgggaaagaaattctactatattctgccggcggtatttcgcagcagaacggcagcattttacagggagaatatagagcacttaaaggcattgccgctggacggatttgtggcaaaaagttacgatgccgccgcatttgtgcggcaggagctgggtgcggagacgccgttaattttagatcacagtctctatagctggaacagtgcagcgcgggatgtgtttttgcagcttgcgccagagcgcgataccgtaccgcttgaactcaaccggagcgaactgtttgcgagagacaatcatcacagcgaggcgatggtgtacggttatcttccactgatgacatccgcgcagtgcgtgcatgcgaacacggagaagtgtgataggaagcgcggaatcttatatctgaaggatcggtatggaaaatatttcccggtcaaaaataactgcacggagtgttataatacgatctataataccacgccgctcatgctttttgacgaacgcgcggattttttacgcatgggaattgccgcataccggatatcgtttacgattgaggaggaagagcaggcggctttcatactggatctttttgagcggacgttcctttccggaaaacacagcgtaaaggaactgtttcccgacggctacacgaggggacattataaacgaggggtcgaataaccaatgacagatttgattgtagaattatcaaaatatctcatgacacttttgttcgcgttctatacgtacgagtgtttttcctcattccgcgggaagcttaccccggagaaaagggcgaagatatttaagcgtcagatgtgcctgatgtatctcattcatctggatgcgtttctggcaatctacgcggtgacggacgatatccgcatgattttgttctatgtggtgcaggcggcgtttattgccgtcacaatttccagttaccgcctggtgtacggaagggcttccgggcttttgatcaacaatatgtgcatgctgttaatgatcgggtttattatgattacaaggctttcctttgacaaggcgatccggcagtttgccattgcggtgggggcgatggtgtgttcgctcattataccggtgctgattcagaaagtgcgctttttgcggaaaatgccgtggctttacgcagctgccgggatcatcggtcttctggcggttctggcgttcggaatcacgagcagcggtgcgaaaatatcaatctcgattgccggaatatcggttcagccgagtgaatttgtcaagatcatatttgtattttttgtggcatgtatgctttacgagaatacggatttgaagcacgtgtgcatcgcgacggtgctggcagcggtgcatgtcctgattctggtgttatcaagagatctgggaggagcactgatcttctttgtgacctacctggtgatgctctatgtggcgaccagaaagctgttctattttgcgggaggacttctgaccggatgtattgccgcagtggtggcatatcagctgttttcccacgtgcgcgtgcgtgtcctggcatggcaggatccgctctcaagaattgagaatgagggctaccagatctgccagtccctgttcgccatcggtaccggcggctggtttggaatgggactataccaggggatgccggaaaagattccggtggtcgagcaggactttatcttttccgccattgcggaggagatgggcggcatttttgcaatctgtcttttgatggtgtgcatcagctgctttttgatgttttttaatgtggcgatgcagatgaaggagcagttttacaagctgattgcgctgggactgggaaccgtatacggatttcaggtgttcctcaccgtcgggggagtcacaaaatttattccgtcgacaggagtcacgcttccgcttgtcagctacggaggaagctcgctattttcaacgatgatcatgtttgccgttgtgcagggcttatacatcagacggcaggatgagggggcagcaaatgaaagaaaaaatgcagcaccgccaagacgaagaaaaacaggatttgacgaagatgtggaaactttttcataaaaacggaaagaaaaaaaagaatacaaaaaaccgggaatttgcggtagtaacctactcttttctggggttgtttctgtgcctgatgggctattttgtgtattttgagcaggtggagagcgaacagtttatcaataatccgtacaacaaacggcaggagctctttacgcgcagcgtcgtgcgcggcagtatctattccgccgacggaatcacactggcggagacggttacggatgcagagggaaatgagacgagaaagtatccggcgggcaggatctttgcgcatgttgtcggatattccacacacggtacttccggcattgaggcgatggcgaatttcaatctgctgcgctccaacattctgtatatggagaaggcggtcagtgagatcaagggagagaaaaatccgggggacagtgtcacaacgacgttgaattatgatctgcagcttcaggcgtacgatgcactgggaagctatgacggggcggtcgttgtgatggagccggagacaggcagtatccttgccatggtgtcaaagccggatttcgatccgaacacgatcgcggatgactgggatacctttgtgtcggacgacagtgacagctcggttcttctaaaccgtgccacccaggggctgtatccgccgggatcgacgtttaagatctttaccacgctcgagtacattcatgagaatgcggactatgcggactatcattttgactgcagcggcgagtataccgtgggcacaaagaccatccactgccataacaataagcggcacggatcggaggatttaaagacctccttcgcaaattcgtgtaactcctcctatgcgtccttaggactcacactggatctggaacagtttgatgatctctgtgaccagatgctgttcaataccgcgcttccgacggatttcgagtcgtcgaagagcagctttgtgctggagccgggagacagcgattcagcggtgatggagacgtccatcggacagggtaagacgcttgtgacaccgtttcacatggcgttaatcgcttctgcgatcgccaacgacggtgtgctgatgaagccgtatgtgattgaccgcatcacggatgcggagggcgaggttgtggagcagtatgagcctgcggagtacaaaacactgctctcggagagcgatgcgtccgttttgcaggaatatatgcgctatgttgtggaggaaggaacagcgaccaagttaaggagcgacagctatgaggcagccggaaagacgggttcggcggagttctcatccagctcggacgccacacattcctggtttgtgggatatgcgcataacggggaggaaccggacatcgcggtggcggtgatcgtggagaattccggcgtgggaagcgagtatgcggtcccgattgcaaaacagatctttgatgcgtattatacatgggaaaactaagcgcatacgaggttgcgtgaagtctgaaaaagtattatactggatataattatgaaaagaccacatcgggaggtattgcaatgatagaggcaacaagctgtggcggtgtggtaatattccgtggtaagatattgcttttatacaagaattataagaacaagtatgaaggctgggttctgcccaaggggacggtggaagccggggaggagtatccggatacggcaacgcgtgaggtgttggaggagaccggggtgaaggcggcaattatcaaatatgtcggcaagagccagtattcctttacggtaccggaggacacggtggagaaggacgtccactggtatcttatgatggcagacagttattacagcaagccgcagcgggaagaatattttgttgattccggatattataagtatcacgaagcgtatcatctcttgaagtttccgaacgaaaaacagattctggagaaagcttacaatgaatatctggagcttaagaagagtaatttgtggggaaatcacaaatacttttagagcagtgtgatatggagagcatgcatgacatggtatgacgagttatatgtaggggaaagtattgtacataagacaaagcgcgtgaagtggaaaatcaaccacaatgcgggacagatcggcatttatgtgatcgcgcctgcgtcgaatgacaaaaatcttctggatattatcccggctgccgaacttttgcagaaagggtatccgaagaaagaccttaagattgccggacttgccgggagttatgatgaggcgctggaagtggcggtgtcgattgtggatgaagtataccggaacacaggagcgttttttgtgcgcagttatctggatgagcaccggagcggcagggagggataatggcagttctattgctgatattaaaaataattggaatcatcctgctgatcctgcttggactgatcctgctcattttggcagtggtgctttttgttccggtgcggtatcaggtgagcggcagcatcggggagaagacgaccgtccggattgcggtgacatggcttttgcatgcggtaagctggagggcagcgtacgaagaggaagggttttcttcacagctgcggatctttgggatcacccggaaaggaaaaaagccggacgatggagaacccggggaggatgaccgggaggacggtgcagaagaacccgaagagcgcagtgcggcagatgtccccctgacagacggggagcagaaaacaggcggcattctgacagacggagagcagggagaggcggaacggttcgacgagaggcaggcgaagaaagtctgcgccggggcgaaggagccggatcctgcggagcataaggaactggaacaagcgaatccggctgtgcgcagaaagcagcgcggcgggctgtttcggcggatatgggagcgtatccgtgcattctttgcaggactcgtcagaaaactgcggcagcttcgtgccggcataaaagaggctcttaagaaaataaaagatgtccgtacgtttttgacggacgagcggcacagagaggcgctgccgctcatttttacagagttaaaatacctgctgacccattttaaattccgaaggatccggacggatctgacattttccatgggggatccggcgctgaccgggcaggtgctcggaggcttatgtatgcttccgtttctgtatcggtatcaggtgcaggtatatccggactttgaagcggagaatacctatgtaacaggcacatttgatataaaagggcgtgcaagaggactgcatatcgcagtatcggcagtccggctgcttggcaaaaaggagttccgcatctggctgaaatggctgatgcacagataaaggataagaaaggggtaacattatggcagataacagttttcacacaacagtagaatccctgtttaagggaatggacagttttattacgacgaagacggtggtgggtgatgcgattcatatcggggataccattattcttccgctcgtggatgtatcattcggagttgccgcaggagcattttcacaggataagaagaacaacggagcaggcggtatgggcggcaagattatgccgagcgctgtgctggtgatccagaacggtaccacgaagctcgtgaacatcaagaaccaggacggcgtcacaaagattctggatatggtgccggattttgtgaacaaatttacctccaggaatcaggtcgcatccgatacagcgtccgctacagacgaggatgagacgaaggcgagagaagcggctggcaaagagatggaggacatcttaaaggattccgtgaacaaagaagaaaactaaaaaacagtagagaaacttccggcagatgcatatgatgaagagacagattgtttgggggatcttatgaagcggatgatgggatttgcactgttttgcttttccatggggatgctggtgatgcttgtgctccacagccgtttctttgggttccttcttctggtattatgcatgatcgccggttactatctgttctgctgtgatgactgagagcacacggcagaggagagggaagacggaaaaaatatttatgcaaactttatattcgttggagaaaaatgtgagcatttcttccagctgaatgtttgcatcgaattctgtgtctcttccacgtttagacactcacggagtgtgtccgacaagccgcagacaatgagcggactttctggtgtccctaatggcacctcttcatagacaatataaaaccgtgcgaaccgaaactcgccggcatctgctattgaaaatatggcagatgccggcgagtttcggttcgcgcggttatgttttattcgacaacagatggcatttatgccatctgttgtctggtgccgcaagggacacacacaaaagtcctaaaattgtctgctggcttgcggacacagtccgtggagtgctccaaacttggaaagacacggatcatcgaagatgcaaacattcggttggttagaaattccacattttttgaaccgaatttccatctccatttccacatgaaatctccaagtgtgtttcatataatattacttatcactccaaagagatccatgcttattgcggcaattacttagttggaacggcttatgcgagcaattcctttacgcatgcagcaatggcgtcgtccttgcagttggcatagaaatattcggcaaaatgttcgccgctcaatgcaccgacgacgagatcacggtcaagctcttttaagatggagacgagatcgcggtgtgtgactttttttacctcatcgaggattttcttgttgcgctgctccggtatgacacgctccttcggataaccgccaccgcccggtgcacagaataatttctcgaagatgtatgtgaggtttagctcgccaccccagccgaagttctcagcgaacgggagagcaatacagttgccgtcattgacctgtgagaagagataagcatccagaggagactctacatgtccgcagagtacctgcgggaaggaattgcaggcaagcatagcaccctcgccggtaccgcatcctgtgataacgaaatcggctgcaccggaattcaataatactgcggcaagaataccgttctggacataggtgagctgatgctcatcctcggcagagtacataccgtaattgaatacggtgtgacccatcggctctacaacggactttaatgtgttgcagatcatttcattcttgactgcctggctgttttcgttgattaaagcgattttcataatggtttagacctccgttttataacaaatctgtcatggctacatcgtccatgtcgtcaaaatcctgattctcaccgaccatgccccagataaaagtgtaagcctgggtgccgcatccggagtggatcgaccagctcggggagatgacggcctgctcgttgcgcattacaatgtggcgtgtccctgtcggttcacccatatagtgcatgacaagggcatcttctggcatatcgaaatacagatagacctccatgcgtctgtcgtgtgtatggcaaggcatcgtgttccatacgcttcctggctcaagcttcgtcatgcccatctccagctgacagctctctacctgacccggaaggatatatttgcagattgttctgtggtttgccgtctccagagaaccgagttctaccttgttgcaatccttcacaatgacaacgccgtcttccggtgtgccttccggcttgatgagaacggtcggacatgtgcggtgtgcaggagcactgtttaaatagaattttgccggtgcagcggcgtcatcgcttgcaaaagtaatgtcgcgggagcccatgccgatgtacatgccttccttgtgtgcaacgtggtatgcttttccgtcgatggtgatggtgcctgcgccgccgatattgatgacgccaagctcacggcgctcacagaaatactgtgcgcggagttcgtcgccggcggtcagctttaaggtctcttttaccggaacggcagaacctgtgatgatacggtcaatatggctgtatacaagcttgatgacatccggcaaaaacaggtcgtcaatcagaaattcctctcttaaacgttcggtggtgtagtgtttgacatctcttggagatgcagctgttctaagttccatgataaaatatcctttctatgtattgttgcatgaaatgcccggaaaaccgggcatttcaatgggaaaccaattagcaggtctttaagtcaaatccgaagtagttgacggcattgttgtagcagattcccttcacgatctcctcaagtgtctcgtagtctgccgggaactcgccgttctctacccagttgccgatcagattgcagagaattctgcggaagtaatcgtgacgggtataggataagaagcttctggagtctgtcagcattcccacgaatccggaaaggtttccaaggttggcgagagagatcatctgatcctgcatgcctgtcttgtgatcgttgaaccaccatgcggaaccctgctgaatctttgcaactgcggtggaatcctggaagcagccgaggatcgtgccgatggcctggttgtcgttcgggttcaagctgtagatgatcgtcttcggaagctcgtcgctctgatttaaggcatttaagaaatctgccatctcagaagaaggagcgtagttgttgatgcagtcatatccggtatccggtccgagcttgttgaacatcggtgtgttgttgtcgcgcttgcagccgtagtgcagctgcattacccagttgcgctttgcatattctttgccgacattgaccatgaatgcagtcttgaactttaattcttcctccttggtcacgtcatttcctgcaagacgttttgcgaagatgctctcgatctcttctgcggaagcaggagcgtacatcacatactctaacgcgtggtcggagacacagcatcccatggaagcgaagaaatccatgcggttggaaagtgccttgcacagatccgcgaaggtggcaaccttgatgccggatactgcggataactgatccaggtactccagataggtcggtttttcaatgttcattgccttgtctgggcgccatgcaggaagaacctttacgtcgaaagaagcatcctcggcgatcttcttgtgccactccagagaatcaaccggatcatcggtggtgcagatcagtgtgacgttggactgcttgatgatattgcggacagtcatatccggctcagcaagacgcttgttgcagagctcccatacttcctcagcggtgtttttgttgagcacgccgtgataaccgaaatatttctgcagctccagatggctccagtggaagagcggattgccgatagctttgccgagtacctcggcccactttaagaatttctccttgtcggaagcgtcgcctgtaatgaagcgctcgtccacgccgcaggaacgcatgaagcgccatttataatggtcgccgccgagccatacctgtgtgatattctcgaactgacggtcctcgtaaatctcctgcgggttgatgtggcagtggtaatccagaatcggtgtggctgctgcataatcgttgtacagctttttggctgtctctgtctgcagtaaaaagtctttgtccataaatgttttcatctttttttcctccatagttgttcttggtatatttgaaaaccttaaaataatgtagtgcctcgtttgataagtttgccggaaaaaatggatttcttcggcatttcctcgccctggagaactccgagcagagtctgcaccagctgatgcgtctgcgtctcaagacggttgtcaacggaggtaagctccggtgtacagcaggtggtgagcatggaattattatatccaattaccgacaaatcttccggaacgcggagcccctggcgtctggcgtatttcatggcgccgatggcaagcggatcttccgatgcgatcacgccgtgaaagctaagcttctttttggaaagacgctccagataattggcaacgtcgtccatctgctgcgggtctccatcgtagaagagaatccgtttctcataatccggaacggagtgtgcctccatggctgcacgaaaaccgcccagttttttggcaccgctgtaggaattggaattgtacagatagagaatgtcctcaatccctgcgtcaagcatggaaccggctgcctcaaacatggatgtgtaatcgtcgcagagagtgctgtacacattcggatagtcaaaggaagcgttgagcagcataatgggaacctgtgcggaaacgtccttgatgtactggttctcctcctcattggtaccgatgaagttggaaccaacgagaataatgccgtccaccttcttggaaagaatgaggtttaagtaattcttcttgatgtccagattgtaaccggtacagcataaaagggattcgtagccgttggactgaagctcctgttcgagataatacactgccttggcgaggaaaagatccgaggaatcggcacagagaataccgatcgtctgtacggaatgaagccccatgccgcgcgcaaatgcattcggagtatagtcgtatttttctataatatccattaccttttttcgggtagctggccggactttatcgcttccgtttagaacacgggagacggtggcaatggaaacaccggctttcttcgaaatgtcgtaaattgtcatggtgtgattccttttgaaactccttaatatggaagaaatgagtccgcttccccgggcattacatgtaaagttacatagtataaggcacaaaacaagtatagctgtgaaagcagtttcattgcaaccgcatttattatacaatattaaaattgagaaagcaacaacagaaagaggaaaaataacaaaaatgccaaaagaacggagaaaaaggaacagaatatagataacatcactaaattgtgcaaaattacatattgactaatcctataaaaggtgtaagaatacatggtgtaaacgcttacaaagcaacaaaatgcagtatatatcagaataccaggaggatatcatggacttattaagcagagaaaaaacaggaaaggttgaaagacctgtcagagtattacagtttggagagggaaatttccttcgtgctttcgtggactatatgattgatatagcgaacgagcagggcagattcaatggcgatatcgtgttggtaaagccgatcgagttcggaagcctggatcgtttccacgagcaggaatgtcagtacaccgtacagctgcgcggaattgtagacggagaaccgaagcgcattaaccgtattgtaaccagtgtggcggatgcggtggatgcatatggcgagtatgagaagtatgcggcatttgcgaaactggatacactccgttacatcgtatccaatacaacagaggcaggaatcgtgtatgacgataccgatcgtctggagatgaacccgccgaagagctatcctggaaaattaaccaagttcttatacgagagatacaaacactttaacggtgcggctgacaagggtcttgtgatgctgccggtagagcttattgatgacaatggtattcatttaaaagagtgtgtattaaagcttgcaaaactctggaacctggaagagggatttaccgcatggctgaatgatgcctgtgtatttacctccacactggttgaccgtatcgttaccggatatccgagagacgaggcagaggaactgtgcaaggagttcggttatcaggataacctgattgtaacaggcgagccgttcgcactctgggtaatcgagagcgcaaaggacatcagcaaagagttcccgcttccggacgcaggacttccggtgatctttacagataaccagaagccgtataagcagagaaaggtcagaatcttaaacggagcgcacacatccttcgtgcttgcctcctatctgtgcggcaacgacatcgtgttagagtccatgcaggatgaactgatcttcaacttcatgaaggcgaccattttcgatgaggtgattccgacactgacacttccgaagcaggatctgatcgatttcgcagaggcggtaatcacaagattcaacaatccgtatgtaaagcatgcgttgttatccatctccttgaactctgtatccaagtggagagcaagatgcatgccgagcttcttgggctacatcgagaaggaaggaaagcttccggtacacctgacattctcactggcagccctgatggcattctacacaggaacagagatccgcgacaaggcactgatcggacaccgcgacggacaggagtacaatatcttggatgacgctgcagtattggagttcttcgcagccaacagctctaaggatgcaagagagtatgcacacgcagttctctccaacgaggcattctggggacaggatctgagcgctcttgcaggagtggaggatgcagttacttcctatacagaagagatccgtacacttggaatgcgtaaggcgatggagaagatttttgcataatacactgtgaaaaacaggcaggagacgattcatgaaggattttatcaagatcaatgaaaatgataatgttatcgtggcattgaaggaactggcagccggggagaccattctggcgggaacggaagagattaccgctaaggaaacgatcccggcgggacacaagatggcaattcgcgacattgcggccggatccgaggtaattaaatacggcttccggatcggcaatgcgaaggaagacattgcggccggacagtgggtgcatgtacataatttaaagacggcactcggcgatctgctggaatacacttatgagccggtggagacgaacgtgaaaaagacggaggatgtcaagttcatgggctttacccgcgccaacggaaaagtgggtgtccgcaacgaagtctggatcatcccgaccgtcggctgtgtcaacaatattgcaaccgcaatggcgaaggcagccaacgccagagtgaagggaagcgttgaggaagtcatcgcattcccgcatccgtatggatgttcccagatgggagacgaccaggagcacaccagaacgattctggcggatctggtaaatcatccgaatgcgggcggcgttctcgtgctcggactgggatgtgagaacagcaatatcggcgaactgaaaaaatacatcggcgattacgatgaaaaccgcgtaaagttcctggtttgtcaggaatgtgaggatgagatggaagagggagcaaagctcctggatgagctcatcaattatgcgtccgtgtttgaacgtgagccgatcagtgcctcaaagctgattatcggaatgaagtgcggaggcagcgacggattctccggaattacggcgaacccgctggttggcagattttccgatctcctcatcggaaagggcggcaccacgatccttactgaagtgccggaaatgttcggtgcggagacgcttctgatgaaccgctgcgccaacagggaactgtttgatgagacagtctcactgattaacgatttcaagcagtatttcaaggacaatcatcagacgatttacgagaatccgtctcctggaaataagaagggcggtatctcgacactggaagataaatctctgggctgtacacagaagtccggaagcgcaccggtgcgcggcgtgctttcctacggagagtgtgtaaagactccgggattaaaccttttgtctgcgccgggcaacgatctggtggcggcgacggcacttgcagcgagcggcgcacatatcgtactgtttacaacaggtcgcggcacaccgtttgcatcgccggttccgaccgtgaagatctccagcaacagtacgctggccggaaagaagaaaaactggatcgacttcaatgcgggcgtgctggtggaggatgcggagttagacgcagtggggcagcagctgttcaactacgtgatcgacgtggcatccggcagaaaggtctgcagcgaggaagcgggcttccacgatatggcaatcttcaaacagggcgtgacactgtaaccgcagagcgacagttaagaaatcgatgcgactttcggccactgcggctgatgccgcatgaataatagaaaaggagaacataaaaatgggaattttagacaatttttcacttgagggcaaagtagcacttgtaacaggtgcatcctacggaatcggttttgcaatcgcaactgcgttcgcagaggcaggcgcaacaatcgtattcaacgacatcaagcaggaacttgtggacaagggacttgcttcttatgaagagaaaggcatcaaggcacacggctatgtctgcgacgtgacaaacgaggaacaggtggaagccatggtggcacagatcgagaaggaagtcggaacgatcgatattcttgtcaacaatgcaggaatcatcaaacgtatcccgatgcttgagatgaaggcttccgagttcagacaggtcatcgacgtcgacctgaacgcgccgtttatcgtatccaaggcagtcattcctggaatgatcaagaagggtcacggaaagatcatcaacatctgctctatgatgagtgagctcggacgtgagactgtatctgcatacgcagctgcaaagggcggattgaaaatgcttacaagaaatattgcgtctgagtacggtgagcacaacattcagtgcaacggtatcggaccggggtatatcgcaacaccgcagactgctccgctccgtgagatccagccggacggctccagacatccgtttgaccagttcatcattgcaaagactccggcagcaagatggggtactgccgaggatctgcagggaaccgctgtattcctggcttccgatgcatccaacttcgtcaacggacacgttgtatatgtagacggcggtattctggcatacattggaaaacagccacaatagactactttttgctcatttttgcccatggaaacaattccaacaaaaaaatgctaaaatatgaaaaaaagtagtgcatttttatgagggctgtgctataatacaacatgtaagcacttacattattgcaatgtgactaaaacctttcggagtgcaaaacgatgaaagggcacattgccaagtaataaagaaaaaggagaagaaaactatgaaaaaggatttcttgaaacgcacaatggctaccggtttagtagcagccatggcactttctaccgcagcctgtggaagttccgcatctgaggagacaaacacagacgcagcagccacaacaccggagactccggcgacagaagcagcagcagctacagaggcagcagctaccgatgatggttcttatgagaattgtacattaacaatgtcatggtggggtggtgacaccagacacgaggcaacattaaaggcaatcgaggcatttgaggcagcttacccgggaattaccgtagagcctacatacgctgcatgggatggatgggaagctaagatggctaccgcattcgcagcaggaaccgcacaggatgtaaaccagatcaactggaactggattacacagtatgacaatgatggaaccgctttccttaacctgaatgattactcaaacgtaattgatttcagccagatcgattcctcatatcttgatatgtgtacagcatctgacggatcccaggcaggtatcccgatttccatgacaggtagaattttctactgggacaagacaacatttgatgagatcggatgcgagctcccgaccacattagaggagttaaaggcttgcggtgagaagttcgcagcatacggagatgattactatccgttagctttaggtgagtacgacagaatgatcctcatggtatactatcttgagtctgtatacggaaccgactgggtaacagacggacagatcaactacacaacagaccagatcgcagagggacttcagttcatccaggatcttgaggacgctcatgtaattccttctgtagcaacaatcgctggtgacggtgctgcatctctggatcagaaccagaactggatcgacggacactatgcaggtatctttgagtgggattcttctgcaagcaaattcgcaagcgcagctgagggacgtgagatcgttgttggtgactacttaacagatcttggcgagtatcagggtggatacgcaaaggtttccatgtgctgggcaatcagcgcaacatgcgagcatccgaaggaggctgcattacttgttaacttcttgatgaacaacgaagaagcagcaaagatccttggctctgagaggggtgttccggtatctcagatcgcattaaagacagctaacgatgcaggcttattaaacggccaggtagtagaggctaacggtaaggttcttgcatgggtatccaacagccttgatccgaagttcgaggattctcagttaaagagcagcgatggtgtatactacgatgtaatggctggtttaagctatggcgattacacagtagaggacgcagcacagacattatatgatggtgtaacagccgttatttcccagtaatctgactgcatgaattcggagctgctgttcttatgacagcagctccatttttaaaaaaggtgtatgatgaattttgatcagtttgtatcagaatatatagcagaggatcatgatattgagcagctttcggtcatggttctggagggatgcagagcatggtatcccctggccgcggaagcggaaaagcaaaagctgcaagaggtgatggagaaagcggcccgtgcggcggcagatgcccaccggtttggcaggtatggatttttcctgtatgatcagacgggagaagaacagtatcgcacctggatagaaagaaatgcagagtggcttaagaacagtccgcagtccgaaaacggcgtattcggatgcgtggaagattcttcccgaaacatatccggcagtgtgatgtttgcggtgtatccattctatatggaatatgagaccagatatcacaacaaggcggagtatgccaagatcgtcagacagcttctggcactggcaccgtcggagcaggcgtatatggagcagacgggatggtatcttatgacggtgatcgacgtgatagatagcatgagtcgtgagattttcgaacattacaaatctctcgaagagatttttaagaagaccatcagaaatattcttgccgccggctggaataatgatttcagtaaaaaagaaagtgcaatgatgggatattctattgtaaaggcttgcaatctgggcgttttaaatagtgaaaaatatgcagaaattggactttccatgatcgatggtctgataaaagaaccgtttgattcaaaagattccgaacggatgggcatagccatgatggcttatgcgcagagactgattttaagtcgtgagtgaatgaaattttaagataagcaggaggtacaaaaggttggctaagaaaagtaataccgcaaatgttgcagtgccaaagaagaaaaaaacgtttgttgacatttgcaaagaaaatatcggcttcttctttattttgccatggttgtttggtttccttgtattcaaactgtggccgatgggttcctcattattctatagttttacagactacaatctgtttaagggcatgaatgtggtcggaacacttcagaactatgtgaatgtcttcacaaccaagaagattacgacagcgttgacggttacattcaagtatgcatttatcacggttcctttaaaactgatatttgcattgtttatcgcttacatactgaacttcaagatcaagggcgtgaattttttccgtaccgcttactatgtaccttccatcttaggtggatcagttgctattgcggtgctctggaaagccgtgttccgcgatgatggacttttaaacggattcctcggtctttttggtatcgcaggtccgagctggctgtccgatacaaagtattccctgttcgtaatctgtctgcttcgtgtatggcagtttggttctgcaatgatcattttccttgcagcgttaaaaggtgtcccgcaggatctctacgaggcagcttcaatcgatggagcaggcaagtggcgtcagttcttctctgtgacagtgccgatcattacaccggttattttctacaacctggtaacacagctctgtcaggcgttccaggagttcaacggaccgtacatcatcacacagggtggaccgagaaactctacaacactgatttcacttttgatttacaacagtgcgttcaaacagtatgacatgggtatggcaagtgcgatggcatgggtaatgttcgtcatcctgatgatctttaccacgattgcattcctgagccagaaatactgggtattctattctgatgaggagggctaagaagaatggcagcagaaagtaaaacaaaacattatgtcaatgtattcttaagatattttgtcctgatccttgtcggattgattatgatctatccgctggtctggatggttggtgcaacttttaaatccaatgcggagattttctctagcatcggtttcatcccgaagaacccgacacttgagggttacaaaaaggcaatggagagctacggcggagcaatcaacgtatggaaggcaatgttaaacaccttctcctacgtaattccgaaggtagtatttacgatgatctctgcgacggttaccgcttatggattcggccgttttgagttcaagggcagaggaattctcttctctgtattgatggcgacattattcctgccgcaggtagtattgaacgtaccgcagttcatcatgttttccaagatgggctgggtagattccaagttatatctcccgatcattgtgccgaccctgttcgcgacggatacgctgttcgtattccagctgattcagttcctgcgcaacgtgccgaaggaattggatgaggcggctaagattgacggatgtaacgcagtacagactctggtgaaggttatcgttccgatgctttccccggcgatcacatccatcgcactgttccagttcatgtggtcatccaatgacttcatgggaccgttgctttacgtgaatactccggcaaaatatccgctggctattttcgtaaaaatgtccatggatgcagattccggattccagtggaacagaattctggcactgtccctgatctccatcattccttctcttgtggtattctttatggcacaggataagttcgtagatggtatttcagccggtggtgtaaaaggctaaaatcaaaaacaaagcttagaaaaagggtggcaggcttgtcacccttttgttgcactgtaagaagtaacgaatgaccgtaaggtataaatggaggatgagacaatggaaattcgtcttgtgatgaaaacggcgagaagcgtctcgctggaactggatgacggcggcatctataagacaaaagaagtgtaccggattcttgtaaacggagatgaggtaaagacaaccgataccgtaatcacgtcgctgtatggcttgaagccggataccgactatgagattggcgtggaggatgcccatggaaccagacagggagagattgcattccgcacggattacgagttcgtcacactcaatgtgcgcaagttcggtgcaaagggagacggtgtgtcggatgacaccacgtttatccaggcagcgatcatggcatgcccgcctgagagccgtgtgctgatcccggcaggaacctataagattaccagtctgttcttaaagagtgggatcagcgttgaactggcgaaaggcgcggaacttttggcggacaccgaccggtcgcactatgcaattctgccgggactcatcgagagctatgatgagacgggagactataatctcggaacctgggagggaaatccgctgccgatgtttgcgggaattatctccggaattgacgtttcggacgtgaatctctacggggagggcagcatcaacggagctgccagccacgaaaactggtggaaaaatgagaaggtgatggtgggggcgttccgcccgagaatgctttccttaaaccgctgcagaaacatccgcgtgcagggactttatttccatgacagtccggcatgggtgattcatccgtatttcagcgacgagctgctgttctgcaacctgatcgtggagaatccggcaaagtcaccgaatacggacggtcttgatccggaatcctgccgcgatgtgacgatctgcggtgtgcgcttctccctcggggatgactgtatcgcagtgaaatccggaaagatctacatgggaagaagatacaagacgccatcctccaatattcacgtctatcagtgcctgatggagcatggacacggcgcggtcaccgtcggcagtgagatggcgggcggcgtcaataacctgatcgtggagaaatgccggttttaccataccgaccgcggtctgcgtatcaagacgcgcaggggacgcggcaaggatgcgattctggacaatattatcttccgggatcttatgatggagcaggtcatgacgccgtttactgcgaatgccttctatttctgcgacccggacggaagaaccgagtttgtgcagtcgagagaaccgtatccggtggatgacggcacaccgtccatgaagcgcttctgctttgaaaatatcacggcgaaagactgccatgtggcagcatcctactttgacggtctgccggagcagaagatcgaacagattaccatgcgcaacgtatccgtttctttcgccgggcaggcaaaatgcgacgtgccgatcatgtcaaacggtgtggaagcatgctgcaaaaagggattgtatgcgcggaacgtgaagaagcttgtgctggacaacgtctccattgagggatgcgagggagaggagatcgaacttcacaacgtggatgaggttgagcggtagaagacggccggaacattgggcgggcaggaggaagaaagcccggaaaggatagaaaaatgcagcttggaatacgtttacatgatatcaaaaaggcgccgcttgaggagcggcttgccattgcacatgagcagggatttgcctgcggacatctggcgctggcaaaggtgatttcggagtatccggtggatgacggtgccctgacgccgggttacgccatgtatttaaagaagatttttgcagagaatcagctggatgtggcagtgcttggatgctacttgaatctcgccaatccgaatccggcaagccttgcaaagaatacgcaccgctatctggcgcatatccggtttgcatcgctgctcggtgcgggtgtggtcggcacggaaaccggagcagtgaatgaggaataccgttttgaggagcgcaatcattccgaggaggcgctaaagatctttatcaacaacctgtgtccggtggtttcctatgcggaaaaaatgggtgtgatcgttgcgatcgagccggtgtacaagcatattgtctgcaatccgaagcgggcgagaaaggtgcttgacgcgatcggttcaccgaaccttcagatcattttcgatccggtcaatctgcttgatatttgcaattacaaggacagggatgctataatagcagaagcgatcgatgtgcttggcgaggatattgcgatggtacatatcaaggattttaaggtggagaataacagcctggtatcggtggcagccggaaccggcgagatgaactacgacaggatcatccgctttatgaaagagcgcaagccgtatatccatgcaaccttagagaacactgtgccggaaaatgccgtggcatcgcgcaaatacattcagagattgtgggaggagtgccatgtgggatagattttttgatctcgacaacgtggtttggcgtaccattgataaaatcggaaagatatttttattgaatctgctctggctgatctgttccctgccggtgtttacgatcggggcatcgacgaccgctctgatttacaccagcatgaagctttcggacaatgaagggtactggcatcagaattttttctcgtcgtttaaggagaactttaaacaggcgacggcgctgttttttatttatctggcagcgggtgcattcctggcgggcgacttcctgttgggcggtcgtgccggcaattccttcgggcagctgatgcagggagtggcggcaattctgtttgtaccgtattttctgtcgctcctctatgtgttcggcgtgcaggcaaagtttgtgaatccggtcaaggcgacgatccggtattccttttttgtcgcaatgcgcaacatgaagacgacaatccagcttgcaatcttgatgattctgtttgtctgggtgaacacaaccacgctgcttgccaatttcctgacgctgatctatggaatcggtctgatggggtatttctatggaatgtactataagcatacgttcgccaagtatatcgaggcggtggaagaaggctccgcagacgaagagcaggagcgttagcggacggacacgaagctgttccgacgaaaacgagcataatgaaaaggaattgtcgcaataagcatattgtgctttgttttgataagtaatattacaagaaatagatacttaaaagttccagataaacatgcggcgacaaattctgaccgcaaaatccggtatttctaaccatgccgcagctgacatccgtgatgatccgtgtctttccaagtttggagcactccacggactgtgtccgcaagccagcagacaattttaggacttttgtgtgtgtcccttatggcacctctgagcaaaacataaccgcgcgaagccgctgtctgagtcggcatctgccctattttcaatagcagatgtcggcgagttcggttcgcgcggttttatattgtctgtgaagaggtgccattaggaacaccagaaagtccgctcattgtctgcgacttgtcggacacaatccgtgagtgtccaaacgtggccaagacacggaatgggatgccagccgcggcatggaagaaatactcgaattttgcttcaaagaatttgccgccgtctgtttattctggaacttttttggtctctggtattcctgtaatattacttatcgctcgaaagaggtctatgcttattgcggcaattctatgctgcatcagtcttcgacgacgcccggctcaaaggcgaccggggcggcggaggagccgagcggaacgcagtagctctgatctgtggaaaaatcacggaagtatacatattcggaagtgattgtaatatccttgaagtttccctcaaacagtgtggtgtagccgctgccgtccgtgcgcatgaatccgagacacggatgctcggattcatttttctggaagtagatgtaatctccgtagaggttgtaccagtccacgcggtcctcggacagaagcgtcttctcgccggtgctaagatctgtgcgggcgatcgcgtagttgttgtcgcagtccatgaaataggcggtggtatcgtctatgacagtcggcatatagcagttcccgccgtagagcatgccctttgagtcgtccgtggtattgagccgccagatatagtgatcgctgtcggttccgttgtaatacatatattcgccgttggccgagcaggtaaagtcgggagcggtgtcgacctgcttgcagtcggaaccgtcgatttttaccttataaagcgtggaaccctcggattcatcgtagcggatatagtaaatataattcccgtagagggaagcgtaaaggcacggcgccgaatccagaatcagaacggagtcatcgccgccttccctgtcaatgcggcagagactgtcggtgttgaccgagagaaaggagagagcggcgcccgttgctcccggattgttgcgcacatagtagagataatgttcgtccgcattgatgtaggataccgtgtcatcacagagctttgccagattgcttccgtccggagacatcgaatacagcttcccgccgtcggacgggttggaaaaatataccgtgccgtcgtattcgcagaagagaccgccgttgtagaggttgccagcggtgttgccattcacgtaaccctcattaaaatgagtccggttggagagatagtggaaaatgacagccgctgcgataagtgcgataacgacgatgacagcaatgataatggaaatcttttttttcatggaatgattccttctttcgtctgaaatgccgataaaatataatcatagaaattataacattttcgtctaataacttgcaagggctctcttgtcatcagcacgttaatgtactatattataaactaaggcgaagtcccgcaaagagcggatctgcctgatatgaataaggaaatcagacggtgaggagcactatgaagaatctattagagttgagagatgagattgatgtcattgacaagcagattgttgcgctgtatcagcagcggatgcagattgcgggcgaggtggcggaatataagatagagacgggcaaaaaagtttttgacaaagaccgtgaaatggaaaagcttgcaacgctttcggcgctcggcgacagcgcgttcaaccggcacggaatccgggagctgtttgagcagatcatgtcgatcagcagaaagcgccagtatcagctgatgacggagcacggcatatatgaaaagccggattttgaagagctggatgcgctggattataaaaatgcgcgtattgtctttcaggggacggagggcgcctacacgcagctcgcgttaaagcagtatttcggtgaggatgcggggaacagctatcatgtggagacctggagggacgccatggaggcgatcgccagcggggacgcggattatgcggtgctgccgattgagaattcatctgcagggattgtctccgagaattatgatctcatggtggagtatggacactgcatcgtgggcgagcagattatcaagatcgaacatgccttgcttggcgtgccgggagcgaagctttccgatatcacggatgtatactcgcatccgcaggcactgatgcagtgtgcgagatacttagaagggcatcgggagtgggagaagcacagcttaaaaaataccgcgatggcggcacagaaagtcagggaggacggtatgcggcacaaagctgccattgcaagccgtcttacggcggagatctacggtcttgatgtactggaggaaggcattcaggacaacaagcagaatgcaaccagattcatcatcgtgacgggaaaacatgtgtttaccagaaaggcgaataagatcagtatctgctttgagggagcgcatgagaccggttctctctaccacatgctgtcccatctgatctacaacgggatcaacatggatcacatcgagtccagaccgctgccggagcgcaactgggaataccggttctttgtagattttgaggggaatctgaacgatccggcggtgcagaatgcactgcggggattgtcggaagagacgaccagactgcagattctggggaattacgaagcgtaaagtgaggaatgtgggaagatgaagataacgaagaatctgatcctctacagggattttgaaaacgagcagttattctatgactttacctgggtcatggagaactatcagaatgaatactataataaagaagatgttgagggattattctatgaatgcctcaaaaaactgatggagcttgcggtcagccatggattttccggcaatctctggcacaatttcctggcttttttgcttgtgaataacgagaatgcatacagcagggcgtgcgagatccgcggggaggtaaaaggctccatcaacgaggtggcgcggcacgattttgccatcatgaaagagttgtttgactttgacctttcggtgctcggcaactatttttccgtggactgcatggacgcattgctgcactatgaggagaccgcggacgcgggaaaattgttcaacaagcggatcagagaccggatcgcagagctctgccgtcatctggaggcagcggcggatgcagaagaatttaaacaggcggtcacggcattttacggggaattcggagtcggaaaactgggtctgcacaaggcattccgcgtcagacacacagatgacggggcacagattattccgatcaccaatatcgcgcatgtaaagctggatgatctggtcggctacgagcttgcaaagcagaagctggtcgacaatacggaggcgtttgtgagcgggaaggaagccaacaactgtctgctgtacggtgatgcgggaaccggaaagtccacaagcatcaaggcgatcgccaaccagtattacgacagaggcctccgcctgattgaggtttacaagcatcagttctgtgacctgaatgatgtgattgaacagatcaagaaccgcaactacaagtttatcatctatatggacgatctttcgttcgaggaatttgagattgaatataagtatctgaaggcggtcattgagggcggtctggagaaaaagccggacaatgtgttaatttatgcgacctctaaccgcagacatctgatccgtgagaagttctcggacaaggaagaggtgcgggaggatatgcacacttccgacacggtgcaggaaaagctttcactttatgcgcggttcggcgtgacgatctattacggcgcgccggataagaaggagttccagaagattgtcacgacgctcgcggagaaatatggcgtgcggatggagcaggaggcgctgcttcttgaggcaaacaagtgggagcttgcccacggaggactttcgggaagaacggcacagcagtttatcaattatctgcttggaaaacaataaagaggagggcggatttatggcaatccatacgtttgcggcaatttatatcggttcgtatgaagtgagcctcaagatatttgaattgtctgccaagaaaaaaatacgcgatatcgactatgtgcgcagcagaatcgagctgggggcggatgcgtactccaagggcagcatcggatacgagctggtggaggcactctgtgataccctgcgggaatttgcgcagatcatgaaagagtaccgggtggatgcgtacgaggcgtatgcgtcggcggtgctccgcgacgtggacaatgaactttttatcctggatcagatcaggctgcgcaccggtctgaccgtacgtgtgttgagtaactcggagcaccgttttatcagctacaagtcggtggcgatgcgtgaggagtttgagcatttcatcggcagaagcgcagcggtggtggacgtcagtggatcgggacttcagattaccgtgttctcaaagggaaaggtgctgaccacccagcatctgggactcggcaccatgcgcatgcgggaacagcttgccaaaaagagccggaacctggcgcagtatgaactgcagatcgaggagatggtggtaaaggagatggaagtcttcaaggcaatgtatctggaaaatcaggagattgaatacctgattgtgatcggcgattatatcgcggaactggtatgccgcctcgagaagaaccgcgacaagaataccgtgtcgattgagaagttcgtccagtacatggagcagctcggcaggaagagcctggaggagatcgcggaggaactgggactctccaacgagaacgacccgctgatcgtgccctatatcatcatctgcaagtgcatggcgagggggctgggcgcaaaggaactgtgggcgccgggcgtgattgtcagcgacggaatcgcctgcgactacgcgcagaaaaaccgtatctataagcctacgcatgattttgatgaggatattatctcggccgcggaaagtctctcgagacgttacatgagctattcaccgcacattgaagcgctgacccagatggcgatgcttctgtttgacacgatgaaaaaacagcacggtctcggaaagagagagcggctgttgttgcaggtcgcggcgattttgcatgactgcggaaaatatatcagctttgccaatgccccgcagtgcgcatacgacatcatcatgtcctcggaaattatgggactgtcgcatctggagcgtgagatcgttgcggggacagtgctctacaacagctatccgcttgccgattatgaggatgtagcggaccggctcgaccagcagagttttcttacggtggcaaagttatccgccattctgcgcgtttccaatgcgatggatcgcagccacaaacagaagtttaaaaacgtaaaagcacagcttcgtgacaaagaactgatcattacgatcgagacggatgaggacattgcgctggagaaggcgctgttcgcttccaagacggcttattttgagcgcattttcagcatcaagccggtcgtgaaggaaaaacgtgtctattcgtaaggacgtggagggatgatacatggaaaaagaaaagaaaaacgaattccatttgccggaatattacgagaacagagagctaagctggctgaagtttgacgcccgcgtgctcaacgaggcaaaggataagagtattccgctgttagagcggctcaaattcgtgagcatcacgtcgtcgaacctggacgaattctttatggtccgggtcgcgtcgttaaaggatatggtacatgcggactaccgcaagcgggatattgcgggcatgacggcatcggagcagctcgaccggatcaacacggcgaccagaaaactcgtcgagagccagtacaacacgtataaccgctccctcgttccgctgatggcagccaacggaatacacattattgaaaaatacgaggaactgacggctgagcaggcggcgtatgtggaccgctactttgaggaggacgtctatccggtattgacgccgatggcggtggacgcatcgcgcccgtttccgctgatccgcaataagacgctcaatatcgcggcgctgctttccagcaagaaggatgaaaagcataaggacgcggtggaatttgcaacggtgcaggtgcctggggtgctgcctcgcctggtgccgatcccggcagatacgtcggagaattccggggaggtggagggacgcacctttattctcctggagcagattatcgagaaaaatattgataagctgtttttaaactaccatgtgctctgcgcacatccgtaccgcgtcatgcgtaacgcggatctgccgatcgatgaggacgaggcggcagaccttttaaaagagatccagaaacagttaaaaaagagacagtggggagaagtcatccgtctggaagtggaagcttccgtggacaagaagttgctgcgctttttaaaggatgaactgaaagtggcggaggaggatatttttcagatatccggaccgattgacctgacatttctgatgaagatgtacgggctctccgggtgcgattccctgcgctacgaaccgtataagccgcagcgtgtgccggagattgaaccgggggaggatatctttgaggcaatccggggcggcgacattctgctgcatcatccgtatgagacgtttgatcctgtggtcgattttatccggcaggcggcgtcggatccggacgttcttgccatcaagcagacgctctaccgtgtcagcggcaattcaccgattatcgcatctctcgcgcaggcggcggagaacggaaaacaggtgtcggtgctcgtggagctgaaagcacggtttgacgaggaaaataacattgtgtgggcgaagaagttagagcaggcgggctgccatgtcatctacggtctggtcggccttaagacgcacagcaagattgcgcttgtcgtgcgccgtgaggaagatggcatcaggcgctatgtgcatcttggaaccggcaattacaatgattccacggcaaagctctacacggactgcggaatctttacctgcaatgaggcgatcggggaggatgcgaccgcggtgtttaatatgctttccggatattccgaaccgctttcctggaacgaactggtgctggcgccgatctggctgcgcacccgttttatgcgcttgattgcacgtgagacaaagcatgcgcgcgagggaaagccggcgagaatcgttgctaagatgaattcactgtgcgacgagggcattattgccgcgctctacgaggcgtcggcggcaggcgtagagatcgaactgatcgtccgcggaatctgctgcttaaaggtcggaatcccgggaatcagcgagaatatccatgtgcgttccattgtcgggaatttcctggagcacagccgtattttcttcttcttaaatgacggggaggaggaactttatatgggaagcgcggactggatgccgcgaaatctggaccgccgtgtggaaattttattcccggtgctggacgatacgctgaaagaaaaagtaaaacacattctggatgtggagcttgcggacaataccaaagcccatgtgctaaagccggacggagaatatgagaagatagacagaagagggaaggtgcttgtcaattcccagaagcaattctgcgaggaggcggttgcggcggtgccaaagacagatcatgtctaccgcgagcgtgtatttgtcccggcagaaccggcagagtaggaatgccgcaggacatatgatgggctaaaagcaggatgggaggaatgagtatgaatcacaagattttgtttgttgatctggatgcgacgctgctctctgacgacaaaacagtatccgaagaaaaccgggccgccatccagaaaatgcttcttgccgggcacgacattgtactctccaccggacgtccggtggagagcggcagggcggttgcaagagaactggaactgacacggccgggctgttatatgatcgcttttaacggggcggtactctacgattgtgccgcggatcgtgtgctgttaaagcgctcgctcccgattgaggtgacgcaggaactttttgagagagcctccaaggcgggaatttatgcgcagacctataataataccgagattattaccacaagacatacggcagagcttgagtattaccggaaaaaaacaggactttcctacaagctttcggcgaatgtgctggatctgctggaggaggagccgcagaaggttctcatgattgatttaaaaaatacggggcgtctcgcgcggttccgcgagaagaatctggaatgggaaaagggaaaatgtaccagctttttctcctgcagagagtatctggaatactgtccgcttgataccagcaagggaaccggtgtgtcctgtcttacgaagatgctgaatcttccgctagactgtacggtagcggtgggagatgaggagaatgatattgcaatgcttaatgcggcgcatatcggggtagcggtaaagaatgccacgccggaggtgaaagccgcagcggattatgtgacggagcacgacaacaatcacaatgcgatcgccgaggtgatcgagcgatttatcctgtaaaaggagggactgctgcatcgggcgggcagctgccttgagtcgataaggaatattataagaagcacaccacgcagatttcagctggaaatgcagatggaacattcgtttgagaaaaatgtgagcatttcttcctgctggatgtttgcatcggattccgtgtctcttccgcgtttggacacttccggagtgtgtccgacaagtcacagacaatgagcggacttcctggtgtccctaatgatgccgcttcacagacaatataaaaccgcgcgaaccgaaactcgttggcatctgctattgaaaatacggcagatgccaattcaaacatcggcttcgcgcggttatgttttgttcagcggcatccataagggacacacacgaaagtcctaaaattgtctgctgacttgcggacacagtccgtagagtgttccaaacttgggaagacacggattatcgcggatgcaagcatccggcgggttagaaatgccactttttttgaacagaatttccatttgcattttcaactgaaatccccaagtgtgcctcttgtaatattccttatcgcttcaaggcaaactggctattcccgatgcgacagtcctttcttctgcctttatgcgcggaggtgttctttgatggtttcaagaatggaatagggaatgtagagatgcccgcgtccggtcccgatctgaattgtgggtttgttggtgccgtggaagtcagagcctccactgatgagaagactgttctcttttgcaagccgcttgacgtactgttcctcgccggtggtgtaggttgagtagatcgcttcgatgccgtcgagatggacttcttttaactcgtcgatcagatgctgcaaggtcgtctggctcatgtggtagagcagcgggtgtgccagaacggcgatgccgcctgcggcgtggatcagttcgactgcctccatcggggagactttaaagcggccgacatagcatttgcagccgtcgccgatatatttttcaaacgcctccgagacgctcctgatctgatggctgtcgtagagaaaacgtgcgatatttgcgcgcgtgatgacactgtcgggattggcagcaaggagtgcttccgtggtaatggaaaagccttcgcgctgcagggcagccactattttttcattgcgcgcatcacggcagcggcggaactcgtttgttttctcgataaggagcgggtgctccggatcaatgtagagaccgacgatatggacttcttttccaccgccggctctggtgggcagctcatattccgtggaaagctcgatgccggggattaattcaataccacaggcggcagcggcgggagcagctttagagacacctgccgcggtgtcgtgatctgtgagcgcaaaggcggacagaccggcagcctttgcggcagatacgatctcggtgggagtaagggtgccgtccgactcggtggagtggacatgaagatctatgatgcggtgttccatggtaaaatcctctcttcagataatctaattcagactaatcatagagaaaaaaatcacatttgtcaaaaaaatatggaaaccagttgaacacgtagtaaaatagaactataatataaaggtactaaaaaatatacacggatgtagagaatacagcacacaggaggagcgaaattgtttgaaaatgtacgaatcaaagagagactgacaaaagcatttgttatggtggcggcaatcactgccataggagcggtagtcgggctggcagcgatgcttgtgatgtcgaaccgttattccagcgcacttgtgaattatggtttttcacagggagatatcggcaaggcgatgatcacatttgccaacacgagatcagcgaccagaggaatcatcggatttgatgagcagggactggtggatgatgccatgacagaacatgacgaacagaaagcaaagttcgagaattacttcgcaaccgttggggatgtagtaacgacgagcgaggaaaaggcactctaccagcagatttcagataaactgcagcaatactgggcagcggaggaaccgatcatcgagcagggtgcaaccaccgatgctacacagtccacagcggcacagcagcagatgaaggaaagtctggatccgatttacgaagatatctatgcagatatgatagaactgatgaatacgaaagtgacggagggagaccgcttgtcctccactctgacggcagtcagcgtgattcttgcgattgtgattgtggcagtgtcagctctggcaatggttatggccaacaagcttggcaatcaggtggcaaagggaatctccggaccgcttgaggcacttggcgagcggtttaaaacgtttgcacagggagatctttctactccgttcccggaggtttccacgcaggatgaggtcgcagacatggcgcgtgaggcggcagacatggcagataagctgaatcttatcatcaatgatgcgggaagaattctcggattgatgtcacagggcaattacgcagtgcagtcggagcacaaggacggttatacgcttgattttgaaaaattgattgtggcgatgcgcgttctgcgcgatcagatgatagagacgctgacatcgatcgaagatgcggcaaaccaggtttctgccggttccggcaaccttgcagaggcatctcagagtctggcggagggcgcaacggatcaggcaggagctgtggaagaactgcaggcgaccatcacaagcattacagagaatatccagaagaccgcggagcaggcagaggaatcttaccagcaggcaaggcagtatgcaggtgaagcggatcagagcaagaatcagatgcagtccatgattgataccatgagccgcatcaacgaatcttccaacaagattggaaacattattacagatatagagaatattgcgtcacagacgaacctgctgtccttaaacgcttccattgaggcggcgcgtgccggcgaggcaggaagaggattcgctgtcgttgcagagcagatcagacaactggcagagcagagtacacagtctgcggtggacaccagagaactgattgaggcttccctcaaagaaattgaagagggcaatcaggcagtagagcgtgtgtccacgtctcttgaagaggtaattgacggaatcaagcagattgcggagacttccaagcgcttgagcgataattccaaggatcaggcagaagccatgaaacaggcggaggagggagtcaaccagatttccgaggttgtacagtccaattctgcaacggcgcaggagtcctcggcaacgagtgaggagttgtctgcgcaggcgattgcactggatgagctgattgggaagtttgtattaaaaaattaaaaattgacagattctgcggttgccgaaccgaaagaaaagggatataatagcaagaagaaaagtttcagaacaggggggaagtcacatgcagctgctgacatttacattaacgggaatggattatggaatatcacttgagaacgtggaatccattgagagtaagatgaatgtcgtggttgtaccgacttctcctgccaatatcagaggcatcatccgccttcacggagagatcctgccggtgttttcccttgcatccagatttggactggggaacattgcggtggacaaccttgtggttgtcaatgtgggcggcatgaagctggcacttgaggtggaaaaggtaaaggaaattgtggacgtggaagattccagagtgcttccgatgccgacactgatgagcggacagcagtgctgttttaatgatgtggcttcctgtcagaaggagctgattgtgatgcttgatgtcaagagtctggtatcacaggaggagcaggcggcgatccgcaagatgatcagcgacaacaccagcgacaaataataaaaaacacttgacacggatacgtgtgtgtgatagatttaaatagttgttagaaaacaaagtagagtatccactctcaccggagcacaaatacgtgactcatggttcatatttcaaagtattgcgaacatatcatgttccgggtttgaatgtttagtggatagtctgcctatccacttttttatttggaggtacgataccattagcgagttaatgattaacgaacagatcagagacaaggagattcgtctgatcggagagaacggagaacagcttggcattatgtcagcacgcgaagcaatgaagctggcggaagaggcagagcttgatctggtgaagatcgctccaaccgcaaagccacctgtatgcaagattatcgactacggaaagtacagatatgaactggcacgcaaggaaaaggaagccagaaagaagcagaaagtggttgagatcaaagagattcgcttgtcgccaaatatcgattcaaacgatttgaacaccaaaatgaacgctgcgaaaaagttccttagcaagggagacaaggtgaagatcacattgcgcttccgcggacgtgagatggctcatatgaatgcgagcaagcacattttggatgattttgccgcaagcctcggcgaaatagcagtagtggaaaaagcaccaaaagttgaaggtagaagcatcagcatggtgttggcagagaaaaaatcataattaaggaggaacatatcatgccaaaaatgaaaaccagcagagcagctgcaaaacgtttcaaagtaacaggaacaggaaagttaaaaagaaataaagcttacaagagacatatcttaaccaagaagacaaccaagaacaagagaaatcttcgtaagccggcaatgaccgatgcaacaaacgttaagaacatgaagaagattttaccatatttataggaataagttaaggaggaatgcaaaatggcaagagtaaaaggcggattaggcgctaagaaaaagcataatagaacattaaaattagcaaagggttacagaggcgcacgttccaagcagtatcgtgtagcaaagcagtctgtcatgagagccttaacaagttcttatgcaggcagaaaagagaagaagagacagttccgtcagttatggatcgcacgtatcaacgcagctgcaagaatgaatggtatttcttacagccagatgatgcacggattaaaggtagctggtgtggacatcaaccgcaagatgttagcagagatggctgtaaacgacgcacagggatttgcagcactggcagagctggctaagagcaaggtagcttaaggaacagcagacagaacctatctcgtatgtgggacaacccatatgagataggtttttttatgtaacaggaaagcaggattttttggtatcggtattatacagcatctgaattttgtatgttccaatttacagcaatatacggtataatattagcgatttttgaacgcaaagggaactacgaaagggaaacgggaatatttatatgaagaatatatggcgtatttttgcaaaagacattaagggactggtgaagaatccattcgcaatgattattgcgctgggactctgtgtcattccatcgctgtatgcatggtttaacatctattcaaactgggatccttatgcgaatacttccaatatcaagattgcggtcgtgtcggaggatgaaggatacaccctttcggatggaacgacagagaacatgggcaatgaagttgtggaggaactgaaggagaataccaagatcggatgggtgttccttgaggattcggatgccgcacttgaaggtgtcaggaacggagattactacgcggctgtcatcatcagcgatagctttacatacagtatgtataatgtgttcaaggagaactttaagaatccgacgatcacatattatgagaatgaaaaacggaatgcggttgcaaccaagattacggataccgctgtatcgacggtaaagcagagcatcaacgagaagtttatcgaggtggttgcaagtaccatttttacacagacgaacgaactgtcctctgagatggagaatcaggatgtgttcagcgaatttgagggcaaactgaccaacctgaacaacaatctgatcggttacagtgatatgattgatgagtttatttcggcgaatgcagtgctggaggcagagatcaaaaccgcagacggagaactgccgaagctcagcagccagattcagaatggcgagaagagtttccagaattcgcagagcaatctgaattccacgaaaacttcactggagaatttcagcagcaatgtgcagacgacactggatggcatcaatcattcgatcaattccatcacaacggatatcaacaacgcgaacctggcgcagaatgcgcagtctacggcagacaatctgaacaagacggcaaccgatacggcggaactgatccgacagttaaaccagttgaagaagagtctggcagatcaggcggcaaattcatcgggaaccacaggctccacggagggcacaggctccacggaaggaacaggctccacggagggtacaggttccacagaaggaacaggctccacagaaggaacaggctccacggaggggagcggttccatagattcgatcgtgtccgatgaggtgaatcagcagattcaggagatcttaaataccttaaacagcatgaacaatggtgctgaggatattcagaatgcattaaatgctttgctccagcagggcggtggtacagacggctccggtcagattgttgcggatatggtgaacagatctgtggcaagcgtgacacaggtgttaaacaactgcagcgagtcgattaccaatctgaagaatatgtataccaacagtcttgttccgcagatggacggagtgttaaacagtgtatcgcagatgctcggcaatgtgacaaagcttctggataacttaaataccgcagtaaatgatatgggcgtggtgtttgacggaattcagacaacggtcagtgacacgacggagagccttgagcagatccagaccgtgattgacaacgtgagcacaaagctgacggaactgatcaaccggttggagagtgcggaagatgatgaaaaagtagatgcactgctgaagtttttgcagggtgatccggaggattacggcgccttctttgcagaaccggtacaggtgacgacacaggagatctacgcgattgcaaattacggatcggcgatgacgccgttctattccgtgcttgccctctgggtaggaggaacgattctggtggcactgatcaaagtgaagccggataccgcagggctttccaacccgaagtcctatcagttgttcttcggaagatatctgctgttctttgtgtgtgggcagatccaggcggcgattattgttctgggagatatttatctgctccactgccagatcctctatccgggcttattctggctgacggcagcactggcaagctttacctttacgctgtttatctatgcgatggcgctggctttcggcgacgtcggcaaggcggcggcggtcgtagtcatggttatccagattgcaggttccggcggaacgtacccgattgagacgcttccggagatttatcagaagatttatatcttcttcccgttcccgtatgccatcaacgcaatgcgtgagacgattggcggtatgtacggaagcgattatatgaagtatctgggagaactgctgctttttgcggtggcggcgcttctgattggtcttgtgatccggcttccgtttgtgaagatcaatcattttgtagaaaagcgtatggaagatacggaaatgatgtaggaaatgggagattttatggaaaagaaagaaaaatacgaacagatgtatgagatgctcgtgacgtatgagcgcaagattcacgagaagaatcaaaagagaatcagtatcggtttaaagtgtattattattattccgttgatcttcctgttccttctgttctggacagagagcaataaggttgtgtttctgattctgtggattgtatcgctgtttttgctggcagcctatctgattctggtggagtatatggactataaccttcaggaaaagttaagcgagatcaacgacgaggggacacgcgtggattccctcatcggactggagattgataatgttccgggaaatctcagaaatgtgattcagaggattgacgacggattaaactcagaggcggagacccggctgattgagactaaggcatccggggaagaaacgcagactgtggaaaaggcacagactgcggaagagacagagaaacaaaaggatgcggatgcacaggctgtagaagatgcagatgcacagaaagatgcggatgcacaggctgtggaagatgcagatgcacaaaaagatgcggacacggaggtgaaggagaatgcgtaatatatttaagatttttttcgccgatgtcaagcgcatcagcaccaacgtggtggctgtcgttgtgatcctgggactctgtattctgccgtctttgtatgcatggtttaatattttgtcaaactgggatccgtacggaccgtccgcaaccagaaatcttaagatcgcggtggcgtcggacgacgagggagtcacaattttagggaacagtgtaaatgtcggaagcagtgtcatctctgcgcttgagtcgaacacgacgatgggctgggtgtttacggatacgaccgatgaggcgatcgacggcgtctatgatggaagttattatgcggcgctcatcatcccggagaattttacggaagatatgatcagtttcctcggcggagaggtggatcatccggatattatctattatgagaatgccaagaagaacgccattgcctccaagatcacacagaaggccaagacggctgtgcaggagcaggtgaacagcacggtggtgagcacgcttgcagagaccacgatgaaggtgacgaacgccctctcggatgtggatgcggaagattccgatccggcggagagtgttctggtaagactcaataatttaagcagcgacctacagagttacatcaatatattgaactcgtttgtcagcattatgaattccgcccagagtattgtggaggcgagtcagaccatgcttccgaatgtgaacaacatggtttccaacggtcaggcatccatcaacagcatggagagtctgctggttgcgggcaacagcacggtgagttcgacggcggatatggtgtcgtacagctttgacatgatgaatgattcgttaaataatgtgtcgtccgtcatcaccaatgcgttaaaccgtctctcggagtattcccagggcacttccgtcacggtacagggcttatcggcgatgatgccatacgtgaggcagctgtttgatacttcggtatccgggtgggaggatacggcgccggaggatatgcaggcgcagattaatgcaatccgcacgcagttggataccatcactgcggacctgacagcgctggagaacaatgccgatacatcgatggagacggtaaggaatctcagtaataaaattgtgacggagattgcaaactgccagaaagcggtcgatggactgcgcaatgattttgcttacaatgtcaagccgaagttagagaacacaatgagctccatgcagcaatccatgattgccgcagcgggtattttagacggcgtagatgccgattttaacggtgtggagaatgcactttccgattatcaaagcacgcttgagcgtggaagcaacagccttggcggatcactgtccatggcgcaggaacttctcgccaagctaaacagcgtcacggcggatctggtaagcttacagcagaatgaccagtatcaggagctgcttgaaatcgtaaagagtaatccggaggagctgggagcctttatttcttccccggtaaatctggagacggtcggtatctatgagattgaaaactacggctcggcgatgtctccgttctacacgatcctcgctctctgggtaggagcgctgattctggttgcgatcattcacgtgaaggtgcatccggttgagggcgtcgaaaatgtgaagccgtaccaggagtatttcggaagatacatgatctttttcctggtggggcagacacagacgcttttaacggttctgggcaacctgttttatattaaaatccagtgtcatcacccggtattattctggctggcaggcgctgtggcgagcctggtatttaccctgtttatttactcactgaccgtggcattcggcaatgtcggtgaggcgctcgcgattgtggtcatggtaatccaggtggccggtgccggcggtacgttcccgattgagacgctgccgaaggtataccagatgctctataagtatctgccgttcccgtacggcatgaatgccatgagggagacgatcggcggtctatataagatggattactggaaggatctcggagcgctcggtatctatgtattgatttcactgtttattggacttgtagtggcaattccgttccgcaagctcaatcatattatcgagaagaacaaagagggatccggagttatgatatagcaacagggagcagattatgatgcgtttgatacaaatggttcttttactcacggggctgctcatggtggcagctcccggggcatgtacaagaaaagatgaccggggtaagccagagaccgagaagcgcacccgcacgattgggggatggctgactgcggcagcggttatctggatgattacggaagtgttgagaagtttttaagttattttgggtattcctaataggtatacccattttttgttcggatattgacaaaaaaaatgtacattgttattatcaatggtaagtgtgatgtgtaatttcagatagtaaggaaggttttcttaaatgagaagacaggtattatcgcttctggtcgagaataatccgggtgtgacgagtcatatttcggggctgttcagccgcagaggctacaacattgacagtttttcctcgggagtgacagcggatccgcgctatacgcggattacgattgtggcgagcggggatgaacagattttagagcagattgaaaagcagcttgccaagcttgaggatgtggttgacattaagaagctggagccgggctcgtctgtgacgcgcgagctgattatggtcaagatacgcgccagagatacggaacgccagccgattttaaatgtgacggagattttccacggcaagattgtcgatgtgacacacgattccatggtgattgagcttaccgggcatcaggataagctggatgcatttctggatctgctgcaggggtatgagatcctggagctggcaagaacgggaattaccggtctgtccagaggaactgccgatgtgaagatgatcgacgaaaacggacatctgcagagtttgtaatacatactaattgtgaacgagcggcagacatcacagatgctgctgctatgtataaaaaatggaggaaaaagatatgtcagcaaaaatattttatcaggaagactgtaacctttcactgttggatggtaagaccattgccatcattggatacggaagccagggacatgcacatgcattgaacttaagagattccggatgcaaggtcattatcggtctctacaagggcagcaagtcctggaagaaggcagaggagcagggatttgaagtatatacagctgcagaggcagcaaagaaagccgatatcatcatgatcctgatcaatgatgagaagcaggcggatctttacaaaaacgacatcgagccgaaccttgaggaaggcaatatgttaatgttcgcacatggattcaacattcattttggatgtatcgtaccgccgaagaatgtcgatgttaccatgatcgctccgaaggctccgggacataccgttcgttccgagtaccaggcaggaaagggtactccgtgcctgatcgctgtagagcaggatgcgaccggcaaggcacaggatctggcgcttgcctatgcacttggcatcggcggagcaagagctggtgtgcttgagacaaccttccgcaccgagaccgagaccgatcttttcggtgagcaggcagttctctgtggcggtgtgtgtgcactcatgcaggcaggctttgagacactctgcgaggcaggatatgatccgagaaatgcatacttcgagtgtatccatgagatgaagctgatcgtagatctgatctaccagtcaggtttcgagggaatgagatattctatctccaacaccgctgagtacggcgattacatcaccggaccgaagatcatcacagaggacaccaagaaggcaatgaagaagatcctctccgacattcaggacggaactttcgcaaaagagttcttactggatatgtctccggcaggaagacaggttcactttaaggcgatgagaaagcttgcttccgagcatccgtcagagcaggtcggcaaggagatccgtaagctttacagctggaacaacgaggctgacaagctgatcaacaactaagagctaagagcggagaatgaatccgcaaaaagaatagagaatctgccgcatggagtgcgaagtgcttccggcggcagattttttatttcataggaaataccgtgatacattcatgtgtgaaagtggaactttcctatgaaataaaaaacgctccgcgcggagaatctcgcaagcgagattcttttttatgtggatgccaaaatccggttgacaaatacatccagtatgttaaaataaatcatgttcatgcataaaatgaatcaaagtatgtgaccgtgagaaggagcattaagaacggaagaatgacagagagccgccggatggtgtgagacggtatttggaagttcccaactcgcctttgagtcctttgccggaagccagtggcagcgccagcggtgtgtaaggcagagcgtgtgattcgcgttaagaatgataagtgcgtacctgcgcatagcgcggtgcgaagcagagtggtaccacggagtagcgttacttcgtctcttacggcagatgccgggagacggagtttttttgttatttcaagcgttaatgaaagatgaggagagagaagatgtcagaactttacaatcacaaagttgtcgagaaaaaatggcagaaagtctgggatgacaataaggcttttgcggcgacagacgattacagcaagccgaaatattatgcactggtggagttcccgtatccgtccggacagggactgcacgtaggacatccgagaccgtacacggcactcgatattgtggcaagaaagcgccgtatgcagggatacaatgtactttatccgatgggatgggatgcatttggtctgccgaccgagaactatgcgatcaagaataagattcatccgaagatcgttaccgagaataacgtgaagcgttttaaggagcagttacattcactcggatattcctttgactgggacagagagatcaatacgacagatccgtcctactacaagtggacacagtggattttcttaaagctgtttaaggcaggcctcgcttacaaaaaagagatgccgatcaactggtgtacttcctgcaaggtcggtcttgcaaacgaggaggttgtcaacggtgtctgcgagcgctgtggagctccggttgtccgcaaggtaaagagcgagtggatgttaaagattaccgattatgccgagaagctgatcgagggactggatcacgtggattacattgagcgcgtcaaggtatcccagaagaactggatcggcaaatcccagggcgccgaggtggatttctccatcaagggcaaggaggataagcttcgtgtatacacgacccgctgcgatacattgtttggtgttacttacatggttgtatccccggagcatccgatcatcgacaaatacaaggatgaactgaaaaactgggatgcgattgcagcataccgcgacgaggcagcgaagaagtctgattttgagcgtgcagagcttgccaaggagaagacaggcgtgcagatcgaaggtctgaccgcgatcaatccggtcaacggcaaggagattccgatctggatttccgattatgttctgatgtcctacggaaccggagcgatcatggcagtgccggcgcacgatgagcgtgactgggaatttgccaagaaattcaacctgccgttaattcaggtcgttgcaaagaacggcgaggaagtagacatcaatgcggctgcatttacagatgtggcaaccggtgttctgatcaattcggatttcttaaatggacttgaggtcaaggacgccaaggcaaagatgatcgcgttcttagaggagaagaagatcggtaccgcgaagaccaactacaagctgagagactgggtattctcccgtcagcgttactggggtgagccgatcccgatcgtacactgtgataagtgcggttacgttccgatcgatgagagcgaacttccgctgatgcttccggaggtggagagttatatgccgaccgacaacggagaatctccgttagctgcaatgacggactgggtgaacaccacctgcccgtgctgcggcggtccggcaaagcgtgagacagataccatgccacagtgggcgggatcttcctggtatttcttaagatataccgatccgcacaacgacgaggcactcgcaagcaaagaggcgttaaaatactggatgccggttgactggtacaacggcggtatggagcacacgacacttcatctgctctactccagattctggcataagttcctctacgatcagggggttgttccgtgtccggagccttatcagaagcgtacttcccacggcatgatcctgggtgagaacggcgagaagatgagtaagtccagaggaaacgtcgtaaacccggacgatatcgtaagagagtacggtgccgatacgttaagaacctatgagatgttcatcggtgcgtttgatttgagcgcttcctggtcggaagatggcgtcaagggatgccgccgcttcctggagcgtatctggaaactgcaggatatcatgaccaacgaggagggatactcttcggatcttgagacaaagatgcatcagacgatcaagaaggtaagcagtgattatgagaatctgaagtacaacacggcgatcgcagcaatgatggcgctgctcaatgattttacaaagaagggctccatcacaaagggcgagtacaagaccctgctcattctcttaaatccggttgcgccgcatatcacagaggaactctggcagatcatcggcggcagcggctatgtatatgagcagacctggccggaatacgaggaagcgaagactgtagaaaatactgttgagattgcagtgcagatcaacggaaagacgaaaggaacgctggcaatcggaagagatgacgcgaaggaggatgtcattgccaaggcaaaggaatccatcgcagataagctcaccggcaacatcgtaaaagaaatctatgttccgggaagaattgtcaacattgtaatgaaataagatatggaaaaaggaacgaagcttttagaaggttccatctggaaaggggttgtagcatttgcaatccctctcttcttgggaaatttatttcagcaattatataataccgtcgattccctgatcgtcggcaatttcctgggcagcgatgcgcttgccgctgtcagttcatccggaagtcttatttttcttctggtaggattttttaacggaattgccgttggcgcaggcgttgtgatctccaaatacttcggggcgagagactatgagaatctgaagaaagcggtgcatacggatgtggcatttggacttgtctcaggacttttacttaccgtgatcggcatgtttttggcaccgcagattctggttctcatgggaacgccggagtcggtactgccgaattcaatcctgtatttccgcacttattttgcgggatcgcttgcatttgtcatgtataacattgtgatgggcattctgcaggcggtgggagacagcagacatccgctgtattatctgattttttcttcaatcgtgaacattgtgctggatctgctgtttgtcggtgtctttagaatgggcgtcggatcggcggcgcttgccacggcaatctcacaggcggcgagtgcgctgctctgttttatccggctggtgcgcacgaacgatatttaccaggtaaaaatacgggagatccggtttcatccggcgcagcttcggcagattatcagctttggtctgccctccggtctgcagaactcgattatttcgattgccaacatcgtggtgcagtccaatattaacaagtttggcgtgatggcagtcgcagggtgcggcgtgtattccaagattgaagggtttgccttcctgccgattacctgttttgcgatggcgctcacaacgtttattgggcagaacctgggcgcaaggcagtatgaccgggcgaaaaaaggtgcggcgttcggtattgtctgttccatgacgcttgcggaactggtcggcgtgatcgtgtatttgctgatcccgtacctggcggcagcctttgacagcagcgccgaggttgtgggatttgcaacgaggcaggcacatgtggaggcactgttttactgcttcctggcgttctcacactgtattgcaggaatcatgcgcggtgcgggaaaatccgcggtgccgatgttcgtgatgctggtttcctggtgcatcatccggatcacttacattacgataaccgtgcattttattccgaggatccaggtgatcttctgggcgtatccgctgacgtggtcgatcagctcgattattttccttgtgtatttcctgaaagcggactggattcacaattttgaacgggcagaacagcgataagaaaatgtagaacatggggaaaaagcgatgaaaaaatgggcagaatggctactggtggcaggggctttatgtatgggtatggcaggctgcggaagtgaagaaaaaaacacgtcgaacgcagatgcagaacagaaaagtgagactgcatcagagacaagagaagaaggacaggcaccggagcagacggatacagaaggaagtgaagaggcagaattacagacaacagagtcagaccatgcagagacgggacttactttcgcagatcttgtagcgctgcagtttgaattttgcagtggtgcaggtggatggtcaacggattttaccattgagaaggatggctctttttccggcgtatatcacgattcagatatgggggataccggggatggctatccgaatggaaccatgtattactgcaatttttcaggacatttcacgaacttaacgaaggtagacgacgatacttatgagatgtcacttgcggatatttcctatcagaatacggtcggagatacagagattctggatgatatgctttatgtttacacggatgtctatggtctggagggaacggataccttccggatctatctgccgggtacgccgagagaaaagctgacggaagacgaatggttctggattgcagcgggaaatgagagcgaaacggaactgacgatgacggtgatcgtcaatgagccgaatgaatatggaatttattcctatgagaggtcaaccccgtcagaggaagcgcagggaatatataatagtctgttgaactacaacgacgaactggaacagcaattacagagtgcctcaacgcagcaggaaatgaatgagattacggcgcagatgtaccagaatagtgatgatagcttaaaccagatctggcacatcgtgaaatataattcagatgagacagaatttgctcagattctggaagaacaaaaaagctggatcacggaaaaagaggcggaggcggaacagatcagagcagcaaataatggttcttcggcagagatggatgtcaacataaagctaaatgatctcaccgaagaacgctgcagggaattgttggagtatttgaaaaattaaataaaaagatgatataaaaaaacaggaatcgttctctttctggcatacagagcggaatattcctgttttttgttattctacttggagtagagtgaaaaaatgtggcagatgtagtagaatagaaacagaaaggagagaggatgaatgattgataatgtgacgtttggaggatttgtccggacacttagaaaagaaaaacagatgacacagcttgaacttgcaaagatcctgaatctgtcggacaaaacgatatccaaatgggagcagggaaaggcatttccagacattgcagtctgggaagcactcgcagaagcactggatgtgacggtggcagagttgtttgcgggagagaaattgccaaaggaagaaggaaaagtcagtgccgctgtatttgaggatggtattgcagtggcagcaaacgaagtccggcaaaaaaagaaaagataccggggactgttgatgattatggcggcgctgttagtggtggttgcaggtctgggtatcggcaaaagcctgaaagagaaatttgcagtatatatggtcagcatggatgcaactattcttgaggttcatgaagattattgggaagttagaggaaaggtaacggatgccaaaggacgcagcggagtttatgacatcagtctgacagaaccatggtatctggagcacccggtggatggtaaggaaggagatgagatccgctttttttaccgggaggattggaaaaatagaactttgaaagaaaacgaatatatacaagggattttttctatggagaaagtggaggatgagtagaatcgctagttgggctataaaagaaaaaatctccgctgtttatttgcaaatagcggagattttcctttaaaaattctgatagaactgaatgaactcattgagcgatttggaaggtttgctgttggtgcggtaggcgaaaccaacctcacgcttgtgaatcggaatgccgagcggaatctccacgagggctccggaggcgagatcgtcctgcacgaagcttttgatgacgcaggcgacgccgacgccgatcctggcgaaatcaatcagcagatccatgctggagatatcgatggaatcgtgaacaacgatatgattctcctgcagatagtcgtcgatgtactggcgtgtcatgttgttctggtctaagagcatcagtgtggaggatgtgaggatctcgtctttgcggacgccacgggcatgcagattgcgcagatagtctttggttgccacaaaaatatcctcgatctcttccagatagtcaaaatgtatattctttacattgtccggcttcccgatcagaccgatatcgattttgtcatcctcgagcagctttaaagtgtcgttcgtggattggcagtggatggagatcgtgatgtgcggattctgccggataaattcttttaagtagggaagcagcatgtatttgcaaagggttgcggagacaccgatcttcaagtgaccgaccccaagctcaatcgagcgctttaacttttcttccccgagtgtgagcgtctcaaaggcagtcttgacatgctcgtagagcagctgtccctcgtcggttaataccacgccgcgggaactgcgggaaaagagacggcagccgacgctttcctccagtttctggatggatttgctgatggcgggctggctgatgtaaagctccttggcagccttggagatattgcctgtgttggctaccgtataaaaaatccgataggatgaaagattctggttcataatagttcctttccttgggggtgttgatttcatagatatttgtatctgttctgacaaaagtatatcatgaattaatgttatggtaaatatatttattatgtatttttattatagtatgtgctatgataaaatagtcacgaatcagatgaatattacacacacacgaaaatagagtttgatagtaggaggggatagaatatgggtatgacaatgacacagaagattcttgcggcacatgccggacttccgtctgtctgtgcagggcagctcattgaggcagatctggatctggttctcggaaatgatattacatcgccggtggcgattcatgagatggataagatgaaggtggacggcgtttttgacaaggacaagatcgcgctcgtgctggatcatttcgtgccgaataaggacattaagtctgcgcagcactgcaaatgtgtccgtgaatttgcctgccgccatgacattacgaattattttgatgtgggagagatgggaatcgagcacgcgctgcttccggagaaaggactcacggtggcgggagatgtcatcatcggagcggattcacatacctgtacctacggggcgctcggcgcattttccacaggcgtcggcagcacagatatggctgccggtatggcaaccggaaaagcgtggtttaaggtgcctgctgccatcaagtttaacctgaccggaaagccggcaaagtggatcagcggtaaggacatcatcttacatatcatcggcatgatcggtgtggatggtgctctgtacaaatccatggaatttgtcggggatggcatacagtatctttccatggacgaccgttttaccattgcaaatatggcgattgaggcgggcggcaagaacggcattttccctgtcgacgatctgacgaagcagtatatggagaagcattctaagcgcccgtatgttatctatgaggcggatgaggatgccgagtatgagcaggaatttacgattgatcttagcacgttaaagccgaccattgcatttccgcatctgccggagaacacgcacacgatcgacgaggtgggagagatcaagattgaccaggtggtcataggctcctgcaccaacggcagaatggacgatctgcgcgtggcggcatcgatcctgaaagggcacagggtggcaaagggactgcgcgtgatcgtgatcccggcaacacagcagatctatctggatgcgatggaagagggcttgttaaagacctttattgaggcgggggcagtcgtttcgacgcctacctgcggaccgtgtctgggcggttatatgggtatccttgcggagcatgagagatgtgtctccacgacaaaccggaactttgtcggcagaatgggacacgtggagtctgagatctatctggcaagtccggctgtggcggcggcaagcgccatcaccggaaagttatccggaccggatgagattgcataggcgaggaaaggagacagagcatgaaagcagcaaagggtcatgtatttaaatacggagacaatgtcgatacggatgtcatcattcctgcacgttatctgaattcttctgatccgaaggaactggcgacacactgcatggaggacattgacaaggattttgtgaaaaaggtaaaagcgggcgatattatcgtagcaaataagaacttcggatgcggttcgtcgagagaacatgcgccgatcgccatcaaggcttccggcgtgagctgtgtcatcgcggagacatttgcgagaatcttctaccgcaatgcgatcaatatcggactgccgattatcgagtgcccggaggcggcaaaagcgatcgaggcaggagatgaggttgaggttgattttgactccggcatcatcacggacaagacgaagaacacttcctatcaggggcaggcattcccgccgttcatgcagaagattatcgactgcgaagggctggtcaattatatcaatcagaaatagaattaaccttttgggcaatctgttccagataattcagatagcgcctggagattttaagaccggtgtagatatctgcgtattccttcggggagagcgtatcgacatagttttccgggaaatttttttgaatgcctgccgcgcgggcgagatcaacggccttgttgtaggcaatggcggctttttcctcggaggagtagctgccgatctggtaattgccattgatgtggatgacggcgcggtaccgcgggagtctgttctttaaaaactggagcaccccgtggtaacggttgacgatcacaatattggaatagcggaagtcactgttatctccgttgacaaactgatagtctcttccggcaacagcgtaagggcggatgccgtagcgggagaggatggaatactgcatgccatagtcgctgacgaacagatgcccctgccgtttctggatcttgcggctggaatagtagaacaggtcgtcaacgtcaaactttaactcctcgatgcgcgagagatagtagctgaaatagccgttgcgcaggtagatcggattcttaaagtaaatgccgttgttgcggaagtttaaaagcacgatgattttttcaaaggagagggttgtgggctgctcaatataatcttccggcagctgatccaaagagcccagaatggcaagtgcttccagataggcattgcctgcggtggtctcatccgcatagcttccgagactgatatgtttatttttgtaatagagaccggcacggtagtagaccgtgccgtctttttttgtggcgatggatacaccctgcgtcataggtcacctcttgtttaccataaaaatattatgtaaataagcattaggatacacttttgtgatgagtatagaataacagaaggaaagacgggatgcaatagcggaaacccgattgacgaaaatatacaactttgctatactaagaagagttagatgtgtgcaggatgtcatatattttggaaggggccattttcaaatgaaaaaaatatcaacaaaagtattgatcccggtagtgctgcttgcagtgattgcagtcatttcggcggtaaccggattaaaaaatgccaatgagctgcataccagcagcaaggagatcagtgacacaacggtggatcagctgatgctgctaaatgacatttcgtcgaattttaagagcattgatgcaatcacataccggatgtgcgtatccacgtccaaggacgagcgcgatcagctgatggagcaggtggatcagtaccgcacggacattcagacgtcgattgattcctatgaggcgctgacacagacgcaggaggaagctgcggcaatggagacgcttcgggaaaagtttgccgattacaccgaggtctatgaccggattgcagactttatttcccgcgggaataaggacaaggcgagacagatctgcaacacggtgctggcgccgaccagtgagaatgtggacggggtgctcacggagctggaagggtatatggaagcaaatgtgaatgccggcgtggcggagcaggaatctgtatacaataattcacgggcagtcagcggtgtcacatttgtacttgtgctgttgttctttgtcgttgcggtgatcggatcggtacgcaacgttgtaaatccggtcaagagtgcgacgacacagctgaatgatattttaaaagagatcgagtccggcaacggggatctgacacgcagaatctctttgaagagtaaggatgagatcggacagcttgccggcggcatcaacgtgttcttagagaccctgcagcagattatgagccgtattgtgattgactccagggagatgggcgagatcgtatcgcgcgtttcgggcagtgtcggcacagcaaactccaatgcctgcgatatttctgccgtgatggaggaactctcggctaccatgcaggaagtggcgtctgccgtcaacacggtcaataccaatgtggcgcagatcgggcaggatgtgaatgagattacaaaagaatcacaggatatgaactcctatgcgaccgagatgcagagccgcgcggaggatatgaaggagaaagcggttgccaacaaggagacgaccagccggatgattacggatatcatcgagactttaaaggctgccattgaggagagcaagagtgtggatcgcgtcaacgagctgacggaggagatcttaagcgtatccagccagacgaacctccttgcactgaatgcttccattgaggcggcgagagcaggcgaagccggaaaaggatttgcagttgtcgcggatgagatacgaaagctggcggattccaccagagagaccgcgaacaatattcagtccatcaacgcgctggtaacgcaggcagtgaataagctcgccaacaattccaacgcgatcgtcgaatacatcgacgggacgatcatgccggattatgaccgatttgtagaaaacggtgtacagtaccgggatgatgcggcgtatgtgaataccacgatggatcattttgaggagaaggcgcgcaacctgcagcagatcatggagaagacggtggattccatccgcgacatttccacggcgattgaggagagtgcaaacagtgtcggaaatgcggcgagcagcacgacggttctggtgtccaatatcgacaccgttcattcggagatggagacgaatcagagcatcagcgaccgcttaaagggagaagccggacgatttaaaaatgtataatattttagtacgttagtgcattgacatgaatgtacagtttcttatataatgtgagttaagtatataagagactgtacattttttttgtacatcgcatgttacaagaagaaagagataagaggattatgaagatggaattagtgtatgcaagtacgagagacgcacaggaaagagtaacggcatcgcaggcgattctgcgtggtctggcaaatgacggaggactgtttgtaccgacacagattccggcgctggatgtgccgatggaagagcttggcaaaatgtcctatcaggagacagcatatgaagtcatgaagcgttttctgacggattttaccgaggaggagttaaagcactgtatcaattccgcgtatgacagcaagttcgacacagaggagatcgcaccgcttgtggaggcggacggcgcatattacctggaactgttccacggttccacgatcgcttttaaggatatggcactgtccattctaccgtatctgctgacgaccgctgcgaagaagaatcatgtaaagaatgagatcgtgattctgactgccacctcgggagataccggaaaggcagcgctggcaggattttccgatgttccgggaacgaaaatcattgtattctatccgaagaacggtgtaagcccgatccaggagaagcagatggtgacccagaaaggtgacaatacgtttgttgtcggcattcacgggaactttgaccaggcgcagactggcgtgaagaagatgttctcggatgcggcgctggcaaaagagatggacgctgccggatatcagttttcctccgcgaattccatcaatatcggaagacttgtaccgcagattgtatattatgtctacgcctacgcgaagctctatgcgaatggcgtgatcgcaaaggatgagccggtgaatgtcgttgttcctaccggcaacttcggcaatattctggctgcattttatgcgaaaaatatgggaataccgattgccaagctgatttgtgcgtccaacgagaacaaagttttatatgatttcttctccacaggcacatatgacaagaaccgtgaatttatgctgacaagctcaccgtcgatggacattctgatttccagcaatctggagcgtctgatctaccgcattgcgggaaatgacgccgagaagaatgccgcgctgatgagagagctgacgaccaccggaaaatacgagatcacgccggagatgagagcacagcttaaggatttctatggcaattacacaagcgaggcggagacggcagaggtcatccgtacactttatgagaagacaggctacgtgatcgatacacatacagctgttgctgccggtgtatatggaaaatacaaaaaggataccggcgatgtagacaccaagaccgtgattgcgtccacggcaagcccgtttaagtttacaagaagtgtgatggatgccattgaccacaagtacgacagcatgtccgattttgaactggtggatgagttgagccggattgcgaacgtagccgttccgcaggcgattgaggagatccgcaatgcgaaggtgcttcacgataccgtgtgtgaagtggatgagatgccgcaggtagtaaagaatttcctgaaaatctaagaataaaaatgtgaaagacataaaaaagctgcacgccccgcgtgtgcagctttttttgataaatcttttttgataaactatttttcggaacagatttcaaagatgaagtgaagcgttccaaacgggaataaaaccggcagaagataagtctcatgctcaaaggtaagcagatctttttcttctacaaccggagcctccagtgacagattcatggagaactcgtttgacatattgacacagaacagaccgttgtgcagattgataaaatcttctacagaagaacgcacatactcatcaaattctgtaaagttttcgttgacatacttggatgcaaaagcaatacatgtattctctggaatatcgagataagtccggatggaaaacgatccgcttactttctgtgatacgcagtagttggtcgggtattccttgcaactgctcggagaaaccagtgtgaaatcatctccgataaaccgatagagattattgaacaaaagctggaaaaaagagatttcatactttgagagcggacgctcagcgagaatgaaaaagttctcgatcatatggcggatggcatcctgatcttcctcggagtaactgtaatcgtccagttcgttctctgactgataatcaatgatcaactcctggagctgctgattattgatgagtccttcgtccacaagtgcctgtccgagaagaagaaaatccggcttctgctctgcgagaagcttagtcacttcctcttctgtgagatatccctcatgaatggcgagttcaccaaaacgcttgtcctcgtgtgtctgaagaatgacgatacggtctacctcgtttgcggtcatatatccggcatgaatggcaagagtgccaagtttgatcttggttgaggacttccgatgcatggtctctaacagctgctccctggtaacgacaccgtgtgataataagtaatttccgaaaaactgagcgtacatagcttatctcccttcaaatcttgaagaaataatgtgatgaatctgttctgcattcagcggcttctggataaaatcgttagccccggcctcaatggcagcttttaactgtgtctgtgtaccgacggatgaaacgacaataatatcagcatccttatcatatgccttgatctcggtaatggcagcaatgccgtcctttacaggcatgacaatatcaaggaaaaccaattcaggtgactcttttttgtagaggtcgatggcgtcctgtccattggaagcttccagaaacactggagtaccatatgtggaaacaatatcctttaactgctttcttgcaagtatggagtcgtcgccaatgagaatcttaatgccatttaacatcataatgcatctcctctgtcatcataattatattcgcttctattttacactaacaagaaaaatagttcaatgaatatattgaattttgtaagaagaagatagataatgtaaaaaaatatgtcgaatcagtcgactggaatgagaggatacaagaatggacgtaatgctgatatttgatgtggtcatcgccattttcggggtatatatgatcggagcagcacttaagatgaaaaagacagggaagatcagctcggcggtcatcacggcggaggagattgccagatgcagaaaaacgaaggagttcataacgtttatttactggaaagaggcagtattcggcgcattgattatcgctgtgggtgtccttggaattatcaatgataaagtggtatcgctcggtgcatttaacgtggttgaacttttaatcttcctggcggcatttctgtggttccagtcccagctgcgcaaggcaagggaacagtttttataaaagattctccgaatcatcagatggcattcacaggaacgtcacattgcgacgatatgatgtcaaaaacagggaggtatctgcgttatgagaagaatattggtagtagatgacgaagaaaaaatcagggcgattataagaaaatacggagagttcgaggggtacgacattaccgaggcaaaagacggcatggaggcggtaaagctctgcagagagcaggattttgacgtgattattctcgatattatgatgccggagctggacggcttttcaacctgccgggagatccgcaagaccaaaaacattccggtgatcatgctgtcggcacgcggagaagagtatgataagattcacggatttgaacttggaattgacgattatgtggtgaagccgttttctccgaaggagcttatgatgcgtgtaaaagtggtcattgaccgcaacggcggaagagattctgcaagcacgaacgggcatgagattttccaggcggaggggcttgtcattgattttaccggaaggactgtgacggtggatggaaagcgcgccgaactttctccgaaagaatacgacttgctgttttatctggtgcggaaccggaatattgcactggagcgtgaaaagctgattaccgaggtgtggggatatgattattacggggacgaccgtacgctggatacccatatcaagctgctgcgcagcagccttggggactaccgcaagttccttgtcacgttaagaggggtggggtaccggtttgaagcatgaaaaaatcagtatcaaatggaaaatctttttctatcttctggtgtttaccggaatccttttgacggtgctgtggcttgtgcagatctgttatctggacaagttctataagaagatcaagtcccaggaggcactggaactcacctcggaagtgattgaggtcttacagagcgattcccagaacattgaagaacagatcgatgcgctggcggcgcagaataacatgatcgtgtttgtcacggatacggacggaaacaccatttacagcgcagaatatattccaaattccaggctgtgcgagatgccgcaggagatgatacagaagctgtacgaagctgccaaaagcaagggcggtagcacgaagctggaatttgagggagatgtcgggaagaatgattttcagaatccgcaggacgtgatgaacccggatgcggcagcgggtgccacaggagcgggaaactccccggatgcagccgatgtgacaggagcgggagcagaaaatgccccaggtgcagccaacggcgcagagcaggagactgcaggaatgccggtgcagaatggctttatgcagaaccacggacaggaacggattgagagcgtcatttacgtgaacgtcgtctcgatcgacggaagtgagagaatcctgtttgtgaacgcgcagctgacgccggtggatgcgacggtcaatacactgcgtgccgaactggtatggatcacagtcatcatgattgttctctcgctcggtattgcacttttgatttcaagaaaagtgtcacgttccctgatcggtctgaatgcctccgcgaaggagatggcaggcggcaattttgacgttcattttgacggaaccgattaccgggaggtcgcggaactttccgataccctgaatatgactgcgcgggaacttggaaagagcgagcgcctgcggcgggaattgatcgccaatgtatcgcatgacctgcggacaccgctcacgatgatcattgcctacgcagaggtcatgagggatctgccgggggaaaattctccggaaaatgtgcaggtggtcattgacgaggcggagcggctgaccaatctcgtcaatgatatgttagacatctccaagcttcaggcaggcgtactggaaaaaaatgtcacggtctacaacctgaccgagagtattcagtctgtatttgcacggtataataagttaaaagagcaggatggttataagattgatttctcctacgaccagatggtcatggtggaggcggacgagtacaaaatcttccaggtcatctacaatctggtcaataacgcaatcaattacaccggggatgacaaacagatctgggtgcgtcagattgtgcgggaagacggatatgtgcggatcgaagtgacggacagcggcgagggaatcgctccggaggcgcttccgtatgtgtgggaccgctactataaagtggacaagacacacaagcgggcggtcatgggaaccggactcggactttcgatcgtaaaaaatattctggaactgcacgatgcacgctacggagtagagagtgaagtgggaaaaggttctaccttctggtttgaactgaaagtatatcagattgtttaaaagagctgcccgcggattgacggagcgggcagaatggaatactctggaaaatacgcgtgatgagagaactccgtctgtaatggacggggttcttctttggaggaaaatgcgagtgtttctttcatgccgcgtttgacatcttattctgtgtctttgccacgtttgaacactccgccgactgtgtccgacacgccgcagacaatgagcgaccttcctagcagcggcattagcgccacacgaaagctctaaaattgtctgtggcgtgcggactcatccggcggagtgctccaaacttggaaagacacggatcatcagggatgtcaaacgcggtgtgattagaaacaccggattttacggtcagaagaaccgccggccattatagccggagttctaagttcgcatattgccacatgcttcgtcctgcccgctctgtcaatccgcgggcagcttttttagaatgaggtgtgcagtgaaaatcagacacgctcatccatcgggacataaatcttatgctcgccgacgtttttgtaggcaggacgcatgatcttgccgccgcctgcaacttcctccagacggtgcgcactccatccggcgattcgcgcgatggcgaaaatcggcgtgtagagttcgaccggaagtccgagcatgctgtaggcgaatccgctgaagaagtcgacattcgggctgactcctttatagatcttgcgctcggcggcaatgatctgcggggcaagacgttccactgccgtgtagagtgcgaattctttttcatagcccttttctgcggagagacgctttacgaatccgcggaagatctgtgcacgcggatcggacagcgaatagaccgcgtgtcccataccgtagatcagaccggcgtgatcgaacgcttccttgtggagcagggcagtcaggtaacggctgatctcctcctcatccgtccagtccttgagattggccttcatatcgtcgaacatgcgcaccaccttgatgttggcaccgccgtgcttgggacctttgagggaacctaacgatgccgcaataacggagtatgtatcggttccggaggaagataccaggtgggtggtaaaggtggagttgttaccgccgccgtgttccatgtgaagaatcagggcaatatccaaaagctttgcttcaagcggcgagaacttgctgtccggtcttaaaatgtgcagaatattttcggcggtggaatattcttccttcggggaatgaataaacaggctcgcgccgtcatgataatgcttgtatgcctgataaccgtacacggataaaagcgggaaaagactgattaactgcagacattgtctgagaacattgggaagcgaaacatcatccgccatctcatcgtaagaatataaggtaaggacactgcgcgcaagcgtattcatcatgtccttgctgggcgccttcataataatgtcacgcacaaagctggtcggcagcgtccggtaactgctcagcagagccgaaaaatcgcgcagctcatgcttcttgggaagcttgccgaaaagcagcagataggtacattcctcaaagccgaagtggctgtcctcgggaagtccggcaatcagatctttgacattgtaaccacgatagaagagctcgccgtctgcgggaacagattcaccattgacaatttttgtggaactgacttccgagatctccgtcagtccgaccaggacaccttttccgttcagatcgcgcagaccgcgtttgacatcgtatcttgtgtataattccgggtctatttttgaacattcggcagactttgcggccagccgacgcagttcgggtgtaatttcacagaattgattcattgttagccctccttaatgttttcgtcttttcatcatagcatatgtacttatttttatacaagaaaattgaattatatttaatgaaaattttaaaatttaaaagaaaactggtaccttaaaaagggaaagtaccaaaaaatgctttcttttttcagaagagtctattacaataaaaaaggatcatcagatgtaaaaagggaggatacaggatggatctgaatatagagttgctggcaaaaaaggcaatcgaggcaaaggaacatgcgtatgtaccatattcccatttcagggtaggtgcggcgcttcttactgcagatggtaagatttatacgggatgcaacatcgaaaatgccgcgtacacaccgacgaactgtgcggagcggacggcgtttttcaaggcggtatccgaaggggagcgtgattttacggcaatcgccatcagcggtgacgcggacgattatctgtatccgtgcggcgtgtgcagacaggtaatgtcggagttctgcaaggcggatacgtttcagatcatcctggtaaaggaggacggaacatataagatttttaccttggaggagcttctgccgggcgcttttactgagacagagctgaaaaaaggacagcggatgtagggcgtccgcaacagaggaaggagagcgttatgagatattcgattgagggagaaccgcttccagttgtcatctgcaatctggagcagggagaggtaatgattacggagagtggtgccatgtcgtggatgtccccgaatatgaaaatggagacgactggtggcggcatcggcaagatgtttggaagagcgctttcgggggaaagtattttcttaaaccgctacacggcaatgaacgggaatgggatgatcgcgtttgcatcgtcgttcccaggatcaatccgggcgtttgatattgtaccgggacaggatttgatcgtgcagaaatcggcatttcttgctgctgtatccagcgtggatctgtccgtgttctttcagcagagaatcgggagcggacttttcggaggagagggatttattatgcagaagctttccggaagtggaaccgcatttctggaatttgatggttatattaaagaatatgaacttgcacccggacagcagattgttgtggacacgggataccttgcagccatgacaggctcctgcaagatcgaagtgaagacggtgccgggagtgaagaatatgctcttcggcggcgagggtatttttaataccgtgattacgggaccgggaagagtgtggctgcagagcatgccgattgcacagatggcaaatacgctgcgtccgtatttcccgagcaataatcattaaagatgcgcggcgcattttacattcagaaaaaaaatagaaatgcgcacagaaattggcactaatttttggttgcagatcggggcatattaaagtataataaaaccagtaagaaacagcctgggatgtgcgacaccctacatttttgaacctacatttacttttatgggattcttatatttggaggcagatgtcaagccaccagtaccgcaaggtacgcgagcagtggaagacagaaactgacatgcggttacccacctagcggcagctaggagtcaaaaacgtaggaaacggcattttgggtgatacaaaagattctgagggatacaacagaagcttacaatacgagagagaacctgtcaggatacgaaggatgacggatacgaaagatagatcaggtactaaagagtagagagcatacagaagaaagaagctgcctttgtgtgaggcagcttctgtttttttactcttttgcagagaattctggggcaaggcataaagtgtgatgggaagtggaaaatgggaaagagaacaaaaaagcgaggcgtaaaggcacacatcgccatcgtatgtctggtgcttttacttgcggcgggtacgcttgcgtctggatatcgggacagacagttaagggagcaggaaacattgcccgaagaccgggtggaacttgcggaaataaaagaggaactctcctttggagtatacgggcaggaagattggaaagccttttttgagacatttcccggagacaggctgaccggggaaatactggaagaactgctcgcaaagctgcagctgtccgattacatagagattcctgtcatgagggaacagcaaaaagtatcccgggaagactggaattatgtctacggtcagatcctggatctgctcgatatggaacatgccgtgacaaaaacggagtttctggttgtggatgtcatggaggcggagaaccagaatgtgattataacaaataagggagacttttgcaccgtgcttccggcaggctattttaagcagtggaacggatatgaaggttactgcgtggaaaaccggtgcatcggagtcgtgggaacgctgaagaaggaatttacgctggacaatgcataccttacggactgttccgaggacggcgtggattttctgtatgcgggcgcggcacatcacaaggagacggcggctctgacagagaccgtttccccctgtgtatgcgatattgtgctggcggacggggaacttacggcactgcgtgtaaagcaggagaccatcgagggagaactgttgtcctatgacgatgagaccatcgagatcaaaggatacgggaagctttgccataccggaaaactgccagtgtaccagacctatggggaagtgtcggaaaaatccatttccgatgtgaccctcggcaatatgaacgtggagtatgtgacgggggagaagcaggtctgcgccattttaatccgcgagccggctgtcatccgcgaaatccgtgtgctgctcctgggggatgacggaacaaaatgccggcagtccgtctatctgaaatgtacgtcagacgcagcggtcacctggcagggagagacaacacatgtggcagcgcagacgctgattgctgcatccgatcagatgacaggagatacacagggaacatttacggtgacgccggagcaggagggctgtgtggtgatctgcgatgcagatggcgcagagatttccaatggctacgggggcagcatggaagtgcggtgcatgggagacggctatacgctggtcaacagtctgccgctggaacggtatctgcaggacgtcgttccgagtgaaatgccggcatcctatgaaccggaggcattgaaagcacaggcggtctgcgcgcgcagctatgcctgtatccagctgcttcggggcgatctggcggaatacggcgcacatattgatgacagcaccgcgtatcaggtatacaaccgggtgacggacgcggacgcagccagggaggcggtaatcgccacacagggggaagtgctgtcctatcagggaaacatcgtggaggcgtattatttttccacgtcgatgggatacaccgccgcagctgatgtgtggaatgtggaagatccggcggaatacggctatctgacaccggcgtgtctccttacggatggaaagatgcaggatctctccggggaggaggcgtttcttgcttatattcagagtcccgcagatggatacgacagtgactgccggtatttccgctggagagcggaggcggattaccacgggaaaacagatgaagtgaattccatactgctggaacggtggaagagttcaccaaagaatataaacttttatccgaccggtcagactacggaaatacagaatcccgatgcggcatcagtggcggcactgggggaggtgaccggcatgagcgcggcggagcgcggcagctccggtgcactgcttgccttaaagatcacgtatgagaagggaagcgcccttgtgcggacggagtataatatccgaaaagttctggggatctgtaccgcaaaactgacatgcgcagacggcgcggaacagacggatgtgacgatgctgccgagtgcgttttttgccataacgaaacaggaggacggcggcatggttttatacggaggcggctacgggcatggactcggcatgagccagaatgcggcgaatggaatggcgaaggcaggaatgaattacgaagagatcttgcaatatttttataatgacgttaaactggaaaccatgaaataatgaatcctgacggattcgctttttgaaggggagcaatatgatctggaagcttattggtaatgtcaaatcctttcttgataaatgcaagagggataagatcaatgcctattcggcgcagtcggcgttttttattatcttatccatcattccgtttctgatggtgttctcgtctctgctgcaatatacatcggtgacagagtccatgctgcttgagatcatccgtcatctgatgccggagtatgtctctccgtttctgatatcgctcgtggatgaggtgtacagcagatccatgggaattatctcaatcacggcgatcatcgcgatctggtcagcggccaagggcgtccagtacatgacggacggactgaactcggtcaatgatctggaggagacgaggaactggtttgtgctcagattctgggcggtcgtctatacggtggtttttctggtggcgattgtttttaccctgctggttctggtgttcggaaaccagttaaaggtacttgccacacagtacgttccgattttagagcatgcctcgcgggtgctggcacatttccgcgggcttgtgatgctggcgcttttgattgcatttttcgatgtaatctttacggcgctgccgaaccggaagctttccttccgcgggcagctgccgggggctgtgatctgcggggtagcgtggtatgtcttttccttcggactgtctgtctacgtggactattttaacggtttttccatgtacggcagcctgacgactattgccttgattatgctgtggctttacttctgcatgtacatcatgatgatgtccgccgaggtaaatgtggtgttcaacgcttacttccgcaaatggtggaagcgctttaaaaccagcaggaataaaaaagcttgatgttttgcgcctgctgtgctaaaatgctatacagaattcagaaaaatcaaaggctgtgaatgtgtacggaagcgattccgggtatcgtaagatatcagtagagtgcaggagactctttcagagagagcgggtcatcggctggaagcccgtttaggataagacctggacttgaagttcgcacaggagctgcatctgtgaagtgaaagtagtggatgacgtcggatacacgttacgtatgaattgagagcttttctttggtgatatgaagagaagaaacagggtggtaccgcggaatcattcgtccctagagcagggatggatggttccttttttgatgtctgaaatagtttaaaggagaattagaaatgaaagaaaaattgcagcagatcagagaaaaagcaatagcagagattgaagggtctgatggattagaccgcctgaatgaagtccgccaggcagtgcttggaaaaaagggtgaacttactgcggtgttaaagggaatgaaagacgtagcgccggaagaccgcccgaaggtcggacagtgggtcaacgacacccgcaccgccattgagacgatcatggaagagaagatgaaaaaactggaggctgaggcgctccggaagagatatgaggcggagaagatcgacgtcacaatgccggcagtaaaacacgaaaagggcaatctgcatccggtcacacaggtgcgcaaccagctcattgacatttttgcatccatgggatttgaagtgtacgagggaaccgagattgagaccgactactataacttcacagcgttaaacacaccgcaggatcatccggcgagagatatgcaggatacattttacctgtcaccggaatttttactccgcacccagacgtctgccggacagattcatgtgatggaggcgaagaaaccgccgatcaagatcatctccccgggcaaggtgttccgttccgatgacgacgcgacacattctccgatgttcacccagatggagggtcttgtggtagacaagggaattaccctctgcgatttaaagggaatgttagatgagcttgtgaagaagattttcggaaaagagacgacaacgcgtctacgcccgtcctacttcccgttcacggagccgtccgtcgaggtagatgtaagctgcttccagtgcggcggatgcggctgtaagctctgcaagggaaccggctggatcgaagtgctcggagccggcgtcgtcaacaataaagttctggaaggatgcggcattgatacgaatgagtacagcggttttgcgttcggtatcggtattgagcgaattgccatgttaaaatacggtattaacaatatcaagctgctgtttgagtcagatcttcgcgtattaaagcagattgacgattaaagacgaatagaaaaggagagttatcatgttagcaccattaagctggttaaaagattatgtagatattgatgttaccccgaaggaactggaggaaaagttgttttcctgcggctttgaggtggaggagctgattgaagtcggaaaagacatcagcaatgttgtggtcggactggtggaatcctgcgagccgatcccggatacccatttaagtctctgccaggtgaatgccggagagcacggcaccttccagatctgctgcggggcagacaatgtccgtacaggcggaaaatatccgctggcgcttgtgggcgcaacagtctatgcgaccgcaaaggatcatgtgacgatcgagggcgtcatgacgatcaagaagggaaagcttcgcggctatgaatcctacggtatgctgtgttccggaacagaactcggattgaacgaagatttatatccgggggcaggatacaacggtcttttagttcttccggaagatgcggaagtcggagcagacgtaaagccgatccttggaatggatgactggatttttgatattgcgatcaccgcaaaccgcccggactgtcagagcatttacggaattgtcagggaagtggctgcagtgctcggaaaagagtgcagggagccggcgttggattacacggagacggcggtacagaaagactttaaggtggaagtatccgcaaaagatctctgcccgcgctatatcgcgcactatgtccatgacgtgacgattggggagtccccggcgtggatgcgcagaagactggcgttagtcggaatcaactcgatttccaacatggtcgacatcacaaactacgtgttaaaagagctcggacagccgatgcatgcatttgactatgcttatctggagggcgatcagatcaatgtcagacgtgcaaacgagggcgagcgcattgtgacgctggatgaaaaagaatttacgctcaattcttccaatcttgtcatctgcgacggcgtaaagccggttgcactggctggtatcatgggcggtatgaactccgagatcaaggacacgacaacggaagtcatgtttgagtccgcaaagttcgcgcgcgacaatatccggaagagttcaagagcgctcggacagtcctccgattccagtgcgatgtacgcaaagggcgtctatgagtacacgacggtcatggcgatgaagcgtgccctgcatcttgtggaagaactgggatgcggaaaagtgtcgtccacacagcttgaagtctccaccggcaattctatcgagccgaaagagatgaaggtcagcgtaaagcgtgtcaacggtgtgctcggcattgaggttccggaggaggacatgctgcgcattttatcggcgcttcagttcgcaccgtccatcgacggggatgaacttaccctgcagattccggcataccgcgaggatatggattcctacccggatgtggcggaggaagtgatccgcatgtacggttatgagcatgtgattccgacctttatgccgacagcaaaagtgaccctgggaggtcttaacttaaagcagaagacggagcttaagatcaagcgggcactctgcgcagcgggcgcttacgagggagtccattactcattcttctccccgtccgatctggatctgttaagactgccggaagacgcgccggagagaaaggcgatcaagctgatcaacccgatcaacgtggatttatccctgatgagaaccacgctggcatccgagatgctgtacgcgatttccagaaaccagaagaagggaattctggagggacgcatttttgagcttggaaatgtctttattccaaaggcactgccgctcacggaatacccggatgagagagagaccctctgtgcgggcgttttcggagaaaaggaatccttctatacactcaagggtctggcggagacggttgcggatgcattaaacgtaagctttacctatgaggcggcggagagaacctttttgcacccgtaccagacggcggagatcttctgtgagggagagcgcgtcggttatctcggaaagctttcctatgagattcaggatgaacttgacatgcgtgtgcctgcctatgtgatggagattgacctcgcggcgcttaagaaatggtatggcaaagagcagattttcactccgcttccgaagtttgcggaggaaaagcgcgattttgcgtttgtggtagataaaaatatcacctgtgcacagattgagaacggcatccgggaagcctgcaaatacgtgacagatgtgaatctgttcgatgtgtatgaaggcatccagcttggaccggacaaaaagagcatggcattctctgttgtatttaccccgcaggaggaagagctcacgggcgagatggtagaaggatttgtgaagaagattttgaaacatctcgaagcaacactggatatcagacttcgtgcgtaagaggagtagttatggacgtaaaagatttttattatgaccttccgcaggaactgatcgcacaggatccgctggaggaccgctcaagctccagactgatggtgcttgacaaggcaaccggagaggtggaacaccgccattttaaggatattgtggactatctaagaccgggtgactgccttgtcatcaacaatacaaaagtaattcctgccagactgtatggcgtgaaggaaggcactgaggcaaagatcgagattcttctgctcaagagaaaagaaaacgatgtctgggagaccctggtcaaaccgggaaaaaaatgcaagatcggaaccagaatcaatttcggcgagggacttctgaccggcgaggtcattgacattgtggaggagggcaaccgcctgatccagttccattacgaagggatttttgaggagattctggatcagctcggacagatgccgctgccgccgtacatcacacaccagctgaaggacaaaaaccgttaccagacggtgtatgcaaaatatgacggttccgcagcggcgccgacagcgggactgcattttacaccggagcttttagaacaggtgcgcgccatgggcgtggagatcgcggaggtgacgcttcatgtgggacttggcaccttccgtccggtcaaggagagtgatgtgttaaaacatcacatgcattccgagttctaccggatcgagcagtcggaggcggacaagatcaaccgggcaaaacaggagggacaccgggtcatcgccgtgggaacgacaagcaccagaaccctggagtctgccgcagatgaacacggcatgcttcatgagacgagtgggtggacggagatttttatctacccgggctatcagttcaaggtgatcgatgctttgattacgaatttccatctgccggagtcgacgctggtgatgttagtgtctgcgcttgcaggaagggaacatgtgctgcatgcatatgagattgcagtacaggagcgttaccggtttttcagctttggtgatgcgatgtttattaccgcaaaataggaggagttggtcccatgctggaaaagagaaaacataagcgccttaagatggaacacgcgctggaactggcgcggttaaatgcggacggcacggccgacggcggcgttgtgaatgcggatatcctgaatatctcgcgcggcggagtcggatttttgtcccgcaagagactcgaggtcggcagttattatgacaccaggatcagcctgttcagccgggagatgattgacgctgtgctggaaatcgtacatgtggaagagcaggaaaagggctattactacggcggagaatttatcggcatatcggattcggatgcggtaaagattgatatttaccaggtctttcacgacatctgaccgtgaaaatagacaaaaagacacgtctgattgtgtgcattatatacgaaatgacgataaaatagtgccacactattgacaatggtgatcattaaatttataattggtaacagttaaaggatagttcacaccgcaaggtgcactaaaccggaaagctgaatacaggctatttgggcatgtatgaagttttccggtttttctttttacaagaggagtctgttgtttgaaagaggagggagtcagatgagaatctatcgggcaaaagattattatgacatgagcagaaaggcagccaacatcatatccgcgcaggtgattatgaagccggactgtgtgctgggacttgcaaccggttcgacgccggtcggcacttatgcacagcttgtggagtggtacaaaaagggggatctggatttttcagaggtaaagacggtgaatctggatgaatataaaggactcgaccagtcgaacgaccagagttatttttacttcatggcggaacatctgtttgacaaggtcaatattgattttcagaatgtcaatatcccaaatggaatggaaacggatgcggacaaggaatgtgcgcgctatgaggcgaagataaaagcgctcggcggagtggatctgcagctgctcggaatcggtcacaacggtcacatcggattcaacgagccgaacggacagttcgaccgcacgacgcactgtgtgaatctgacacagagcacgattgaggccaacaaacggttctttgcatcggaggaggatgtgccacggcaggcgtacacgatgggaatcaagacgatcatgcaggcgaacaagattctgatggtggcaagcggggaagacaaggcggagattgtaaaacgtgcctttttcggaccgatcacaccggaggtgcctgcatcggtactgcagcttcacaacgatgtgacactggtgggagatgaggcggcgctgtcgctgatcggctcctgtcagagttaggatatgggaatgaaatcatgaagataagtaaagtgattaataacaacgtcctgtcggcatttgatgaaaacgggcaggaagtcgttctcatgggaagaggactcgggtttaaggcgaagacaggagacgacattgacgagagccgggtacagaaagtgttctgcatcgaaaattcggcgctctcaaggcagtttcaggaaatgatctccaacatccctatggagcatatgcagatctcggcggacattatctcctacgccaagaacgagtgcggcatggagttaaaccagagtatttacgttgcgctgacggatcacatcaatttcgcgattgaacgatacaggaatgggattgcgctgtcgaacgctattctgtgggagatacggcagttctaccgcagggagtatctcgtcggagagtatgcgctccgcctttttgcggagagactggatattcatttcccggaggatgaggcgggatttattgcactgcattttgtgaatgccgaatataatacggatatacatgacacttatatgatcacggatgtgattcagaagggaatcgagattgtaaaggcagagtatcagaaagcgctggatgaaaaatccatgcactacgagcggtttgtggcgcatctgaaatttttcgcgagaagaatcttcttcagcaaggaaatgctctccgatgaggagcaggagttctccgatctgattgaactgaaatatccgagggaatatgcgtgtgccagaaaaattgccgattacatcgaagcgcagtatgactgcacggtgaccaaggaagagatcatgtacctggcaattcatatccggagaattacgacagacagcgatgaatgagaaaggagagaggctgatgtttggattatttcataaaaaagaacagaaagcgctggaactgggagcgccggtaagcgggcaggcagtaccgcttcaggaggtgagcgatcccacgttcggcggggagattctcggaaaaggcgtggcggtaagacccacggatggcaggatttacgcgccggcggatggggagattaccttgttatttgatacactgcatgcgctcagcatgacgacggataccggggcagaactgctgctccatattggactggacaccgttgcattaaagggtgcgcattttaaggcgcatgtaaagacgggggataaagtcagaaagggtgatctgctgttggaggcggatcttaatgcgatccgggaagccggatatgatgtgatcacaccgatgattgtctgcaatacagactgttttgcagaagtaaaagcggtgacgggtgcggaggtgacgccgcaggatacggttctgattctcacatcgaagtaatcagttattcaatggtattttaaccggagctttccggtataaaataaaggggcaaatcatatatggcatagtgagaaagtctactgtgccagaaaaagaaggaggaagaagttatgatgaaatatcttcagaagttaggaaaagcattgatgcttccggttgcctgcctgccgatctgcggtatcttaatgggaatcggatatgcactctgcccggcaaccatgcagggtggtgacattgcaggtgcaaaggcgctgattggatttttccttgtaaaagcggggggcgctttaattgacaatatggcatggctgtttgtcatcggcgtcggcgttggtatggcagacgacaatgacggtaccgcggcacttgcggcgctggcatcctggctgatgattaccaatctgctctcgacgggcgttgttaccacattgatgccgtcaatcgcagagaatgcggataagacgctggcattcgacaagattgcaaacccgtttatcggtattcttgccggtatcatcggagcaacctgttataacaagttcaagggaacgaagcttccggactggctggcatttttcagcggcaaacgctgtgttgccatcgtatccggtgtggtatcgattgtcgtgtcagctatcctgttattcgtatggccggttgtgttcggcgcactgatcgctcttggtcaggcaattgtgggaatggatgcagtgggcgctggtatctacgcatttttgaaccgtcttttaattccaaccggtctgcatcatgcattgaacaacgtattctggtttgatacgatcggactcggtgatctggccaacttctggaagggcaagacatcggcggatgtatcatgggatctcggtatgtatatgtccgggttcttcccgtgtatgatgtttggtattccgggtgcggcacttgccatggttcacacggcaaagagcaataagaaaaagatcgcaatcggattggttggttccgcagcactttgttcattcatctgtggcgttactgagccgttcgagttcggattcatgttccttgctccggcactctatgtagtatatgcattattatacggtatttttacctttatcacggttctggtaggcttccgtgcaggcttcagtttttctgcaggtgcaactgacctgatcttttccgcttcccttccggcggcaaagaacacctggatgattcttccgctcggaatcgcagcatttgtcgtattctatgttgtattccgttttatgatcacgaagtttgatttaaagactccgggacgtgaagatgacgatgatgatgcagagaaaggtgcaaagcttgagaataatgattacaccgaagtggcaagaatcgtgcttgaaggtgtcggtggcaaagagaatatagaaagcattgataactgcattacgagactccgtctggagatcagggattacactaaggtagatgagaaaaagatcaaatctgccggtgtggcaggtgtggttcgcccaagccagaaaacagtacaggtcattatcggtacccaggtacagtttgtggctgatgaatttaaaaaactttgtaagtaaccatattctgtaaaatagattgccccaatgaaaaacgaccgcgaaagcggtcgtttttcgatgcagacatatattcagcgctcataaatggtgtagtggtgcttttttagaagtgtgatggcggcggcgagcgattcgctgtcgtacatttccagatgcagcacgccgtcctcaaattcacgattgtggatgatgccgatattcttgatgcttaaatggttgctcgcaagaatggtggcaactgtggcaattccgcccgcttcatccagaagatccatgtacagttcatatacctgttttaaggtgccgttcgcgtgaagggtcagtgaatcccggtagtcttttgccgaggtaaaggcctccatcagcgctttgctgtcggaagcggcgatggcagagcgcatatgaccaagctcctcacagaaagagtcaatcagtcttagaatctgttcctgattggaaagacagatattttcccacatgacgggggaggaggaggcaatgcgtgtaatgtccttaaagccgccggcggcgatggttttcatggttccttcacagtcatcgcagcttttcacaaggttgacaaggctgtaggcgatgatgtggggcagatggctgatggcggcagtggcataatcgtgctgctcgtagtcaagcaccatcggtatcgcaccgagagatgccacaagctccttaaagtcctctaacgcagcgggatcggtctgggcggtcggggtaagaatatagtaagcattttccaataaaaattccctggcattggcaagaccggtcttctcggagcctgccatcggatgtccgccgataaactgcgcctccatgccgagggcggtcacttcccggtgaatgtcggtcttgacgctgcccacatcggtaatgatgcagcggtcgcagacgtgtccctttaaaagacgcagatattccatgtttttctggacaggcgtgcacagaaaaatatagtcgcagtcatagaaatccgacagttcacaggggctggcgttgtcggtcagtccctctttgtaagcggcctctatcgtcgcggcatgaccggctgtagcgataatgaccagatctttatgtagaatacgaaggcgcttggcaatcgaaccgccgatcagtccaagcccgataaatccgattttctgaagtttcataaatgaatcccccacaagttattggtacccaattatcatagacatttccgcctggaaagtcaacacgttaatctgtgagagtacggaaagatgcggcgtgtatggcgagaacatgtccaaattgtaaatattgtgtaaataataaaaagaagtattccaaaaatgttcaaaagtaatacatattattgctaaatgtttctgatattataaatacagttagtaatattgaataaataagttgtaaaaaaagacggaatttagtaaaatatatccatacataaaacaattacagaatatggagggtttgctatgaatgtttacacaactgacagaattcgtaatgtggttttacttggtcatgggggatgtggtaagacgagtcttgtggaagcaatggcttatctggcaggcatgacatcacgtatgggaaaggttgaggacggaaataccatcagtgattatgacaaggaggagatgaagcggcatttctccatcaatacttcggttgttccgattatctgggaagataccaagatcaacatactggatacaccggggtattttgattttgtgggtgagaccgaggaggcggtaagtgcggctgacgcggcgatcatcgtggtttccggcaaggcgggaatcgaggtcggcacgcgcaaggcgtgggaattatgtgagcagtataagcttccgcgcatggtttttgtgacggatatggatatcgatgaggcgagctaccgtcaggtggtacaggatctgcaggaactttacgggaaaaagatcgcaccgttccatctgccgatccgtgagaacggacagttcgtcggctacgtcaatgtgctgcagcagcgggcgaagcgctggaaggagaacggagaggttgagaagacggacgttccggattattcaaaggagaatcttggcatctgcagagaggctctgatggaggcggttgcagagacgagcgaggagttcatggaccgctattttggcggtgaggaattctccgaggatgagatccgacaggcactgcgtgtgaatgtggcggagggaagcatcgttccggtgctcatgggttccaatattttggcacgcggcatctacacgctgctggtggacattgtgaaatatctgccaagcccggaaaagcgcacctgcaccggcatcaatgccaagaccaatgaggtttacaatgcggattacgatttcgcaaaggcaaaatccgcctatatctggaaaacaatcgcagatccttttattggaaaatattctctgattaaagtcaattccggcgtattaaagacggacgacatcttattcaaccagcataaggatgtggaggaaaaagtaggaaagctctacgtgatgcggggcaacaagccggaggaggtaaaggagctgcacgcgggcgacattggtgccctggcaaagctttccggtgcgacgacgaccgattctctctccacaaagacgaatccgattctgtatattagaacaaccatctccacaccctatacctgcaagcgctacaaggcgaagaacaagggtgatgaggataagatctcgcaggcattgcagaagctgatgctggaggatctgacattaaaagctgtcaatgacagcgagaacggacagacgcttttatacggcatgggcgatcagcatctggaggttgcggcgagcaagctcttcgagcgctacaaagttgagatcgaattaaaacgtccgaaagtggcgttccgcgagaccatccgcaaaaaagtcgatgtggagtataaatacaaaaagcagtccggcggacatggacagtatggtcatgtaaagatgacctttgaaccttccggagctctggaacagccgtatgtatttgaacagtgtgtcgtaggcggcgcggtgccgaagaattacttcccggcagtcgaaaagggcgtgcaggaagcggtattaaaaggacctatggcagcgtatccggttgtcggagtgaaggcagttctctacgacggcagcttccatccggtagattcctccgagatggcattcaaggtagcggcgatgcaggcgtttaaaaaaggatttatggatgcatccccgatcctgttggagccgattgcctccctcaaagtggttgtgccggataagtacaccggcgatatcatgggagacttaaacaagagacgcggccgcgtgctcggcatgaatccgacggagcacggttatcaggagatcatcgcggacgttccggtgatggaactttacgggtacaacacagacctgcgttccatgacaggcggaagcggaacattttcttatgaatttgcacggtatgagcaggcaccttccgatgtacaggagaaggagatcgaggcaagggcatccaaggtagaacgtgcggaagagtaacagcagtatgtaaaagcagcagaaaagagtaataggcagaaaagaaaggaggatgagcagagatgagaaaagaatttcttgcactggtatcgatgtttgtcctccttttgaatgatccgatggtggcacaggcttatatgatggtcccgacggatgacgccggatgggagcagagtgggacagcttggattgatccattcctcggtgtgaacgatgacgctgtacatctggtgtacgagttaaacggcggggtgaatcacaatgccaatccggatgtgattacagcggaagaacttccgtttgcgcttgagattcctgtccgggacggttataattttgctggctggtatacggacagctcctacgatcacaagatcacggagatcacggaagaaaatgcagcgaatatggttctgtttgcaaaatggaccaggccgatcgacaaccgctacaacgtcgagatgtattcctatcagaccgcgagcgtgttaagccgcaatcaaaaagaattaaaagagtgcaattatgcgtttctggatgagctggacattccgggaatgccgtccaccagagagaaagactatctcgacaatctgatcagcagcgagggacagtgtctgcagggactctgcttcacaccggattatattcttatgacggcgtatgcggatggatctgacacgaaaggctccttaatgatctttgagcgtgagaccggaacctatctggcgacgcttggcatgaaggagaagagccacctcggcggaattgcctttgacggggagaatgtatggatctgccattccaattcaaagacgctggagcggattccatatgaatatattgagagaatcggagccgatgcacccggatactgtgtggacgcatctgcactttccgacgaatacaagctcgacaatattccgtcctgcatcacctgctacggcgggcgaatctgggtggcaacccacaccaaattctttgattccgagatgctttcctacagctacgatgaggaaaaggatacgcttacctcactcagcagctacaatattccgaacaaagtgcagggaattgcctttgacaaaggcggtcaggtatatctgagcacatcttttggacgcaacagttcctcctacctgaaagtatacgcatcgcttctgacgctgacgaagcatcccaatgagccgtcggcaaaggtagagatgccgccatgctcggaggagatcgcaattgcggatgataatgtgtatgtgttatttgaatctgcaagcctgcgttattttgagggaaccgacggcaagggcaacagcagctcgccgattgacaaggtgctggaagtgacggtggcgtcgatctggtaaaaaaacagaacagaacagagtaaaaggagcggttttaagagccgctccttctgtttttcatcaggttcatgattttgtcagctttggcagattcttctgcggacatgttctgctttaggatctggaataagagatccgtctccggttcactgaactggatgttatttgattttgcggaattcatggcagagagcagaaacggcatcatctctttaatgtcggtcggctttttggctgtggcaaagttcatgagaaactgtagcttctccggagacatatcggcgagaagcggattgttgttcaaaaaatcgtagggcataggaattcctttctgtttaactgaagatggtttcgtaggtctcaagcatggagaacatattcgcaagcatgtcgatggtttcctgctctttgctggtgcagaaagcgcgcagatcgtttaacatggcaaccatattattgctgccctcatcgacggagcacatggacatcaccttgtcttcctgtgagaacacctggacggtgttttgcagctccatatattttatcaatatggcaaattgctttttttgtgtatctttcatgtaggggagcatggtttttaacatctgcagttcccgtgtctgtgtcatataatcaaacggtgtaaaagtggatgtttcgttatgatccataagaaccctttttcttttagtttatgagcagagaagagactttatgaccggtaacgcatatcatataatgtgggcaaaggcaaaaggaagcatggaataaaagaggcaggacttttgccggagcgcaatcatatacgcgtctgtggaatggagattggtatgcttataatagaaggtaacagtgtatacgagattgatgaggaatgtgtgcgaaaaagaaaagtccctgaaaaatgccagacggcacagaaattgcagatgcagagaaaacgcgaagcagaaagcggtgtgacaggaaagagcgaacgctagaataacaaaaatgaggggcggcatttgccgctcctcatttggaatctgtgtgcgtttttattagcagcagccgaatccgttgccgttgccgtttccgcatccgccgcagcagaagagaagcaggataatccaaaggcagctgtcatttccacagccattgccggaattaagaccgcagccgttgccaccgcagcagcacagcaataagatgatccagagaatggaaccgcatccgccctcgttacaggaacatccaccaccacagtttgtcgcagctaaatcactcatattaaatcctccaaatttttcttacactgtatcttatggcatccggaaagatttgttacaaatttttctaaaacaattgttatgcgttctctaatttgctatgatgaacgtagcaaaacagagccagatggcgggagggatgaacatgggatttgttgtaattgcggaaccggatgaagtaaatgcggcgcgcattaagacgatattagacagtctggacaaggatttttcctatgcacttgtcggttcagcggaagcagcgatacagcttgtggagcagaataccaccgatgtgtttatcgcggatatgcagatgccggtgattaagggaacagaactgttttccatgattgagatgatgtctccggagacaatacggatcgtgatgactgacggcgcacggattgcagatactgtggcatttatgaatgaatgccgtacctttaagattatcatcaagccgtgccgtgtggcagatgacctcatggctccgatccgtgcagcctttcggtataaggaacagctggagcgggctgccggacaggagcaggaacaggagactgcgtacagcatgacggagcaggcgtatctggagcaccgcaggatgtggctgatgcgggcaagcaacaataagagagcgcaggacgtgctggcggagctgatgaaggtgaacctttctttttcagatatggaagcagaacgaaaggaacgcctcggacgctggtatgtctggattgtatccgaatacatcaactgcgtttcgtgcgggactggcgagtttaagaccgcagccgaggggcttgcggcattcggcaataaaccggaacagcaggaatattttgaattgaggtgcactgccgatgaggtggtcgacccggaacggatgaacgaggtcacttatattctgcggattattaccggactgtgtaaggatatcttaaacggctatcggatcatggcaatcctggagccgatggaaaaggtctatgtgcttcgtgtgcgcatacagatgtataaagattcattcagaattaaaaatacaacaatgcgggagggattgtcacgcgcaacggaacttgcgatcgacgcgctcggatacaaatctgtcgtcatgaacaaggagcaggagacgatttttaatctggcattacggcgctgaatgtcataatgtctgccattactataacaaaacattatatctgctataactttttattcattgacaaatagaacaagaaatgtatagtataagaagacggtataattgtatacaattatgcaagcggttatttatgcaatgatcaagaaagattatacgacggagagaagccgtgaaggaaccgccgcattggatgatggcaaaaggagtgcagctatgagagaagtcgtaatgaataagaaaacgaacctgctacagttggaagagcatttttatcagctcgtggatgtggaagagccgaacgtattccacaatctgttcccgtacagtgagataccgaagatcgcattcaatgatcgtattgtcccgcacaacatgccggagaatatctggattaccgacacgacgtttcgggacggtcagcagtcgagagctccttatacaacggagcagattgtaacgatctatgactatctgcataagctgggcggtccgaaaggactggtccgtcagagtgaatttttcctgtatagcaagaaggacagggatgcggtctacaagtgcctggaaagagggtacaagttcccggaggttacgagctggatccgtgcaagcaaacaggatttccagctggtgaaggacatcggactcagagagaccggtattctggtaagctgctcggattatcatattttttataagatgaagatgaccagacgggaggtcatgaatctgtatttgagcgtgatccgcgagtgcctcgagacaggaatcagcccgcgctgccacctggaggacattacgaggtcggatatttacgggtttgtcattccgttctgtgtggagctgatgaagctgatggatgagtacaagatcccgatcaagatccgcgcgtgcgatactatgggatacggcgtgaatttcccgggtgccgtgattccgcggagcgtgccaggtattatttacggactgaccacccatgccggcgttccgtcggagttgattgagtggcatggccacaatgatttttacaaggcggtcaataactccacaaccgcatggctttacggcgcaagcggcgttaactgctccctgttcggtatcggagagcgcaccggaaatacaccgcttgaggcgatggtctttgagtatgcgcagttaaagggaacacttgacggtatggatacaacggtcattacagaactggcagaatactttgaaaaagaactcggctatgtacagccgagccgcacaccgtttgtcggaagcaacttcaatgtgacgagagcgggaattcacgcggacggactgctcaagaacgaggagatttacaacatttttgatacggggaaattcttaaacagaccgcctcttgtatcggtgtccaacacatcgggtcttgccggaattgcacactggatcaattcgtactatcatctgccgaaggagaaatgggtcgataagaattcggatctggttaagaaaataaaagtctgggtggatgcacagtatgaggacggacgtgtgacggtacttacggattccgagcttgtggaagagatcggaaagtgctgcaaagagctgaacatcacgatatagcatgaggtaaatagatgagtgaggataattattcgctgagttcgcgcgtgtttcacacaatacgtgaaaatatactgtccgggaaatatgcgacggacgaggaattaaaagaaaaatccatcggagaggaactgggtgtcagccggactccggtcagggaggcactgcgccagctggaactggagggtcttgtgaccatcattccgaacaagggagcatatgtcgtcggaatctcccagaaggatatccgcgatatttatgagatccgctccaggctggagggactctgcgcgaggtgggcgtgcgataacatcacaaaggatcagctggatgagctggaggagaacatttatctgtccgatttccactcgtccaagggaaattccgagcaggtggtggagcttgacaacaagttccatgaaattttatacgatgcgtcaggcagcaaggagctgcgccacatcctgcgggattttcaccattacgtgcagcgcgtgcgcaaggtgacgctcgccgtgcaggagagagcggtcaattcaaacgaggagcaccgcaagattgtggaggcgctaaagcagcatgacggggccagggcggaagaactggcggacgcacatatgcgcaacaccattaacaatatggatcattacggctgggacaatctgctcaagcagtaagagcggaagatgccatgtcagatagaacagaatcacagcacagaaaggaagcagccatggaaaaaatcaaaatgacaacgccacttgtagagatggacggagatgagatgacacggattctctggaaaatgatcaaagacgaactgttgtatccgtttatcgatcttaagacggagtattatgatctcggactggaacaccgcaacgagacggacgatcaggttaccgtagattctgcaaatgcaacgaaaaagtacggggttgctgtaaaatgtgcgacgattacgccgaatgccgcccgtatgacggagtatcatctcaaggagatgtggaagagcccgaacggaacgatccgcgccatgctggacggaacggtgttccgtgcaccgattatcgtcaaggggatcgagccgtgcgtgaagaactggaaaaagccgatcacgatcgcgagacatgcatacggcgacgtctataaggcgagcgagatgaagattccgggaccgggcaaatgcgaactggtctacacggcggaggacggaaccgagacaagagagctgatccacaattttaccggtgcgggcgtggtgcagggacagcacaatctctgcaattccatcgagagctttgcgagaagctgctttaactatgcacttgacacaaagcaggatctgtggtttgccaccaaggataccatctccaaaaaatacgaccacaccttcaaggatattttccaggagatttatgacagcgagtatgcgcagaagttcaaagatgccggaatcacatatttctacacactgattgatgacgcggtggcgcgtgtgatgaagtcggagggcggctatatctgggcgtgcaagaactatgacggcgatgtgatgagcgatatggtatccagcgcgttcggttcgctggcaatgatgacctccgtgcttgtcacaccggacggaaagtacgagtacgaggcggcgcacggaaccgtacagcgccattactataagcatctgaagggggaggagacctccacgaattccgttgcaaccatttttgcatggacgggcgcactcagaaagcgcggagaactggacggcagtcacgagctggaagagtttgccgacaagctggaaaaagcttgtgttaagaccatcgaggatggtaaaatgacaaaagaccttgcgctgattacaaccatccctaatccggttgtattaaacagtgaagattttatcaaggcaattcgcagcacgttagaaggaatgttattgttatgattttatcctgtcagaatatttccaagtcattcgggacagacgaaattttaaaaaatgtaagctttcatatcgaagcaaatgaaaaagcagcgattgtcggcatcaatggtgccggcaagtctacgctgcttaaaattattatgcagaaagagacgccggataccggcgaggtgatccttgcaaaagacgccaccatcggctatctggcgcagtatcaggatgtgtccggacaccggaccatctacgaggaggttcttgacgcaaagcagaacatcatcgagatggaggagcgcctccgtggaatggagacgcagatgaatacgcttacagggcaggaactggagacgcttctggacggttatcaccggttaagccatgagtttgaactgctgggcggctacacctaccgtagtgaagtgactggaatcttaaagggactcggcttttcggagagcgaatttgaccggcagatgagcgagctttccggaggtcagaagacgcgcgtgtcgctggggaagcttcttgtgacaaagccggacgtcctgcttttggacgagccgaccaaccatctggatatggaatcgatccggtggctggagggatttctgatgaactataagggagcggttgtgatcgtatcgcatgaccgctattttctggaccgcgtcgtcaccaaagtggtggagattttccagcatcaggggtatgtctaccagggaaattacacggaatttgcgaagaaaaaggcgaagatccgggaagatctgttaaagcagtattacaaccagcagcgggagattaagcaccaggaagaggtcatcacaaagctcaagtcttttaaccgcgagaaatcgattaagcgggcggagagccgtgaaaagatgctggataagatcgagcgtctcgaaaagccgacggatgagaacacggacatccatattgtgctcgagccggatgtgacaagcggtaatgatgttcttacggtggagcatttaaggaaagcgttcggcacacatacgctgtttgacgatctctcttttgagattaagcgtggggagcgcgtggcgctgatcggcaataacggaaccggcaagacgacgattcttaagatcatcaacgaactgcttctggcggacggcggaaccatcgtgctcgggtcgaatgtgcacatcgggtactacgatcaggaacatcagctgctccatatggagaaaacgatctttgaggagattgcggatgactatccgcagttaaaccacacgaagatccgcaatgtcctggcggcgtttttatttacgaacgatgatgtattcaagcggattgcagacttaagcggtggggagcgcgggcgcgtctcccttgccaaactgatgctttccgatgcgaattttctgattctggatgagccgaccaaccatctggacatcacatccaaagagattttggagtcggcgttaaaccagtacaccggaaccgtctttttcgtgtcgcacgaccgttattttatcaatcagaccgcaacccggattctggatttgacgggagggacgattgtcaactatatcgggaattacgattactatctggaaaaacatgacgagctgacccggatctatgtggaggcggagccgaaggcgcaggcggcgcagatgacggaacagaccgtggcgcaggacggaagtggaacggacaagaaagcggactggcaggcgcagaaagccgagcaggcgcgcatccgcaagcttgagaatacgctaaagaaggcggaagagcgcattgccgagctggaggatctgatcgccggcattgatgaggagtgcgcagatcctgccaatgcaaccaattccgcgaagctcggcgagctgaccggcagacagaatgaataccggagcgagctggaaaaatgctacgaggaatgggagcaggtatcgatggagcttgagtcgtgagggatgccgtctggttgttaaatttttgacacattgacagatatctggtttatcactataataaaagagatgttttgatagaaaggtgggcatcaccatgcaggaaaaagaaatatcacaggctgtcattcgtcgaatgccgcggtattacagatatctgggagaattgctggacgccggggtagaacgtatttcttcaaatgatctgagcctcaggatgaatgtcaccgcatcccagattcgtcaggatctcaataattttgggggatttggccagcagggatatggatataacgtaaaatacctatatgaggaaatcggcaagattctaggactgaaccagcagcacaatattatcgtgatcggtgccggaaatctcgggcaggcactcgccaattacgtgaagtttgaaaagcttggatttatgatcatcggactgttcgatgtcaatccggcgttggacggtgtgactgtgcgcgggatcaagatccgtatgctggatgagctggaagatttctgtagagagaacaaagtagacattgcagcgcttaccatgccgaaggaaaaagcggacgccattgccaaccgtctggtcggtcttggcattcatgcgatctggaattttgcacatgtggatctggaattgatcaataaggacgttgttgtggaaaatgtccatctctcggacagcctgatgcagttatcctacaatattgtgaagaatcagcgcgccaaagagaacagccgtcagacagattaaaagaggtcctgcatagcaggatctcttttttactctatagggaactttgttccagtgttttaccgaaataaaatgccgggtgtgatgccggcaggcgggagggaaaagatgcgatatatcgtaaacagccgggagatgaatctttatgacagccggacaatcgaggaatttcatatgccgcaggcagtgttgatggagcgggcggcgttttcctttgtggagacactgcgccgggaaaaacggaatacgtcaagaacactcgtcgtctgcggcagcggcaacaacggcggagacggctatgcgatcgctagaatactcatgcaggcgggaaacaccgtcgatgtattggaagcgccgcacacaggaaaagcgtccgtcggcaatcagctccagaagaagatctttcttgcgtacggcggtaagatcctcacggaatttccggaggggaagtcctacacgctcgtgatcgacgcggtattcggcgtgggattatcgcgcagtgtggagggagaatacgcatcgttaatcgaccggatgaatgccatggaaggggcgaaggcggcggttgacattgcttccggcatttcggcggacaatggaaatgtgctgggaaccgctttccgggcagatctgacggtcacattcgcgtttgaaaaggtgggatgcctgctgtggccgggcaatcagtacgccgggaaagtcgttgtggcggatatcggaattacgccggatgcattcggggagcgcaaaccggcagtggcagcgttagaagacgcagatctgtcccttcttgtcgcaagggagagccactccaacaagggaacattcggcagacttctcgtgattgccggaagccagggaatgtccggagcggcatatctttgcgcgaaagccgcatatgcaagcggctgcgggctggtgcgcatttttacaccggaggaaaaccgcgccattttgcagacgcagcttccggaggcggtaatcacggcatattcctccaaaaaggcggaggcgccgctgctttcggaggcaatgagctgggcggacacgatcgtgtgcggaccggggatcggcacgccggatacggctgcggggatggttcgcacagtgatcaagaatgcggcggttccggtgcttttggatgcggacgcgctgaatgtgattgcaaaagatacaaacctgctgcttctgccgcacacggaactcgtggtgacgccgcaccttggagagatgagccggctgacgggggattcggtggcgtatctgcagaatcatctgattgaggcggcggatgaattcgcaagacagtataatgtgatctgcgtcttgaaggacgaacacacggctaccgcgattccgtacagccagacatggctgaatgtatccggcaatgccgggcttgcaacggcgggaagcggggatgtcttaagcggtatcatcggcggactgatggcgcagggaatccgtgtggagcaggcggcgccgctcggcgtctacctgcacggaaaggcgggcgaagcggcaggtgcgcggcgctccatgcgcggcatgacggcatcggacattcatgacggaatgtgcgagatcctggccggactggaacagacgcagtcacagccgggaaaagatggcatatcatagtgttgggaaaataaaaacaaaatggaatacacccgtgaaaaatggcaatactatccgtaaaagatccagagagaaatggagtggaaagtatggtaattcgacgtggggatatcttttatgcagacttgcgaccggtggtcggctcggaacagggcggtgtgcggccggtgctcatcatacagaacgatgttggaaacagacacagtccgacggtcatctgcgcggcaatcacatcgcagatgaataaagcaaagcttccaacacatgtggagcttgacagccagaaatatgcgctggtcaaggattccgtggtgctgttggaacaactgcggacgatcgataagacgagactgaaagataaagtgtgccatctggatcaccagatccttgtgaaaatagacaaggcgctggagatcagtctggaactctatacataacttgactattatgcgcgaaaatgttatgatttctgatgttttagtgtgtaataccggagacacgaaagaaaggatactatatggatgatggttgcagccccactgtgggcatcctcatttttgcaggatttgtcatattagattttgtggtttttggctttatcgccgccatgcagaatttgaatgaggctgccatagaacgtctggcgggagaggaagaccgcggtgcgagacttctgcggcgctatacggataagaatgaacgatatacgcatgtctgcgaactggtggttttaatcgtgcatatgctgctcggttttctggaggtaccgctctggcgcgcgtattttctgccggaagatgcgggaagcgtcatgtcggtacttgtggatgtcctcatttttgtgatcctgattctcattgtgctggtgtttggaatctacacgccgcagaaagtggcgtccagaaagccggaagcctgggcactgcgtctggcgggaccggtacatgtggtggagcttcttttttacccgatcatattcctgacggacggtttagccaaccttctggcgcgcgtgttcggcgttgatccgttaagcgatacggatgatgtgacggaggaagagattatctccatggtaaacgagggtcacgagcagggtgtgctccttgcaagcgaggcggagatgattcataacatctttgagtttggcgacaaggaagccaaggatatcatgacgcaccgcaagaatatctgtgcgctcgacggaaccagaacgtttcgacaggccctggagttcatcaaggagaacaactattccagattcccggtgtttctggacgacatcgataacattatcggtgtcctacatatcaaggaggctctggaactgagcctggatgcggcggtttatgacacgccggtctctaagatcaagggtctgatccgcgaggtggacttcatccccgagacgcgcaacatcaattccctgtttgccatgatgcaggcagccaaaagtcatctggtgatcgtggtggatgagtacggacagacggcaggcattgttgcgatggaagacattctggaagagattgttggaaacatcgaggacgagcacgacgaggagacgaacatggtcgaactgcagccggatggaagctatctgatgagcggtatggctccgtttgacgaggttgtggaagtgctgggaattccgctggatgaagaggacgatttcgagacgttaaacggttttttgatctcactgatcgataagattcccagcgacgacgaggtgttttcaacaaccgcatacgggtatctgtttgagatcctttctgtagagaacaagatgatccagaaggtacacgtgatcaaacttccggaggagaaggcttcggaagtcgaactggcagacgggacttgccagaatgaagaataaatgttaaaataataaaccggatttcaacagaaaagaggaaaaaacatgtcaggacattcaaaatttgccaacattaagcacaagaaagaaaaaaatgatgcggcaaagggaaagatttttaccattatcggaagagagattgctgttgcagtaaaagagggcggtcctgaccctgccaacaacttcaagctggcacaggtcatcgccaaggcaagatccaacaatatgccgaacgatacgatcgagcgcggtatcaagaaggctgctggagacggcaactcggtcaattacgaattctgtacttatgaaggctacggtccgagcggaaccgccatcatcgtaaagtgcctgacggacaataagaaccgtacggctgcgaatgtgcgcaacgcgtttacaaagggacacggcagtatcggtacacagggctgtgtatcttatatgttcgatgagaagggacagattattgtcgcaaaggaagattacgagggagatgcggatgagctgatgatgcaggctcttgacgcaggagctgaggatttttccgaggaggaagacagctacgagatccttacagcgccggacgattttgaggatgtccgcagagcgttggaggatgcaggtattccgatggcagaagcttctgtgaccatgcttccgcagaactatgtggagctaacagcggaggaggatctgaccaacatcaaccgtattctggatcttctggatgcagatgatgatgtgcaggaagtatttcacaactgggatgaataataaatttacaaagagagggcagaccataacagatggtttgtcctttttttgtaaaacgctggaattgtagggtgaaatggtatatcataatattgtatatgctttctgcgaaaaacaggatgtttccgatacaaggaggtttttatgaaaaaaatactttttgcagcttctgagtgcgttccgtttatcaagaccgggggacttgcggacgtctgcggcgcgcttcccaaggaatttgacaaggaagagtgggatgtgcgggtggttattccgaattatagctgtattccggaaaaataccgcagccagtttgagtatgtgacgcatttttatatgagcgccgggacttatatccaggacaagtacgtcggggttcttcagtatgtgcttgatggcatcacctactattttatcgataatcaggaatactttaactgcatcgtgccttatggggacatccggtttgacattgagaagttctgtttttttgacaaggcggtactctccattttaaaacagatcaatttccggccggatctgattcactgtcacgactgggagacgggactgattccggtttatctgaaaaatgagttccaggcggactccttttactggggcatcaagtcggtcatcacgatccacaacttaaagttccagggaatctgggacatgaagacaatgcagggactgaccggtttctcggcggatctgtttacgccggataagctggagttccagaaggacgccaacatgttaaagggtggactggtgtatgcggattacatcacgaccgtcagcgattcctatgcgaatgagattcagacggagtattacggggaagggttaaacggtctgctctcggcaagacattacgacatgcagggaattgtaaacggaatcgactatacggtttacaatccgaagacggatccaaagatctatgtcaattacgacgccgcagatttccgcaagaaaaagccgtccaataagatgaagctgcaggaggaactgggacttgccgtcgacaagaaaaaatacatgatcggcctgatctcaagactgacggaccagaagggactcgatctcatcaattacgcgatcgaccgcattgtggacgactatacgcagttcgtggtcatcggaaccggtgatccgcagtacgagaatatgttccgccactatgcatggaagtacggcgaccgtgtctcggcgaatatctgctactcggacgaacttgcccacaagctgtacgcggctgcggacgcgttcttaatgccgtcgcggtttgaaccgtgtggactgacgcagttaatctctttccgttacggcacggtgccgatcgtgcgtgagacgggcggactccgggataccgtaaagccgtacaatgagtacgagaacaccggagacggattctcgtttgcaaactataacggagacgagatgttaggcgtgatcaactactccaaacatatctattttgaccgcaagaagcagtggaaccagatgattgaccgcggaatggcaaacgactattcctggaacaattccaagggacgctatgagggattgtaccgctatcttctgggagaagtgtagcgtgaactgacataatatgacgctggatgatacatactaagcagggtgcaattttgcaccctgcatttttatgcaattagtaaaaagagaagaccgaaggagaaggagaaactatgtcagaaaaacaggaacagaaaaatgaggatatccgggaattcggacaggttgcgttaaataacaaccgggagaacaaccggatctcacttttaacgattataggagagattgagggacacgattgtctgccggcgacgactaagacaaccaagtacgaacacgtgcttccgaagctggcggagatggaggacaaccgggatacggaaggaatcctgctgctcttaaatacagtcggcggcgacgttgagagcggactcgccattgcagagatgattgcgtcgatcagcaaaccgacggtatcgctcgtgctcggaggaagccattcgatcggcgtgccgctcgctgtctccacggattactcgtttattgtcccgtcgggcaccatggtgattcatcccgtgcgcatgagcggaactgtcataggagccaagccgacctacgattattttaaacagatgcagaaccggattttaacctttatcgcgtcgcattcaaaggcgggggaagagcgtctggaggaactgatgatgaacacgggaatgctgacaaaagaccttggaaccattttagtcggggaggaagcggttcgggaagggctgatcgatgccgtgggcggaatcgatgccgcgtttttaaaactgcatgcgatgattgatgccgcaaagggaaaaaattattaagaaaccttttaatgacaaccgccctcaaatatgttaaaattggtcatgtatgtataagtttgacagatttttacgaatcggataaggaggctgccatgtcattattacaggcgatcttgatgggcattatacagggactgaccgagtttttgccggtgagcagttccgggcatctggcactttttaaaatactgtttgatgtcaataccgacacgggaattttatatgatgtactgcttcacgtcggtacattgattgcaatctccctggtatactaccgggacatcttaaaactggtggtagatggatgctgcatcatccgcgacgccggatacaatgtgattgtcttcttccggaataagaccggcaaagagcagatggcgtatcggcgcgtgatcaacagcagctaccgcaaatttgccatgctgattatcgtatcgacaataccgactggaattatcggctatttctgcaaggatgtcgtggagatggcttccgagattctgattgttccaggcatctgccttatcgcaacggcagtgctgcttttgatcgcggatcactgcaaggacggcgacaaacttccgaagaacgtcacctacacggatgcgttttctgtcggaatcgcacagggaatcgcaacgcttccgggactttcacgctccggtacgacgattaccgcctgcttgcttgcgggttatcagcgcaattttgccgtgaaatactcgtttttgatgtcgataccggcgattcttggcgcgcttgttctcgaattaaaggatgccacagacctggcggtgtcgggaacggaggttgtctactatgtgatcggtatggcggtcgcggcggttgtgggatatgtctgcattaagacgatgcttgtcatcgtccgcaaaaagaagttcaccgtttttgccatctactgtctgctcgttggcgcattgtccatcggcgggtatttttatctggcataacggttttggaggttagtaagttttggcaacagggaataaaaagagtacatctgggaaacgaaaggcacagacaagccggaagggaagtacaggacggaagaaaaagacggctgcacagcagcaggaggattttaccagggaggtcattctctggatcattgtagcggtatctattttattatttatcagtaatttcggaatcgggggaaccatcggcaatgcagtgagcaggttcttttttggcgtcatgggactgatcgcgtatgtgttcccggtgcttcttcttgtcggtactttttttgccgtgtcgaacaggggcaaccgggtggcaaccgtaaagcttgtggcgatgattctgtttgatctgttcttatgtatgctgatcgaactgctgaccaaagggtctgcggttgacggtgccgctgcggcatacagctacagttttgagcaccggacgggaggcggcttcatcggcggacttctggcatggattttctgcccgaatttcggtctggctggttcttatgtgatcgatgcgatcatgttaatcatatcgctggtgttaattacagagcgctctgcgcttcgcggaatgcaaaaaggcgggaaaaaggtctacgaatccgcgcgtagcggaaatgaacgccataaggaacgcgtgagaatccagcgggaagagcgggagcagcgcagagaggaacaggcattaaggcggatggatcgcaaggtggaaggggttgccattgacacccgggtgctgccgcggcagaatgtcattgaacattccgatgagatcagtgaactgaatgcggaggattatctggagatgccggaggtacgggaagaaaagattgtgcctctcacgtcggacggcggatatccgcctgcagagaatctgacgccgtcggcgttctcagacgaagcgcttgcggctgtgacaccggaggcttcacagaacatatctgcatggactccggaaacggagactgcacagggagcatcctggaatactgcgccggcggaagcatcgtgggatgtggcaacagagccggaagatccatggagcactacagcctcgcaggaacagaaagatccgtggagcagcgcagccgaaccggaagatccgtggagcactgcatctgcgcaggaacagaaagaatcatggggcagtgcggccggaccagaaaacgcatgggaggcggctgcgccgaaagtacagctgaaagagccgcaggaagcatcggcagccgtatcgcccgcagagacaaaggctgtgtccggcatcggggaaaatgccggacataccacatctgcacctgcggcatccggtgaaagtgtgtcggcggagcagatgcctccggagcgtccgtatgtgttccctccggcagatcttctgacaaaggcggcaaacaaagccggggattccagacagcatctgcaggagacggcgatgaagctgcagcagaccttaaagaatttcggcgtgaatgtcacgattaccaacatcagctgcggtcctgccgtgacgcgctatgaactgcagccggagatgggagtaaaggtcagcaagattgtcaatctggccgacgacatcaagctgaatctggcagcggcggatattcgtatcgaggcaccgatccccggaaaggcggcgatcggtattgaggttccgaacaaagaaaacgtcatggtttcttttagagaactggtagagtcggaagaatttaaaaagcatccgtcaaagatttctttcggcgtcggaaaggacatcggcggaaaggtgacggtggcggacattgccaagatgccgcatcttctgattgccggtgcgacgggttccggtaagtccgtatgtatcaacacgattatcatgagcatcctctacaaggcgaaccccaaagaggtcaagctgattatgattgatccgaaggttgtggaactgagtgtctataacggcatcccgcacctgatgataccggtggtcaccgatccgaaaaaagcggcgggtgcactgcactgggcggtggatgagatgacagaccgttatcagaagttcgccaatgcctcggtgagagacttaaagggctacaatgcgaagatcgaatccctgccgacgatcgagggcgatccgaagccggaaaagttgccgcagattgtgattatcgtggacgagctggcggatcttatgatggtatcgccgggcgaagtcgaggaatccatctgccgtctggcacagctcgcaagagcgtgcggcattcatttgatcattgcgacacagcgtccgtcggtcaatgtcattaccggtctgatcaaggcgaatatgccgagccgtatcgcctttgccgtgacttcgggcgtggattcgagaaccattctggatatgaacggcgccgagaagctcctcggcaagggagacatgctgttcagcccgcagggaattccaaagccggtgcgtgtgcagggcgcatttgtatcggatgaggaagtatctgccgttgtagggtttatcaaggaacagaatggtcaggtgacctacagtgcggagatggaggagaagctgagcaacatggaatccgccaacaccaccgtagcgatcgattccagcgcggatgcaggggacggcagggacgtttattttgcagatgcggcgcgccttctcatggagaaggaaaaaggttccatcggcatgcttcagcggtattttaaaatcggttttaaccgtgcagcccgcattatggatcaactggaggaagcgggtatcgtaggtcctgaggaaggcacaaagccgcggcgggttttaatgtcgcccgagcagtttgagcagtacgaagaggaatatctgtaacaggattcatataaaacatacaaagccgctctggcggcggaatggaggagacattatgaaaagtgatattgaaattgcacaggaagcccagatggtacatattcgcgaggtggctgcaaagcttgacatcccggaggatgatctggaattgtacggaaagtacaaggcaaagctttcggacgagctgatccgtcgggtttccgacagaaaagacgggaaactgattcttgtgaccgcaatcaatccaacgccggcgggagagggaaagaccaccacgagcgtcggcctcggcgaggcattcggcagacttgggaaaagggcggtcatcgcgttaagagagccgtcccttggaccgtgttttggaatcaagggaggtgcagccggcggcggatacgcgcaggttgtgccgatggaggatctgaatctgcactttaccggtgatttccatgcaattacctccgccaacaatctcctggcggctcttctggacaaccatatccagcagggcaatgagcttggaattgatccgcggcagatcgtctggaaacgctgcatggatatgaacgaccgtgtcctccgtaacattgtcgtcggtctgggaagcaagatggacggaatggtaagagaagatcactttgtcatcacggttgcgtcggagattatggctattctttgtctggctgacgatatgcatgacttaaagcgccggctcggacggattatcgtcgcatatacgtttgacggaaagccggtgaccgcggacgatctgaaagcgaccggcgcgatggcggcactgttaaaggacgcgctaaagccgaacctgatccagacgttagagcacacgcctgccattgttcacggaggtccgttcgccaatattgcgcacggatgcaacagtgtccgtgctacaaagacagccttaaagctcgcggattatgtgattacggaggccggctttggcgcagatctcggcgctgaaaaattcttcgatatcaagtgccggaaagcaggactggcaccggatgccgttgtgctggttgcaactgtgcgtgcactcaaatacaacggcggcgtggcgaaagcggatcttggcacagagaatctggacgcgttgaagaaaggaattgtcaacctggagaagcatattgagaacctgcagaagttcggtgtgccggttgtggttaccttgaactcctttgtcacagacacaaaagcggagacggattacgtggagcagttctgcagagaacgcggatgtgagtttgcactttccgaggtctgggaaaagggcggtgaaggcggcattgagcttgccaacaaggtgctgcttacactggagcagaaggaaagccatttcaagccattatatccggatgatatgagccttgaggataagatcgcaactgttgcgagagagatttacggagccgacggagtgacctattccgcagctgccaaaaaggaactgaagagaattaccgatatgggaatgtcatccttcccggtctgcatggcaaagacacagtattctctttcggatgaccagacgaagcttggaagaccgaacggttttaccatcaatgtgcgcgaggtttacgtatcggcaggagccggctttgtcgttgcagttaccggttcgatcatgacgatgccgggactttccaagaacccggcggcgtacggtattgatgtcaatgatgacggagtcattaccggattattctaagagacagaatggaggatacgtatgacacagatcattgacggaaaaaagatttcacaggagatcaaggacgaactgcgcgagcaggttgcggaacagaaaaagcttggaaaagaagcagcgcttgcagtgatccaggtaggaaccgatccggcttccagcgtgtatgtcaataacaaaaagaaagcctgcgcctatatcggcatcggttccctgtcctatgaactgccggaggagacgacggaggaagaacttcttgcgcttgtggagaagctgaatggtgatgcttcggtaaacggaattctggtgcagcttccgcttccggcacagattgacgcagacaaagtgattcgtgcgatcgcacccgaaaaggatgtggacggattccacccggaaaacgttggaaagcttgtgatcggggagccgggatttgtctcctgcacaccggcgggaatcatccagctcttaaagcgctccggaattaagatggaaggaaaacattgtgtgataatcggcagaagcaatatcgtggggaagccgatggcacttttaatgctacgcgagaatgccacggtcaccattgcacattccaagacacagaatctgccggaactttgcaaaacggcggatatcctgatcgttgcaatcggaaagccgcagtttatcacggcagattacatcaaagaaggggcggttgtcatcgatgtgggaattcaccgcgatgagaacaacaagctgtgcggggatgtcagatatgatgaggttgcgccgcatacgtcggcgatcacaccggttccgggcggagtagggcctatgaccattgcaatgctgatgcataattgtgtggagtccatgttgcagtaacagatgtagaatccatatggatgaaagagtgagaggaatcgtttcatatgaaatgtgcaaagtgtggggcagagatcaaagagggatgtatctactgctccgtgtgtggaaatgcggtacagattgtgccggattacagtgtgttggaggatgactatctgcgttctcttctaaaagaggaggaatctgccgggaaggaaccggcgccggcacaggcaaagcagcaaaagcccaaacagccgcagaggaagaaaaatcgccggctgccatttctcatcgggggaattctgctggtgcttctcgttctggcgggaattctgattaaggctgcaattgatcaccggaatgccaattcttacgactatcagatggaacaggcggccatggcggctgatgcgcagaatgacggggaggcacttgactattacgagcgtgcgctgtatctgtatccaaacgatattatcgcgcgtgagaagatgattgaaatctatgaaaaacagaaaaataccgatgcggcaatggtgctcctgattgagatcataaagcttgatcctgccaatgaggacgcatacagagatctgatcgctatctatgatgcgagggaagattacgacagcattctggatctggaagcggaggtcgatgccgaggatcttaagaataaggataagattctggatttgtttgcggattacatgacatctgcaccgctgattacggatcctgagggagatgtgccgtccggaaagtatgatgaggcgctcgaggtagagattgcgtcgacagacggggatgccatctactatacgatcaatggagatgagaacgaactggatgccaagaccggaacgaggtattttgtcggaaacccgctcgtctttgatgagagtggcaaatataccatcgcggcggtctgccggaacgataagggaatctacagttccgtgacgtatgccgattttgagatcgaacttgcaccaccggattttgcagaggtgtcgccggacggaggccgtttttatgagccgacactcgtgacgctgaccgcagaggatggatgcagcatttactatacctgggacggaaccgatcctaccacggcgtctgcgcgctacacggagccgtttgaggtgccggagggcaacaatgtcctgtccgtacttgtggtggacaaaaagacgggattggacagcggtgtttaccgtgccaattttatctattacccgtaaaaaggaattgccgcaataagcataacctctttggggtgataagtaatattataagaaacatacttggagatttcatgtggaaatgcagatggaaattcgtttgagaaaaatgtgagtatttcttccagccgaatgtttgcatcggattccgtgtctcttccacgtttgaacactcccggagtgtgtccgccaaatcagagacaatgagcaaactttctagtggcggctaatgctgctgcttcacagacactataaaatcgcgcgaaccgaaactcgctgccatctgctattgaaaataaggcagatggcaactcagacatcggcttcgcgcgattatgttttattcagcagcggcaaaagcgccacacgaaagttcttaaattgtctcatgatttgcggacacagtccgtggagtgctccaaacttggaaagacatggatcatcgcagattgcaaacatccggctggttagaaatgccacattttttgaatcgaattttcatctgcatttccatctgaaatcccacggtgtggtcttttaataatattacttatcagcgcaaagtacaatacgcttattgcgacaatccccttttagaagatcactcgtcgtccgccggtaaaaattcaacgtggtccgtatccattgcaccgactctggcaagtgcatacacttcggttccctgatcaaccagcttttcacgtcctggctggaaagacttttccaccagaacgccgagaccggcgatggtcgcatgtgccagacgcagaagacggatcgctccggtcgcagcctcaccatttgcaaggaaatcatcgatgattaagacgtgatcctcctcggagatgtacttcttggagagcgtcagctcgtagttcgtctctttggtaaaggatgtgatcacagtctggtagagattatcatttaaaatctgagaaggctgcttcttcaaaattaccataggaacgcccagtgcagatgcggtcatgagtgcaggagcaattccagaactttcgatggtaaccactttcgtgatgcctctgcctttaaaatgtgcggcaaatgcctccccgatctgtgccatgagcaccggatccacctgatgattgataaaactgtctaccttaagaatgtctttgtttaatgcctttccctcggaaagaatcttttcttccagtaatttcaaaatcgtcacctctcaatagtatatttgatggttctattgtaccataagtcgctgcatgaaagaagtgctgttttggagaaatgtcccgattttagaaaagctcggcgtagagcagttcaatcatatgatcggtaaaggattccgaaagggagggatactgatgaagcagcagcttttccatcacttcgtagcgggaaaaatacagcgcctcctccggctgatcgttgtcgacggactgatcaatgacatcggcacggtaggtatccagaaaccatttgaggatctcatcctgcagtgcatcttctgttgcagtcgcatctttgagctgtttgatctgtccgaaggaacggatgccgatccacaaaaagataacgaacatgattcccatgacaagacccgtcagaattctggcggcaccggtaatatggatcggaagaacgccgcagaaaaacagcactaaaagaaccagtccgatgatgccgaccccggtaaaggtgtaggcggtagacttcatatcttcggtctgggaagccttggaccggtaggcgtgtgaatgtgcagtaagcggctgagtatctcctctgccgccttccgctgccctgacggtggaagctgccgaaagttcttccatgtcatcaggggagaaggcatccggactgtcttttgatttgtcctctgatatggagagcgactccaccagatccacgccgcagtccggacagcggacgattcccgctacatattcgtttttacattctggacaccacataataagttctcgctttcttagttttcttttcctatattataggagattttatagactgccgcaaccaaagaatgttataatgaacctgctatgaagattacaattttatgcgttggaaaaatcaaagaaaaattttacagagatgccatcgaggaatacgctaagcgcctgacgcgctattgcaagctggaaatcatcgaggtcgcagatgaaaagacgccagacggcgcaagtgccacggaagaaatgcagatccggcaaaaggagggggagcgtgtgcttgcccgcctcgagaaatgcaggcagagcagctcctatgtcatggcactcgccatagacggcagggaactcgattcggtcgaactctcacagaaactggaaaaactgggaactgacgggatcagccatgtgatctttttgatcggtgggtcactcggcatgtcaaaagagctgcttgcggcggcggattttaagctctctttttccagaatgacgtttccacaccagctgatgcgcgtgattctgctggagcagatctaccgcggctaccgcatcatgaaccgggaaccctaccacaaatagcggcaggctattcggtaaagtccctggaatacagaacggttccgtccggatttaaggcggtcagccggatggcgatgccgtttatgccggtctcatctgcaatctgcgcgcgcagcgaggaaaaagtggaggcatagctgtcaaaaatggcgtcatacagctgcgtcagtgcgtcggcgtcggcgtcatccgacatatcatacgccttagaaagcgtgtactggaacactaacgcatcggaatctgcggtgacaatgtccagggtgtatcccagatcctgggaattgacggcgtctgtcatctcctgaaactgatccgcctgtgtggcataccagtcatccagcgatgcttttttacatcccatcagagccattcccaagcaaaaaagtgcgagcacgcacagtaatattctgtgtctttgaatttgatatccggtcataacggtctccttttccctgtagaagcttaaaaatctatcatcagtatagaagtccgccgcacgacttgtcaagcgtccgcgcggcaaatgttgaatcggcggttaaacggtgttacaataaagtatactttagaaataagggggattgcagtatgagaatgtatgatttgatcttaaaaaagaagcagggcggggaactttccacggatgagatccgctatatgatagaaggttttacggagggaagcattccggattatcagatgtccgccatgacaatggcgatctgttttcgcggaatgacgccgcgcgagacggtggatttaacgcttgccatgagggacagcggtgatgtgctggatctctcggggatcaagggggtaaaggtcgataagcacagcaccggaggcgtgggagacaagacctcactggcgctgacaccgatcattgctgcgctcggggttccggttgcgaaaatgtccggcaggggactggggcataccggcggaacaatcgacaagttagaatgttttgacgggtttacgaccgcgctctccgaggagcagtttgccgggaatgtcaataccatcgggattgccattgcgggacagactgccaatctggcgccggcggacaagaaattatacgcgctgcgtgatgtgacggcaacggtggatcagatgtcgctcattgccagctccatcatgagcaaaaagctggcgtccggaagcgatgccatcgttctggatgtcaagacgggcaacggcgcttttatgaaaaagcttgaggattccagagcgctcgcaaaagagatggtctccatcggtacgatggcgggcaagaagacggtggctgtcatcacggatatggatcagccgttgggacgcgcggtcggcaattcacttgaggtccgggaagcgattgataccctgcgcggagagggaccggctgatttcaaagaagtggtgtttgcactgggcagccagatgcttatgctcgcagggcgggcggcggacgaaaaggaagcccgcgcactgatggagggcgtgatagaagacggatcggcactcgataaatttgcccagttcgtgcgcgcacagggcggagatgctgcaccggtctatgacacatcccttctgccggttgcggggaagacactagaggtcacggcaaaagagagcggatatgtgcaccggattctggcggaagacatcggaattgcctgcatgaccctgggaggcggaagagagaccaaggagagtgcgattgatctatccgttggtattattctggagaaaaagaacggggatgcggtaagtgacggtgaagtgcttgcgacgatttatggcaatgatgatgccaaaatgcaggcggcgtatgaaaaaattgcccatgcctacgagatcgccaaagagccggcggctttcgtgccggtggtcagagaatatatctttccagaataagacggtatttttcctcatatagtgctatatgagaaaaaatagcagaacttcagcggggtcacagatttcgctgcgcgaaagaattgtagataacctggagcttcccaaagacctcatgctcggggcggcgatcgtgaccgtcaccggcagaggggaagctgtgatttcaaattataaaggaatcctggaatacgaggattcctttatccgggtgcagacaaaaacctgcaggatacggattaccggtgtccgtcttgccatagattattacacgaatgaagaaatgaaaataacgggcagcattgatacgatagagtacgagaactgagacgatgctgctctctgtgatcaaatattttcgcggttatgttcatgtgaagctgacgggatatgcaccggaacggttcttaaatctgtgcgggaaccggaatatcctgatctggaatttaaaaccgtgtgaaaatggatatactttttgtatcagtgtcgatgcattccgacagctgaagcccattctgaaaaaaaccaaaacgcagatccggattcagaagcgtgtggggatgccgttttgcgcgtttcgctaccgcagacggtatcttttcccggcaggcctgctttttttctgctttttgctgtatgatctgtccggattcatctggaatatcgaaatcaacgggaattcttatctgaccacggagacgattctggatttcctggaggaagaacacgcatcgtttggaacgaaaaaatcccggatttcgtgcgaggatctggaagaagccatgcggagccgctaccgggatgtcatctggacttccatcaagatttatggtacaaagatgacggtcgatattcaggaaaacctcctgccgcaggaagaatatgaggcgaagagcgacaagccgcaggacattgtcgccgccaaagacggcgtgattaccgagatggtgacacgcacgggcacgccgcttgccgcggtgggagcggaggtaaagaaaggcgacatcttagtctcggggcgcattgaagtgttaaacgacgacggcgagatcatgcagtacctctaccgtccgtccgatgcggacatcaaggcgaaggtactctattcctaccgggatgtgattgatggcacctgggtggagatggcgccgaccgggaacacgaaggagtgctacagcatcacgctgcttgataacgtgttcgactggccgtttttccggaatccgtttgcagaataccaggtgcagacggagagcaggcagctccatgtggcggacaatttttatctgcccgtgtggctgaataaaagtgagttcacagaggtcgagcaggtgcggcacgagcgcaccgaagaggagatccgtcagattgccacaaagaatttctcggattacatcaaagatttggaagaaaaaggtattcaaattatatcaaaaaatgttattataaaaagtacgggtgaaaaatatgtggtaagcggcgatctgtgggcgcacgaatccattgtttcctatcagccgacagaggtttacgataccacaatgcaagaaaggcagaatgaaaatgagtctgactgaagtttcgttaaatataccgacagaccacatggcgaatgtgttcggtcagtttgatgtctatatcaaaaaaatcgagcgtaccttaaatgtgacggtggttgtccggggagaagatatgaaaatcctcggagacgaaagacgctgcaggcgcgcgcaggatgttttcatgcagcttctggaattgtccaaacgcggaaatgtcatcacggaacagaatgtcaactatgcactggcattgatggcggaggaaaaagagtcggcgatcgtggagatcgaccgcgactgcatctgccacacgatcaacggcaagccggtaaagcccaagacactcggtcagaaagcctatgtggatgccatccgcgaaaagatgatcgtgttcggcatgggaccggcgggtaccggtaagacttatctggcgatggcgatggcaatcaccgcgtttaaaaatgaggaggtcgggcggattatcctcaccaggcctgcgattgaggcgggggagaagcttggcttccttccgggcgatctgcagagcaaggttgatccttacttaagaccgctttacgacgcgctgtatcagattatgggggcggaaagcttccagaagaatatggaaaagggactgattgaggtggctccgcttgcctacatgcgcggacgtacgttagataacgcgtttatcattctggacgaggcgcagaacacgacgccggcgcagatgaagatgtttctgaccagaatcggtttcggttcaaaggcggtcatcaccggtgacgccacccagaaggatctggcgccggatgccgcatcgggcttggacattgcgctgaaagtgctgcgcaatgtggaggagatcggtatctgcgaactgacaagccaggatgtcgtgcggcatccggtggtgcagaagattgtcaaggcatacgaggattatgagaagcgcgccggtaagacgtccggcacgagaaagaacacgagcagaaccggtgcgggcagaaccggtgcgagaagcaggagagagaacacgaatggatgatcgctatgtggcaaagagagtaatatatctgcttggcatgtctgccgcaacgatcctgtttacgacagcggcggcatttatcaggggacagtatctcgacgagtggatcgtccttgttatcatcaatctggtatttcaggcgttgtggttctttttattggagcactgccggatgaagcggagcattgcgggaaaccgtgagacaagctaccggcgtatttttgcagggtatctggcgtcgcttggcgtgacggcggtctgtcttgtacttccggaattttcaagacctgtgatgctatctgccattttgatgctcggtgtggggaatatcgagctttccctgtgcagcggactctttttctgcagcctgctcggtcttttgtgcggtggaaccatccaggaattctccatgtatatcctgctggttctgatcggagcggtggcagtggacgcagtggaaaacagcaaaaagcagttctggtatgaatggtttgccggcatggcaggcatgcttcttccggttctgttctactatctgacctaccgggagatcagcatccggatcatggtatctgccgtggcggacggtgtggtcgtctttttgtttttgcatctgtgctaccggaagctggtggatgcaagaaatgcggaagtcgatgaggtcatggtcgacatcaccgatgaatcctatccgctggcgcgggagctggcgagtttttccagggcagactacagccatgcaaggcgggtgatgcttgtggcggcgcgatgtgctgctgtggtcggggcagacgaacgtgtgtgcagcgccgcggggatgtattaccgtatcggcgtactggagggcgcaccgcttgcaaaaaacggtgtgaaaatggcacagagagcctgcttcccggagaaggtaatccgcattatcggggaatacaacggggaagaggctctgccatccaccatcgagtcggcgattgtacatatggtggacgggctgttgaaaaaactggaggttctggatgaggataccgttggcagcaactggaaccaggatatggtgatctatcagaccttgaatgaatattctgccgcggggctgtatgaccgttccgggcttagcatgaatatgtttttgaaaatacgggaatatcttgtgaacgaggaggcattactggtatgagcctgaatttagaagtcgaagtggacgtgccatttacatttgattatgaagcgctggcgggcgaggttgtcgcttttaccatcgaccatgaaggttttccttatgaggcggaagtgaatctgacgctgacggacaatgaaggaattcatgagatcaaccggatgtaccggcagattgatgcgccgacggacgttttgtctttcccgatgctctcctatgagcaggcgggcgatttctcggcgttggaagaggattatgaggataattttaatccggataccggggagatcatgctgggagacattgtcatctcggtggaccgggtgagagagcaggctgccgcctacggacacagcgagcgcagggaatttgcgtttctgatcgtgcacagcatgcttcatctgttcgggtatgaccacatgacgccggaggacgcggcagtcatggagccgaagcagagacagattctggaggagatgaacatctcgcgtgattaacgaacggcggcgccgtggcgcttccgaaaggatttgaggtacttttatgggcaataaaaaaaggaaaaatacgacaagttttctggcgcagggcacaatcctcgcggcggcttcgctgatcagccgtgtgatcggactgatttaccgcatgccgctgacggcgattattggggataccggcaacgactattatggcagtgcctataccatctataatattttgttaattatttcgtcctacagcctgccgctcgcggtatccaaacttgtctcggcaaatatctcacagggcagaaggcgcaatgtctaccgcatcttaaagtgcgcgctgatttttgcgctggtgtccggaaccgctgccgcggcaattctctatttcggagcggattttattacgggtacgctgcttagaaccccactttgtatctttgcgttaaaggttttagtgccggttcttgtaattgttgcggtcttaggtgtgatgcgaggctttttccagggacttggcacgatgatgccgagtgccgtatcccagatcttagagcagattataaatgcgattgtcagcgtgtgggcggcgtatgtccttttttcctacggttccaaagccggagcgcttttaggcaatgccgaggattacggcgcagcctacggtgcggcgggcggaacgatcggaaccgctgccggagcgctgagtgcgctgctgtttgcgggttttgtccttgttgtctatctgcgggtgtttaaaaagacgcttcgcaaggagcgaaagacaagcgcagattcgtacggagagatttttaaactgctgatcatcaccattattccggtgctggtgagcagcacgatctacaactgcaacgccaccattgaccaggcggtctacaagaatatcgcggcatggcagggatattccaagacggactacggtacctggaacggtatctataccggaaaataccaggtgttaatcaatgtgccgctggccattgcatcctcccttgcggcatcgagtgtgccggcgctctctgctgcttatgcgagcggaaaacggggcgaggcgaaacggcagatcgggcttgccacacgctttatcatggtcgtggcattcccgtgtgcagtcggaatgggcgtgcttgcctccccgattcttcagatgctgtttggtgattcctccgagcttgcggcaagaatgctgcagaccggttccgtggccatcattttcttctccctgtcgaccctttccaacggtctgctgcaggggatgaaccggatgaaggagccgatcaagaatgcagtgattgcactggcgcttcacttgatcattctggtggcgctgatgcttgggctggatctgaacatttttgcggtgatcatcgcaaatgcatgcttcggactgatcatgtgtattctaaatgcgcgctcgatccgccgttacagcggataccgtcaggaagtgcggcgcacgtttttcgtgccggcggtttcagcggctggaatgggcgtggtggtatggcttgtttaccgtctgttcctctatctgcttcggagcaatctgatcgcaacgcttgtatcgattgttgcaggcgtctttacctacgcgacgctgcttttgatgcttaaaggactgaccgagcaggaaatcctgcgcttcccgaaaggcagaacgcttgtaaaactcgcgcggaagatgcatcttttgcgttaattgaataaaaaggaaagaactggcagatacttatcgcagagaatgggaggacattatgaaacggacgataggtatttgcctttttgcggcagtgatgctgcttgtcggaggcttgtgcgggaaaaccgcatttgatgcaggaaggatccgtacggtagaggagacggaggcggtcacggaagatgccgcagtggcacagacggagcggactgcggagagcatgcagatccagaaaacctgccgctatttgctccgcatggatgacgacggcatcttaaaagtctatgaggcggacgggataacccttttatttgagaccaacatccgtgcggaacggctttccgtgcagacgagggagcagctttccgacggaattccggtagacgatgagagagaactgtacgatctgctcgaaagctattccagctgacgtaagagaagttattcattgaatgttacagggctgtgtggtaaaattgttacggttaagaagaacggacagaatgatacagcggttagataagaggttgaaatgacagatatagatgttacggtgatcggtggcggcgcggcaggacttatggcggcggtcagtgcagccaggtgcggcgcgagaacacgggtgatcgaacacatggaccggattggaaaaaagattctatccaccggcaacggaaaatgtaattacacaaatgcagtgcaggggctttcctgttatcgtggagagaatcctgcttttgtgctgcctgtttttgagcagtttgggcaggaggataccgtgcgcctgtttgaagaacttggaatctatccgaagatcaaaaacggttactattatccggcgagtgagcaggcggtgtctgtcgtggaagtgtttggcatggaatgcgattacctcggcgttgatctgtggacgtcctgcggactgcaatccattcaaaaaacctgtaccgggtatgaaatacgcaccacaaaaggcgcgttttcaaccaaaacagtgatttttgcgcccggattgctggcagcacccaagacaggaagcgacggaagtgcatttccatatatagaagcacttggtcatcattttgtagatgtggtgccagctctcgtgcaactgcatggaaaacaggcatttttcaagaaacttgcaggaattcgtgcagaaatgcaggcaacactctacctggaaaatgcgcaatttcaaccaaaaggcagccgtgggacagcccggggagaaaatcctgacgcggtgtgcagtgagcggggcgaacttcagcttacggcttccggaatctcgggtatcccggtctttcagatcagccgttatgcgacgagagcgctcgcggacgaaaagcacccctatgtgctgattgattttgcgccggatcttacggacaaggagttttttgacctgctgtcagagcgcttctacgagaatacacatggcaagagcgccggggaggcactgatcggtctctttaacagaaagctgagcgaggtactgctctccgaagctggcatacggtcggaactctatgccggggaggtggcacgcgccacgttgcaccggctggtgaagtgtgtcaagaatttccgggttgatattaccggaagcaacggaatggaagcggcgcaggtatgcgcagggggcgttgacacggaggagattgaagccacaacgcttgcgtcaaagctggcagacggtatctattttgcgggcgaggtcattgatattgacggcacctgcggcggttacaatctgcagtgggcgtggtcgagcggctttgtggcggggatgcatgcagcagaggaaggaatgtcagaacagagatgatacggatcaatcagataaaaatgccgctgcatcacgatgcggcagcactggaacagaaaatcagaaaacgtctgggactttcgggaggacaggagcttcgctaccggattatcagaaaatccattgacgcgagaaagaaaccggaactgtcgttggtgtattccgtggaggtttccgcttccggagaagagaaaatcataaaaagggcaaacgatccgaatgttacgatcgtaaagcagaccggttattatctgccgggagcggtttcgccaacgccgtccatcccgccggtgattgtcggtgcgggtcctgcgggacttttctgcgcgtatgcgctcacgatgagcggctgtgcaccggttgtccttgagcgcgggcgttcagtgacggagcgcacaaaggatgtggagcgcttctgggagagcggagtgttggatacggtttccaatgtgcagttcggagagggcggcgcaggaactttttcggacggcaaattaaatacactggtcaaggatcccaccggcaggaaccggtttgttctggaaacctttgtaaaattcggagcgccggagcagattctgtacgaaaacaaaccgcacatcggaacggatattcttgccggagtcatcaaaaacatgcggcaggcgatggaagcgcgcggcgccaggttttgctttgagagttgtatgacagattaccgcagggaagcggacggaaagatgtttgttgaggtcaaccacaaggagtggatcgagacttccagactcgttcttgcaatcggtcacagtgcgcgggacacgtttgggatgctgtatcagaagcaggatcttgtcatggaggcaaaagcgtttgcggttggtttccgtgtggaacacccgcaggagatgatgaatctgcagcaatatggagcgctgcatgcacacgaacttccggcagccccctacaaagtgacagcgaacctcgcaaacggcagaggcgtgtattccttctgcatgtgtccgggcggatatgtggtaaacgcatcctccgaggaaggcaggcttgcggtcaatggaatgagctattccggacgtgacgggaaaaacgcaaacagtgcgattattgtggcggtaactcctgacgactttgcggggaaagatccgctagccggtgtccgttttcaggagatgctcgaggagcgggcattcgctatcggaaaagggcggattccgcagcagctttttggagactattgcagcaatcgtgcctcggtgtcttacggggcgtttgagagcgccgcaaagggcgcatgtgtgcttggcaatttaagaggtctgctgccgcaggcactggaagagtcctttatcgaggggatgcacgcattcagccgccggattccggcttttgaccgggaagacgccatcctctccggcgtggagagccggacgtcctcaccggtgcgcctggtgcgcgatccgaagcttcttgtggctgcaggcggcatctatccgtgtggggagggcgcgggctatgcaggcggcatcatgtccgcggcgatggacggactgaaagtggcagaggcgattatgagagatatggaggagcaacgtggctgaatttacaccaatgatgcagcaatatctgcagacgaaggaagaatataaagactgtatcctgttttaccggctgggagatttctacgagatgttttttgaggatgccgaactggtgtccaaagaactggaactgacgctgaccggaaaaaactgcggcatggaggagcgcgcaccgatgtgcggcatcccgtaccatgcggtggagggatacttaaataaacttgtggcaaacggacacaaggttgccatctgcgagcaggtggaagatccgaagctggcaaagggactggtcaggcgcgaggtcatccggatcgtgacgccgggaacgaacctggatatgcaggcgctggacgaatccaagaacaattatattatgtgcatcgtgtatctggcagaccgctacggcgtatccattgcggacgtctcaaccggagactactatgtcaccgaggtggattcggagcggaagcttttcgatgagatcacaaaattttcgccatctgaaattatatgcaacgaaagtttttatatgagtggtgtcgatatagaagatttaaggcatcgactcaagattacaatttatgcgctggagacatggtattttggggatgagcttgcagagacaacactgcttacacactttaaggtaaagagtctggaggcgctgggacttgccgattatgactgcggcatgattgctgcgggagcactgttaaagtatctgtacgagacacagaagaacgatctcaacaacatttccgtgattcatccgtattccaccggaaaatacatgatcatcgacagctcgaccagaaggaatctggagcttgtggaaacgctgcgcgagaagcagaaacgcggatcgctcctgtgggtgcttgacaagacgaagacggcgatgggtgccagactgctccgctcctatgtggaacagccgctgattgacaaggctgagatcgagaagcgccaggatgcaatctgtgagctgaatcagcacgtgattaccagagaggaactccgggaatacttaaatccgatctacgatctggagcgtctgattacgcgtgttacatatctgaccgccaatcccagggatctcattgccttccgcagttcgattgccatgctgccgccgatcaagagccttttaggtgatttccatggtgaactgctgggagaaatccgtgaggacatggatacgttggaggagctctgcgcactgatcgaccgggctatcatggaggaaccgcccatttcggtgcgggacggcggtctgatcaaagacggctacaacgaggatgtcgataaataccgcaaggcgaagacggaggggaagacctggctggcggaactggaagccaaagagcgtgaaaagacaggcatcaagaatttaaaaatcaaatataacaaggtattcggctattatctggaagtgaccaactcctacaaggatctggttccggattattttatgcgcaagcagacgctcgccaacgccgagcgctatatcacgccggaattaaaagaactggaggacatgattctcggcgcggaggacaagcttgtcacattagagtacgatctcttctgtgaggtgcggagtaagatcgctgcggaggttgtgcgcatccagcggaccgccaaggcggttgccggtctggatgtattcgtgtcgcttgcacttgtcgcggatcagaataactactgccgtccgaaaatcaacgagaacggcatcattgacatcaagggcggacgtcatccggtggtcgagaagatgatcaacaacgatatgttcattgacaatgacacgtacctcgacaacggcaaccatcgcatctcaattatcacgggaccgaacatggcgggaaaatccacctatatgcgccagacggcgctgatcgttctgatggcgcagcttggcagctatgtgcctgcggcatccgcgaagatcggtatcgtggaccgcattttcacacgtgtgggagcgtcggatgatcttgccagcgggcagagtacgtttatggtggagatgaatgaggttgcaaatattctgcgcaacgccacctccaactcgctgctgatcttggatgaaatcgggcgcggcacaagcacctacgacgggctgagcatcgcctgggcggtggtggagcatatcagcaacccgaagctcctcggtgccaagacgctttttgccacacattatcatgaactgacagagctggaaggcaaattaaacaacgtcaacaattactgcgtggcggtaaaggaaaagggcgatgacattgtatttctccgcaaaatcgtaaagggcggcgcggacaagagttacggtatccaggtggcaaaacttgccggcgtgccggattccgtcattgcgcgtgccaaggagatcgtggaggaattaagtgccaacgacatcacggaagttgcgagaaatatctccgtcgatacgggaagcaaaaagaaaaaagaaaagctggacgaggtggatctgacgcagatgtcgttgtttgataccgtgcgggacgatgacatcatagaggaactgcggaatgtggatgtcggaaatctgacgccgattgaggctttaaacaaattatacgaacttcagaacaaggtaaagaaccgctggtaaccggaagcgcctttggcaaaggcagatgggaggaatggaatgccgcagataacactgctttcacaggaaacaatcgataaaatagcagccggggaggtggtggaacggccgtcctcggtggtcaaggagcttgtcgagaacgcgatcgatgcccgggcaaccgccgtcacggtcgagatcaaggagggcggcacaacgttcgtgcgcattacggataacggctgcggaattgagcgtgagcaggtaccgctcgcgtttctgcgccattccaccagcaagatcaagagtgtggaagaccttttatgcatccattcgctcgggttccgcggtgaggcgctctcaagcattgctgccgtatcgcaggtggagctgattaccaagacttacagcgatctgaccggaacgcgctatgtcattgaaggctcaagggagatgagcaacgatgagatcggcgcgccggacggcacgaccttcatcgtcagaaacctcttttacaatacgccggcacggaaaaagtttttaaaaaccgcgcagacggagggaaattatatcagtgacctgatggagcgccttgccttgtcccatccggatgtctcttttaagtttatcagcaacggacagaccaagatgcatacctccggcaactccaatgaaaaagatctgatctatcatatctacgggcgcgatattacggcggcgcttcttccggtctgcgcagagacagaatatttctcggtaaagggctttgtcggaaaaccgatgatttcccgcggaaaccgcagctacgaaagctattttatcaatggacgctacatcaaaagcgcactgctctccaaagcggtggaagaggcgtacaagggctttatgatgcagcatcagtatccgttctgcgtgctgtattttaccatggatacggagcttttggacgtcaatgtgcacccgaccaagatggagcttcgtttttccaacaatgaggaagtgtaccggaagctatatcagacgatccgcgatgtgctgactcacaaggaatttattccggctgtcccggtggaggaaaagaaagaagaaaagcgtccggtcattacagggagcctgccggagccatttgagacaaaacgtctgcatatcccgccgcagacacaggtgctgccgcaggggcagaacgtgacgccggaacctgtcagaacaccggaaaatctggacgtgttccggcagcttctggtgcgggaagagagcagctatcatacggattccgcatttgcgggttctgcttcgaccgaagatggcagccggatgcaggagatgccacgggaagcggaaagcataccggcggcggataccgtacagccggatgtgcggccggagccgattcctaaggcagaggtcgtgcagggaactcctgatacaccggagaatctgaatacgccggagaatctgaatatgccggagacagacacacagaacgtgcaggagacgcagaatccgcaggagacagcggacacggtcgtgtacgagcagcagacgctcgaggcggcggacaccggatttttcacgccggatgcagccagacggcaccggatcatcggcgaggtgtttgacacctactggctgattgaatacgaggataagctgttcattatcgaccagcatgccgcccatgaaaaagtgctctatgagcgcaccatggtgcgcgtccgcacgcagaattttgcctcgcagaccttaagcccgccgatcattctgacgttgagcgccgaggaacaggagatgcttacacgctacggggagcagatccgtctgttcggttatgaggtggagccgttcggcggcaaggaatttgccatcacggcgattccagccgattttgaggcggtcgatatgaaaagtatgttcctggacatgctggacgattttaccaacataagcggcagggaagcgccggaactgatcctggagaaggtggcttcgatgtcctgcaaggcagcgatcaagggcggcgactccatcagcagggcggaggcagaacagctgatcgacgagctgctgtccctggagaatccctaccattgtccgcatgggcggccgaccattatctctatgagcaaatatgagattgagaagaagtttaagaggattgtatgacaatgaaaccaaatcccatggtaattctgaccggcccgacggcagtcgggaagacagcactttccattgcactggcaaaaagaataaacggagctattatatctgcagattccatgcaggtatataaatacatggatatcggctcggcaaaaatcatgccggaggagatggacggtgtccggcactatcttgtggacgaactggatccatccgatgagttccatgtcgtccgttttgtggagatggcaaagcaggcgttaaaagagattacggcaaacggtcagatccccattgtggtgggcgggaccggattctatatccaggcgctgctctacgatattgattttacggagcaggagtgtgacagtgcataccgcaggcagctggaagagctggcagagacacgcgggaatcattatcttcacgaaatgctaaaggcggtagatccggcatctgcagaggcgattcacgagaataaccgcaagcgcgtcatccgcgccctggaattttaccatgagtccggcgagcggatctccgagcataacgagcgggagagccagaagacatccccctacaattttgcctattttgtcttaaatgacgaccgcgaaaagctttaccgccgcatcgatgcgcgcgttgatgccatggtaaaggctgggcttgtcgatgaggtggcaaggctgcagcagatgggctgccatgcggatatggtgtccatgcagggacttggctataaagagatactggcgtatttaaacggcaccagcaccctggaggaagcgatctatatcattaagcgcgaatcgagacattttgccaagcggcagctgacctggttccgcagggagcgggatgtcatctggctgaacaagccggattttgagtatgacgatacaaaaatacttacatacatgatggatgtgttacaggcgaaagaaattttgccggcataaaagagaggtacagagatatgaatcagttattacaggaacaatacgagcgtctgggaatttccccggaggtaagtgcattcggggaaaaaatagaagcttccttgaagcagcgttttgaagagattgatgcacgcgcagaatacaaccagctaaaagtgttaaaagccatgcaggacaaccgtgtctcggcagaatgtttcaatacgacttccgggtacggctacaacgatctgggcagagacaccctggaaaaagtctatgcctcctgcttcggcggggaggatgcgctggtgcgtccgcagatcacgtgcggcacccacgcgctggctctggctctgatgtccaatctgcggccgggcgatgaactgttatccccggtcggcaagccatacgatacgctggaggaggtcatcggcatccggccgtccaagggatcgctcgccgagtacggcattacctaccgtcaggtggatctgcttgcggacggagagtttgactatgaaggcatccgcgccgccatcaacgagcgcacgcatcttgtcaccatccagcgttctaagggatatgcgccgcgcaagacgctctctgtggagcgcatcggaaaactgatcgcattcatcaaggacatcaaaccggacgtgatctgcatggtcgacaactgctacggcgaattcgtggaagagcgtgagccgattgaggtcggggcagacatgattgtcggttccctcatcaagaatccgggcggcggacttgcaccgatcggcggctatattgtcggcaaaaaagaatgtgtggaaaatgcggcataccgtctgacttccccgggactcggcaaggaggttggcgcttccctcggcattctgcagtcgttctaccagggactgttcctggcaccgaccgtggtgagcggcgcgttaaagggcgctatttttgcggcaaatatttatgaaaagctgggatttgacgttgtgccggacggcagtgagagccgtcacgacatcatccaggcgatttccttccacaatccggacgcactgatcgccttctgcgagggaattcaggctgcggcgcctgtggacagctacgtgacgccggaaccgtgggcgatgccgggctacgacagcgatgtcatcatggcggcaggtgcatttgtgcagggttcctccatcgaactgtctgccgacggaccaatcaaaccgccgtatgccgtgtattttcagggcggtctgacctggtaccatgcgaaactcggcattttgaaatctttacaaaaacttaaggaacgaaaacttgtgaatctggatgcgttatgctaaaatatgatgtaagtttttgtcccgtaattggttgacataaattctacaaaccatcatagggaattgccggggagagacgggaaatctttatgaatcatcattttacaacggttaaggaactgccggactcggagaagccatatgagaagtttttaatatccggggtcgaatccttaagcgatgcggagctgattgccgtcatcatacgttcagggacgcgcgggacgcgttctgtggaagtggcgcaggaattgctgcggcaggacggacacgatctgttgaatctctacacgttatctgttcaggatatgcagaagattcccggaatcggacaggtgaaggcgatccagttaaaatgcattgcagaattatccaaacggatggcgaagacgcgctataaagagcgcatctgtcttggcgatccgggctccattgcaagttattacatggaggatatgcggcatgagagcagagagcgtacgatggtgcttctctttgacgccaaatgccgcctgctggagaaggttatgatgtctgtcggtagtgcgacggctgcacttgtctcaccgcgcgagatttttctcgctgcattggacaaaagtgcgattcagattgtgctgatgcacaatcatcccagcggtgatccctccccttcggcggaggacgatgcagtgacaaagagagtggcggaatgcggagcgcttcttggcatccctcttgtggatcacattattatcggtgaccgcacgtactacagctacagagaatgcaaaagaatacaataaagggagagaacaatgacgaataacgtgtatggtattgaccttggtacctgcaatatgaagatttattgtaaggcgtccaacaagattatgaacgagaagaacaccatcgctctggtgaataagaatgagatgtatgcctacggtgatgacgcttatgcaatgtatgagaaggcgccggaaacgattcaggtgacattcccggttgtgggaggcgtgattgcggattttaataatcttcaggtaatgcttcagacttatctggaggcccacgccaagggcaagctgcgcggagcggaattcattgttgctgttccaacagatattacggacgtggagaagcgtgcatttttcgacatgttctacaagagcaaattaaagccaaagagtgtgctgttatgtgagaagccgatcgcggatgccgtcggtctcggtctaaacgtcaacgagccgaccggtattatggtggtggacatcggtgcggataccacagagatttccgtcatctcgctgggcggactggtcttaagtgatctgttacattccggcggcaacaagatcgacgaatccattatcacttatgtgaagcgcaagtacaatcttgtcatcggacagaagaccgcgcagagcatgaaggagaccctcggaagcggtatcccgggcaacacccagaccatggtggttgtcggacgcgacgtggtgagtggtctgccgattgagatggagatgtcgggagctgttgtctatgaggcgatcaaggacaacctcaacacgatctgcaattccatcaaaatgatcctggagaagacgccgcctgaacttgcaagagacattattcattccggcatctatatcacgggaggaagctcccagattcatgatctggatcagctgttccgcgatattacaggaatcgagatcaatacctgcgaggagccggaggagtgtgtggtgcgcggactcttaaagatcgtatccgatgccaagtttaagcatctggcattcagtatgaagaataagatattgttatagaggaaattatgaaacggaaacccaaaattgttttgcctgccaagtacatattgctgattctgaccgttgtctgcgtggcagccatgattaccagctttacgctcaatatctccggcggtccgctcaacgcggttgccggttatgtgtttgttcccatgcagcgcgggatcaacacggtcggcgcatggattacggagaaagccgacaatcttaaaaatttaagcgatgtcatggcggaaaacgatgcgctcaaaaagcaggtggatgagcttacctccgaattgaataccaacaatctggagcagtatgagcttgagaatctgcgcgagcttctggcactggaccagaaatacccgagctatgagaaggtggctgccaatgtcatcggcaagagcagcgggaactggttttcctatttcacgatcgacaagggaaccgacgacggaattgaagtcgacatgaatgtgatcgccggcagcggacttgtcggcattgtcacggacgtcggtccgaattatgccaaagtcacttccattatcaacgatacggcgcagatcagcggtatggtgacgacaacctccgacaacctgatcgtaaacggaagtctccagaacatgaatgagaacatggtcatcgagttttccaatttgaatgacagcgacaataaagtggcggttggcgaccctgttgtcacgtcctacatttcagataaatatcagcagggaatcttaatcggctacatcagcagtctttcgacggattccaacaaccttaccaaatccggcacgatcacgccggcagtggattttgagcatatcgaagaggttcttgtcattctggacaagaagcagtcagccggggagtaggattcatattatgagaagaaaagtaaatgtgtttattatcattgcaatctgtttcctgcttcagaccacgctgtttcaggcattgtctttcgcatcgatctcgccgaaccttctgattatcgtcgtgtcgtccttcgggtttatgcgtgggaaaaaggaaggaatgtatatcggttttgcctgtgggcttctgcttgatatcttcggcagcggaattcttggattttatgcgctgctctatatgtatatcggctacatcaacggctgtttccgcaaaatgttttacccggaagacttaaagctgcccatgcttttgattgccggcagtgatctgggatgcaatctgttgatctactttttcttgtttttgttccgcaatcgttatcattttcaatattatctgtggaacatcatgttgccggaacttgtctacaccatgctgattacgatctttttgtatgtgattatcctgaaagtcaaccagcggcttgagatattggaaaaaaggagtgcaagtaagtttgtttgagaatataaaagaagttttccgcatgttttttaaatcgagacttgccgttgctgccgttcttatgacggtgctgttcggtgtgcttttgtggcgcgtgttctacctgcagatcgtaaagggcgagaaatatcaggacaactacaccttaaagatcgtaaaagagcggaccttgaacagtacgcgcggcaatatctacgaccgcaacggcgaactgctcgcatacaatgagctggcttattcgatcaccatcgaggacaacggcagttacagcagcaccgataagaaaaacgaatcgttaaacgccgagattgcccaggttatcactgcactggagaaaaacggcgatgcgatcaccgatgattttaagattgaccgcaccggagagggtacctacgaattcaatgtcacaggtacctcgttaaaacgtttcctggcggatgtttacggcgagagcagctacgatgatctcggcatgaacaaaaagcttggctacgacacctcccaggcgaccgtggatcaggttatggactatctccgcaacgactgttacggcatcgacgacagctacagcgacgagatggcgttcaagatcacgatcgtgcgttttgccatggcgcagaatgcctaccagaaatatatcgcaaccacgattgcgaccaacgtatccgaagaatccgtggcgtacatcagcgagcacgcacaggagctgcagggcgttgaggtgatggatgacaccatccgcaagtacaataacagcgaatattttgcctccattctcggatacaccggtaaaatttcttccgaggaatacgccaaattatccgagacggatgacagttataccaccaacgatgtcgtcggcaagggcggcattgagcagtatatggattcctacttaaagggtgaaaaaggctacgaaaagctgtatgtcgactatctcggaaaagccatcgaggtgattgaccgcaaggagtccaaggccgggaataacctgtacctgtcattggacagtgatctgcagattgcggtatacaatcttttggagcaggagattgcgggaatcgtatattccaatattgataatccttcttccgatattccgatcccgatcacagatgtctactttgcgttaatcaataacaacgtcatcgatctctcacactttgacagtaccgacgcatcgacggcggagcagtcggtatccgccattttttccgcacggcaggatgtggtaaaaagccagttgagagagcagcttaccggcagcacgccgacggattttaaggatctcagcgaggaggagcaggattatttcacttatattatccggagactccgcaaaaataatattcttgccgacagcaacatcgatacttccgatgaggtctaccagcagtggcagcagggggagtgcagtccgaaagattatctgaatcacgccattgcccagaactggattgacattacccagtttacggtggatgaaaaatactcggattccacggaaatatatgatgccctgtgtaattatattctggaagagcttttctatgaaaaagatttttccaagatcatttatgaatatctgattaccggcgggcagatttccgggacacagctctgtctgattctattcgaccagggcgtgcttccgtacaacgaggaagagattgcagcgttaaacaacggctctgtgacagcggtatcgttcttaaaggaaaagatacagaatctggagatcacaccagcccagctggcattggatccgtgctcgggatcgtgtgtggtcacgaataccaagacaggagaggtgttagcgcttgtcacctacccgggatatgacagcaaccgtctggcaaacaacgtcgacaccgaatactttaacagtctgcaggatgacaaatcactcccgcagtacaattacgcgacccagcaggagaccgcaccgggatctaccttcaagatggtaacctccacggcaggtctggcggagggcagcatcacaatcggggagcgcatccgtgatctcggcgtctatgagaacgtaagcaaccatccaaaatgctggattttttcatccaacggcggaacccacggggagatcaatgtctccgaagcgcttcgtgattcctgtaactactatttctacgaggtaggataccggcttgccacgaacaattattccacggcatataacgattcgctcggcattgaaaagcttcagaaatacgcgagcctcttcggtttaaacgaacgcaccggaatcgagatcgaggaagcggcgccgcagatcgccaatgaattcccggtcatggccgctatcggacagagtaataacaactacaccacggtacagcttgccagatatgtgacagccgtcgccaatgagggaaccgtctaccagtatacactgttgaaccgcctggaggattccgacggaaatgtgttacagacatttgagccgcaggtgcgcaatcagatcgacgtgcttgatacggaagagtggaatgccatccattccggtatgcgcatggtggtggagaatacaaaagagtttgacggttttccgatcgaggcagccggaaaaaccggtacggcacagcagaatttaaagcggccgaaccacgcattatttgtgggatatgcgccttacgacgatccggaaatctcgatcgcgacgcgtatcgcatacggttatacctctcacaatgcggcgaaactcgcccggaatgtatttgcctactactttaatgtcgagaatgaagatgaactgttaaacggtcaggctgcaaacggcaattcttcatccaacgagatcagtgattaagagagaaaggcgcagacaatgagtcaggcagtcattatcaaaagcagtaaaaacggaatcaatctggtgctggatgcatcgatgccgtttccggaactgctcacagaaattcttcacaaatttacggaggcggagcgctttttcgcgaacgcatcgtttgccatctcttttgagggcagagaattaagcgatgaagaaaaataccaggtcgtagacgccatcatggaacagaccagagtcaaaatcctgtgtattttagacagtgatgagatccgtgatgcggtgatcgaacagaaatgccgcgagatgcagcagacaaacgaagagaaagaggcgagaagacagagccgcggctgcttttaccgtggctcccttctgccgggagagcgccttgagaccgaggagagcatcgtcatcatcggtgatgtcccgcagggagcggtggtggtatcccaatcggatatcgtggtgctcggcgaactctcgggaagcgcctttgccggaatgagcggcaataccaatgccacgatcacggcgctttctttcctgcccgagcagtataacattgccggcgtttacggcagtccgatggaaaaagcaaaaaattccatcttttccaagcgtaataagaccacacaggcgaaaatggctttcctctgtgacggtattattaatataaggtctttctcgtaaagactataaaaacaggaggtcttccatgggtgaagtaattacgtttacctcaggaaaaggcggcgttggcaagacgactacaacagctaacgtcggtgcgggactttcactgttagataaaaaggtggtattggtagacaccgatatcggcttaaggaacctcgatgtagtcatgggactggaaaaccggatcctctataatctggtcgatgtcctgaccgggagatgccgcgttaagcaggcgctgatccgggacaagcggtatccgaatctctggatcataccgtcttcgtgctccggtgactccaaaaacaatctgaatgaaaaacaaatgaaaaatctgctgtcggacctgcgaaaagaatttgattacgttctgattgacagtccggcgggaattgacggcggttttaagctggcgacggcggattccgaccgcattattgtggtcacaacgccgcagattgcggcgattcacgatgcggactgtgtaatccagcttctgcaccggaaaaaggtgccccggatcgatctgctggtcaacggttaccgcagacagatggtgcgtgacggcaacatgctcgatattccggatatctgtgagcttctggaagcggagcttctgggtgttgttctggaagacgaggagattatcatcagccagaaccacggggaaccggtgatcgggaagcatacggtttccgacacctgttaccagaatattgcacgccggattgccggcatggaagtcgcaataccggattatcttcatcacaaagggatgttctccagattcttctggcggaatcatgccggaaagctggtgtaggatgtgtcatagaagcaagggtgttgcaaaagagcggctgaagctgatgatcgacagccgcaggaaacagctggatgacgagaccctggcgcagatccgccacgaaattggcgaaatcgttaccagatatgtcgatattgaacccgaaaacgttgaaattaaaatcatacttaaggattacatatgttcaaacaatacaaactaaagaattacaagttcatattgattgcactggtggtgatcttaaataccatcggtgtggcgctggtaggaagtgcaagcccgggcgaccagaaaaagcagatcatcggtatggtatccgggatcatcattatgcttctggtatcctatattgattataattttatactgcgtttttcctggctgatctatctgggagccatcggtcttctggggcttgtcattgtggcaggagagcagagcaagggtgcgcagcgctggtttaagatcggcggatttcagttccagccgtccgagctggtcaagattctgatgatcctttttctggcttactattttatgcggtacgaggaaaaaataaattccccgcgggtgctgttcggatcttttgtgctgatcggcattccgcttgcccttattctggcacagcccaatctttccacgaccatcgttctggcgctcgtttttgcggcgatgctgtttgccgcggggctcagttataagatcgtggtgggcgtgctggccgtgtgcgttccgaccttttttatcgtattgacgttaatcattcaggataagtttccgtttatacacagctatcagctcggacgtattatgggatggctttatccggataaatatccggatattgcctaccagcagcagaactctatcatggcgatcggttccggccttttgtggggaaaaggactcggcaataccgatcctacctccgtaaaaaacggcaagtttatactagagccgcagaacgactttattttcgccgtagcgggggaagaaatgggctttgtgggaacggtcaccattataattctcttgcttttcattacgattgagtgtatatttattgctagaaaagcaaaagatgcggcgggcagactgatctgctgcggcatggcggcattgattggatttcagagtatcgtcaatatctgtgtagcgacgggattactgccgaataccggtgttacgctcccgtttgtcagctatgggcttacgtcgctatggtcattatatatcggtatagggcttgttcttaatgtaggtctgcagccgaaaaaatattaacaggggggacttaaattatgaacatcggattgattgcacatgactcaaagaaaaaactcatgcagaatttctgcattgcttatcgtggaattttatgtaaaaacgaactttatgcaacaggaacgacagggagactgatcgaggaggtcaccaacttaaacgtccacaaatatctggctggacatttaggcggcgtacagcagctcggagcacagatcgaacacaatgagatcgaccttgtgatctttctgcgcgatcccctgactccgaagtcccatgagccggatgtcaatacggttgtgcgcatctgtgatacccacaatattccgcttgcaaccaatctggcaacggccgagttgttaatcaaatcactggacagaggagacttagagtggcgtgaaatgtataaataaatggatctgtctgtcccttctgattgccgtttcctgcgtcagcggatgcggtaagacgtcagctgccatcgaacagccctatgacgtgtatgcaaccgcagcggatttcgggttgtcctcgaatggcaccgcagaggcaaagtcttattttgcgagtgatctctgcgtttcggaagatgtggcgatcggaacggattccacggattcccaggtggcagagggcgcaggcacgtttaatcttgagacaaataccgtagtgtatgccaagaatctgtatgagcggctctatcccgccagcaccacaaagattctgacggcgtacattgccttaaaatattgtgatgatctggacgctatggtgacggtcagcgagaacgccgtcaatcaggcatccgactcttccgtctgcaatttaaaagccggcgacgtgatccggcttcgggatttactatacggtctgatgctgcgcagcgggaacgacgccgcagttgccattgcggaatacatatcgggagatgtcgattcgtttgcggctctgatgaatcaggaggcggcagcaatgggggcgacaaggtcccattttgtcaatccgaacggccttccggatgagaaccattacacctgtgtctatgatatgtatctgattttttccaatgcgatcaaaaacgatacctttgtatccatcatcggcacaacctcctacgatgttacctataccgacgcttccggcgaggcagtgacccatacgtgggagaacaccaatcagtatctgaccgggaatgcaaccacaccggacggatttcagattgtgggcggtaagaccggaaccacgggcgaggcgggctactgtctgatactgtattcgtataatccatccggtcagccgatcatatcgatcgtattcaaagcggacggtaagtccaatctctatcttttaatgaacgaaatgctgcagggattcgccatttagacggtggatccctgattgtatatatttatttgaaaattggttgtattttatgtgcatatagactataatcaatttataaaatcaactgcttttatacatattaacggattttgtgtagaaagcagcatcagcaggaggaaatgactatgatagagattatttcaggcgaaaagggaaaagggaagacaaaagagcttttgaccaaggtaaatgctgcggttgcctctgcatccggaagcattgtataccttgataagagtcagaagcatatgtacgaactcagcaacaagattcgtctcatcaatgttaccgattatccgatcgataattgtgatgagttcctcggatttatctgtggtattgtttcacaggatcatgatctggaagaaatgtatctggacagctttcttacgatcgcttccgtagagacggatgacgagatctgtcatgcaattcagaaactggatatcatcagtgaaaaatacaacgtaaaatttgttttaagcgtctccaggaacgaggcatctcttccggattgcgccaaagcaaaaattgtcatttccttataaaatgtaaaatgccgtaagaaaagtgctgtagcgatacagcactttttctttgccggcagggacttcttatgcctgatcgacagagcggatgcgcccgaacaggctgatcagatagagaccgccgagtccgacaagcgcatagatgatccgggagaaccatgacatattgccaaaaataaaggcaacgaggtcaaaacggaaaaatccgatcagtccccagttaatggctccgataatcaccagcgtaagcagtgtataatccaaccaatttgtattcattttctatgcctcctttttctatcatagtatggacatgctgcgccggttttattctgctttgccggacttgttgttcactccgggaacaaatcccgaatttattgccgctaaaaagttgttttccggggctgaaaatggtagaataaaaatgttgaatttgaaaaaaggtggggcattttttgagtaaaaataaaaaagtggttcgctatcgcaagccgtttaatgtcaatatcggaatgatcatttttattattatttttatctatctgatatttaacattttctcctacatgacgacggagcatatttccacgtatgaagtagagcagggcacgatggcagaaaataatatataccgcggactgattctccgccaggagcaggtctattcctcggatacggcgggagcgctgaatgtatatgtaaaggaagcttcccgggtgggttacggaaatctgatctgctccgttgatgaaggaggcagtgtgtccaagaaaatcgatgaagcagccggcaacgcttccaatctgagtgcgcatgatctctcggagattgaggattccataagcgaatttcagacttcctacagcgcccagaatttttataacgtttccacgtttaaggaagatcttgactctgcactgaatgaatccttgagccttgccgcgctggacggaatctctgattacgccgcggcggcgcaggcagaaaatacatttcacacctatcatgccgatcagcccggcattgtcgtctattccaccgacgggtatgagggcgttaccacggatacgtttcagtcgtccatgtttgacgaggcatcctacgaccgcacggacggtcagcgggcactgcaggttgcggcaggagcccctttatataagctgattacaagtgaatactggtcgcttgtcattccaatcggctccgatctggcaaagcggctggcggacgatgataccttgcagctgcgttttatgaaggataacaccacgacctatgcgacctataccatcacggaaaaggaaggttccgcctatctgattctgacgcttcgctcggggatggtgcgctatgccaaggatcgctatgccgaggtagagctgctgcttagtgaggagaccggacttaagatccccaattccgccatcacggagaaggaattctataccgttcccaaggatttcttcatgaaaggcggcgattccggcagtctgggcattctggtgcagaggagcgattcctccgggaaagcaggggcggagttcattgctccgaccatctactatgagacggataccgcttattacatcgacggtgaggaggttggcgcttcggatatcatccgaaaggcggattctacggagacgtaccagatcggttccggcacggcgagcctgcagggcgtttataatatcaataagggatatgccatcttcaaacagatcgacattctctatcagaatgaggaatacgccatcgtgcggaccgggacaacctacggaattgcgctctatgaccatatagcactcgacggaagtaagattcacgaaaatgatctgatcaattaaacggaggaaatagatatgttaaaggaaaatttaaaaacagtggaagaacatgtacaggaggcttgtaagcgtgcaggacgttcccgcgaggaagtgacgttgatcgctgtcagcaaaacaaaacctttggaaatgctgcaggaaatctacggggagggcgtccgcgatttcggagaaaataaagtgcaggaactgtgcgataaaatggagcagctcccgtccgacatccgctggcacatgatcggccatctgcagcgcaacaaggtcaaatatattgtcggaaaggttgccctgattcattcggttgatacataccggctggcagaagagatcaatatccaggcaaagaaacgcggcatcatcgtgccgattctggtggaagttaatatcgccggcgaggagaccaaattcggcacaacggcagaagatgccatgttgcttgtggaagagatttccaaactggaaaatgtgcggatcaggggacttatgacgattgcgccgttcgttgaaaatccggaggataaccgcctttattttcggaaaataaagcaattatctgttgacataacaaataaaaacatagataatgtatctatggaaattctgtctatgggtatgacaggagattacgaggttgccattgaagaaggagcgacgatggtgcgtgtcggaaccggaattttcggtgcacgcaattacaaaaaaagcaatgaatcgcattaggagtataacatgagtgttttagataaatttttaaatgtcatgcgtcttaatccggacgatgacgacgatttttacaatgaagattatgattacgatgatgattatgaagaggatgaaccggtaaaaccgaagagttctttccgcaaggacaagaagaaggcggaggaggatgattatgaagaagatcattctatccacgagaaagccgtcaagagttctccgaaggtcacaccgattcgcccggtcaagaagcagggaggaagcggcatggaagtatgtgtcatcaaaccaacctcagtggaagatgccagagagattacagagacgcttctcaataaccgcacggtcgtattgaacgttgagggactggacgtcgagatcgcacagcggattatcgattttacatcgggttcctgctttgcaatcagcggtaatcttcagaagatctccaactatatctttatcattacaccggcatcggttgacatttccggcgatttcttaagtctggtagacacgttccagtcgacacgcagtgtccagaccgatttttagagtctatgaacgaacaggatctttgtcagaagcgtctgcttgatctctccagacaggcggatcgcaagggaatcgttctattcagcgatttcctcaatttaaatgaattgaatatataccaccagtccgagaagctgtttgcgacgaggaccgaatgttttggcggtattccatgtgcagagcgtcagatgattgcctttcttcctgatgctctttattatgattgggaatatcccatttccgccttaaaaatcaccccggcttatcccaaatttgccgagaagcttggacatcgggacatcctcggatcgctgatgcagcttggcattgaccgctgcaaattaggcgatattctggtaggggagcaggaagcctatctgctgtgtgaggagaccgttgcggactattttgcggagcatcttgaaaagatacgccacaccctcgtgaaagtcgagccgtgcagcctgtgtgatcttaaggtcacacaggaattccagtcacaggacgggatcgtaacctcagaccggattgacgccgtcatcgcgtgcgtttatcatctgtcccgcagtcaggcatcgcttttgctgcgccaggagaaggtttttgtcagcggaaagctgatgcagaatccatcctatacctgccatgcggatgatattatttctgtccgcggttacggacgctttatctaccgcggggaatacgggacgaccggaaagggacggctcaaaatacattacgacctctatgcaaactgaaaggagtttttcatggcaaaatcgattccggtaaaagcaaacgacagtatcatttatcatattgaactggttcatgatttttcaatgttccctgcgtttctgcaggaacttggctacgggcgcagtcagaaaatctgcattgtgaccgattccaacgttgcgcctttgtatgcgagggacgttcaggatctgttggaaaaagagtttgacacggtcattcttcatacgtttgaggcaggagagcacaataaaaatcttgagacggtaaactctttgtaccagacgctgatcgagcagcattttgaccgtcaggatctgcttgtcgctttaggcggcggcgttgtcggcgatcttaccggttttgcggcggcgacctacctgcgcggcattgattttatccagatgccgaccacgctgctttcccaggtagacagcagcatcggcgggaagaccggcgtggactttatgcagtacaaaaatatggtgggtgctttttatcagcccaaactggtctatatgaacctgtccgtcctgcaatcccttccttccaggcagatcatttccgggatgggagagattataaagcacggtcttatcaaagatgccgcttactatgaatggctgatggcacatcatgatgccattttggcactggagccggctgtcatggaagagatgatcgcacgaagctgtgagatcaagcgcgaagttgtagagcacgatccaacggagaagggagagcgcgcactgttaaactttggtcataccatcgggcacgccattgagaagttatgcggtttttccctgtaccatggggaatgtgtggggcttggaatccttgctgcggcttatctttctaaaaagcagggaaatctgaccgaggagcagcttgccggtatcaggcagtgcctgtctgcctttggatttcagacacagatcgatggaatctcaacggatgctgtgctttctgccaccaaatccgataagaaaatggtcggaaaccaggtcaaatttattctgctgcataccatcggagatgcctatatttaccgcgagttaagcgacgcgcagattctggacggcattcgttatgtatgccgggcgtaatcccggtctggcagggaaaacaacatggaaggacaatctatctatgaaagatcattcacctattttgaaacgcaatctgaccggctgtgtggctgcagtgctcctcattctgttcgatcagtttaccaaaatgcttgcggtagcccatttgaagaatcagccgtccaacgtactcatagacggcgtgtttgagctgcgctatctggagaaccgtggctccgcattcggaatgatgcagaataagctgataattctaattcccgttaccgtcgtggtgacgctgcttattctgtatctttttttcaaaaaacttcccgccacgagacactttttctggctcaatgcggttgccgtactgttttttgcgggagccatcgggaatttcatcgaccgcgtcagacagggctatgtggtagattttttctatttcagcctgatcaattttccgatctttaatgttgcggatatttatgtgacagcagcggcatttttattgatctttttatgtctgttctattacaaagaagaagattttgaacagattttcccatcgggttcttccagacaacattcttcggagaaaaaagacaatgactagagaaacatttgaagcgggaattgcatatgagggagagcggctggacaagtatctgaatctcattttcagcgagacagatgcggcgcagtcgcgctccttttttcaaaaactgatcaaagaggggcatgtgcttgtcaatgatacggcgcagaaagccaactaccggttaaaggcagatgatatgatctgcgttgagattccggatgcggtacagacgccgattcttccggaaaatattccgcttgacattctctacgaggatgacgatcttttagtcgtcaacaagccgaagggaatggtcgtccacccgtccgcaggacattataccggcacgcttgtcaatgccatcatgtatcactgcagggacagtttgtccggcatcaacggggagatccgcccgggcatcgtacaccgcatcgatatggacacaacgggttcactgattgtctgcaaaaatgatgagagccatgtctttattgcggagcagatcaaggaacattccgtgaaccggcgctaccgcggcattgtatacggtgtagtgaaagaggaggagggtaccgtcaatgcgccgatcggacgccatccaatcgagcgcaagaaaatggcaatcaatgagaaaaacggcaagcctgccatcacccattacaaggttctggaacgctttgagcggtacacatacatggagtttaaactggagaccgggcgcacccaccagatccgtgtgcacatggctagcattggtcatccgctgcttggcgacacgctgtattccagcggaagaagtccctataagctgcaggggcagacgcttcatgccatgacgatcggcttcattcatccgagaaccagagagtacatggaggttacagcgcctcttccagaatattttgaaaaaattctgaaagatttgcgataatttcaaaaaataattccgtttttcaaaaaaatgtattataatatattcatagaatgttaggaaaggcgggatcttttatgggcaacaaaatctataccattggtcgtgaatttggcagcgggggaagagaaatcggcgaaaagcttgcggaacgtcttggaattaagctctacgacaaagaattgttacagcaggcggcaaaggaaagcggtttctgcgaggagattttcgagaatcatgatgagaaaccgaccagcagctttttgtattccctggtcatggatacatattcgctgaacggctatcattcggcaccgtttctcgatatgcctttaaaccacaaagtgttcctggcgcagtttgataccatcaaaaagattgcagagcgggaatcctgcgtgattgttggaagatgcgccgattacgcattatcggacaatccggactgcatcaatatctttattcatgcggacatggacaaacgcgttaagattatcagccaacgcgccaatattacggaaagcaaagccagggatctgatccagaaacaggataagcagcgtgcaagttattataactattatacaagcaaaaaatggggcgattcccagagctatcatctgacactggactccggtaaactgggaattgacggttgtattgatatgatcttaaagttccgtgaaatcctcgatgcatccagataacatcatcggctaatatcatacaacgtgaacgaaatggtttcaaatggtttcaaagaggcggcacttatttgatttaaggtgccgcctctttatgtctgcgcaaacaaacaccggcaaaatgcaggaaaaacgcacatattccttgaaatgcgggcggcggtgtgctatagtagagatacagatatttattcgcaaaacacaagtttaacgaatagttgctggcataaaacaaccattaagctgttttacgctgtgccggatattttacgggttctgttttaacagatctcttcggaatccagcagaatggtaaacggaccgtcatttaacagagagatcttcatatccgcaccgaaaataccgcagccggtatctggaatctgttctttgcaccgtgcgacaatataatcatacatccggctcgccatttcgggcttcccggcacggacaaaggaaggacggtttcctttgcggcaatccgcatataaggtaaactgcgagatcagcaaaagacttccgacgacgtccgccaacgatagatttgtttttccgtccgcatcctcaaaaatacgaagccccaacagctttttgatcattttatcggcgattgcggtcgtatcggtatcggcaattccgatcagaaccaaaaatcctttttgaattgcgccggtgacattgccgtctaccgtgcaggatgcctcggttacgcgctgtattacaaatttcattttatcaatctcctttttgaattatttgcttcgttgatcctaaatttcatttcatgatagatcatttcatgacagataatttcattataaaatagttacgaggtgatatgcaatctatggaattaaaaaaacttttaagctatacacgccaggcggttgacgattataaactcattgaggagggcgatcatattgcggtcggtatttccggtggcaaggactctctcactctcctctacgcgcttgccggactcagacgcttttatccaaagaaattcacactcatggcaatcaccgtcgatctgggatatgactcttttgatcttactcccataaagcagctctgcgaggaacttaaggtaccgtaccacattgtaaaaacagagattgcacgtatcctgtttcacggcgacagcgtgtcggacaaagcagtcaagggatctccgtgtgcgctgtgcgccaaaatgcgcaagggagcactcaatgaggcggctctggaattaggatgcaataaggttgcctacgcacatcacatggatgatgtgattgagacggcgtttctttccatgatttttgagggaagattctatgcgtttccaccgagcacacatttagaccgcacacagcttgtggtcatacgccccttactatacgtctctgaagcggaagtaaaaggatttcggaataagatgaagcttccggtcgtcgccaatccatgtcctgcagacgggcacacacagcgtgcttacgtgaaaaatctgatccgacagatcaatctggatcatcccggagccaaaaaacagctttttcatgcagtattacatggaaatatccccggatggcagacagacgtcgctgaggaaaaggagaattcaattcgtttatgaaagaaaaagcatattatgaaaatgtgaatgtaaaaaatgaagtaaaattgcgcaagcttctggaacagcttccggatttctgcaaacagtttttcattggcattgagccaaccacttcctcgcgtaccagaatcgcgtatgcttacgatatcggctgtttttttgactatctctgcgatgtgaatcccatttgccagaactataccgtaaaggatattccgctctcgcttttagacgagctcacgcctatggatatcgaggaatatctctcctatctgaagtattacgaaaaaaacggtgtagagcacacgaacgacgagcgcggtatcaagcgaaagctggcctctctccgctccttttaccgctactatttcaaaaacgacctgataaaaaatgatccggccgtgaaagtggacatgcccaagattcacgacaaaaatattatccggctggatatcgatgaggtcgcgagactgttagacgaagtcgaatccggtgaaagtctgactccacgccagcaaaaatatcacgaccgcacaaagacaagagatctcgcccttatgacgctgctcctcggaaccggaatccgtgtctcggaatgtgtcggactcgatctggaagacgtggatatgcgcaataacggcatcaagattcaccgaaaaggcggcgcagaggttgttgtatactttggggaagaagtacgcgaagcacttctcgcttatatggttgagcgccagaaaataaccgccgaagacggcagtatcaacgccctctttctctccttgcagaaccggagaatcagcgtgcgttcggtcgaaaatctggtcaaaaaatatgcaaaactggtgaccagcttaaagcatattacaccgcacaaactgcgcagtacctacggcacctccctctatcgcgagacgggggatatctatctggtcgcggatgtactcggccataaggacgtcaacacgacgcggaagcattacgctgccatcgacgatgatcgacgacgcagcgcagccaaatatgtaaagctccgtgatgtctagtgttccccggagatgcatccatcgccttaagtcctatcagatccgtggctctggcaagactctgacaaacaaaaagctgtttataaaaaagcagctcacaaagaagctccagtcatccgaccggagcttctgctggcttaagaacttcatctaacttttcctggatacgtaccttcaccagatccgcaatctcatgcgttttgagaccgccatattcatcgtataagatcggtttcagataatgtacctgcgtggtgaccggtcccaaacaaaagctgttaaaaactttataagaatcaatcagagccaccggtacgatcggtgcctttgtctttaacgcaatcttaaaactgccggctttaaaatcacacacatggttcttattgttaaattcgtatccgccctccggaaacagaatataacgctttccctgctttacttcctcggatacctcattgatgatcgtcaatgcctgtctgacatccttcttatccagccgctttccctgaagcagatccacaaattcacgaaccagtatggtattggacttcgccttatccatcacaagagaacatggctccctgtgggtgtagataatgccgagtgcgtcgtactttccctgatgattcggatacatcatgtagccgccttctgtcggaagcagctctgtgccgtaagattttgtgtggatgccgccggttaccttcatcaggcgaatcacatggcgcgccagcgcgtagcgctcctctacactatacttttcaggatgatccgcctccctgcgcatcttcggtatcatataaggcgctctgaaaagattcattaaaatgacatagataaactttatcatacgagataactcatcctccgtaattcatattctctgtgctgccttcccgcacaatatgagctcgtcagaattcattataccgtacttacccaaaaaacacaaccgaccggagacgctgcacaaaaaataccatcttacttgagatgttctgccgaataatacgggatggtcagatactgtccggaatgaatgtcccccggcaggatgtgattgatcgcacagatctcctccatatattcgtccatgctgtcgtaatcgtctgtgatatattcatctgcgatattccagagggtatctcccttctggatctggatgcttgtgtaatatttataagaaggttctgcaggagccgcctgtgtgcggatcgttcccagcaggacagaaccgatcacaatgacggttaaaaccatcaatcccaacatgaatgtgcgtctctgcgcctttaccgctgctcttctgcttctcataagaatacctcctgtcatgttaatcgaacgttcattccgaacgtttgttgcgaacatttgtttatgttcctatcataataccagaacatccgtttgtcaacaagaaaatcgaacaaattttcggaatatatgtttgcatttttacgcatgctgtgttaaactaaattatacataatagcattggtaatgattgacaggaggtatatgcatggcatacggcaagatcagcacgaagcagagagagattctcgaatacattaaacaggagatattgaataagggatatccgcccgctgtgcgtgagatctgcgaggcagttgacttgaagtctacctcctccgtccactcccatctggagacacttgagaagaacggatacatccgccgcgacccgacgaagccgcgtgcgatcgagatcattgatgataactttaacctcaccagacgcgaggttgtcaatgtcccgattctcgggaatgtggctgccggtcagccgttactcgcagtcgagaacattgagacctacttcccgattccgaccgaatttctcccgaacgcggagacgttcatgttgagggtaaagggcgaaagcatgatcaacgtcggcatcttcgacggagacaatgttttagttgagaagcagtcgaccgcgcgcaacggcgagatggtcgtcgcgctggtggaggattccgctacagttaagaccttttataaggaggacggttatatccgccttcagccggagaatgacacgatggatccgatcattgttccagattgccagattctcggaaaggtcattggtattttccgttttctttcctgatgaagttcggtattcctggaataaaatgcagattcctattataatgtacaagaaagaatcctgcttttcaggattctccgcctgcggcgggttgctctagcgacatcgcgcgagtgcacatccctgcggagcttttctatgtaacaggaacgaagtttcctattatatagaaaaaagtatgccccctttcctgtcagccagaagggaggcatactctttttacgacactcttaaattcaaaaacacgcatctatgacctttccgtctctccggaatcttacggatcgccgcatctatgacctttccatttctccggaatcttacagatcagccacatctacgatctttccgtctctccagatacgctccagatcatagaataaacgatcttccttggaaaaaatatggacaatgatgtcaccgtaatccatgagaatccaggtagaactggaatttccctcgatctgtttggtcttaagtcccgctttgtataatgcctcttcgcaggcatcacgcattgcctgaatctgattctgattcgttccgtccgcaatcacaaaataatctgcaaccggtgaaatctcacggatatcaatgatcttaacatcctccgccttgcggtcttccaaagccgctactgctattttacaatattcctgtgatgtcattgcatgtttcctttctatctgttctttgttcgttttaacaggtaatccgtcaaaccggatctgtctgttccttctggtactgccggtagaattcataggcaagctgtgtggagggatctaacggtccgccgaccctggagcggtatttcaatgtgtcgcagagaatctccgccatacaggcatccagatcttcaaatgccagtttccgcaccctcggcagatctgcggccttgttccttcccggctcgatataatccgcaatatagatgatcttatcgagcgtactcatatccggcgcgccggttgtgtgcaccttgatggcgtgcaggatctcaggatcttttacttcatagaccgtctctgccagataagctcccagcttggcatgcagcagaaacgggctctcatattctacggcattgatgggaatgtcatgttcctcacagatctgaagcttctcatcgtccggaatacatttggcacaatcgtggagcagacctgcgagcatcgcctgctcgatcgatgtctcataagccatcgccatacatccggcggtatacatgacacctttcgtgtgctcataccgtcccttatccaactctttttttaatcgtttacgaatctcatgctgttccatttttattctcccaaattcgatacaccgtacagatgatagcgtttgatcagctcccacacctcgcctgggagcatggcgggacattcacctgtcatgcggatctgtgcgcggattgccgtcgaggagacatcggtccgtccgcccgcaagcggatagatctcagccggaaacagcgccttgatgcgccgtattttttcctcaatctgcggcagttctaaggtatccctgaccgctgcaagcacggtggcattctgacagatgatctccggatgcctccacttgtcaaagtagtccagggaatcggctcccatgataaagaagaattgatcctccgggaactgttcctttagatgctgcagcgtcttatacgtataacttgtcccggaagactctatttctatacgtgaaagcttaaatgacgcatcatttttgatggccgcctgcgtcatttccgcgcgcacctgcgcgggtgtcatctccgcctcctccttattcggagagtgccctgccggtatgaaccacacctcgttcaacgcgaactcccggtaggcgctccttgcaatattcagatgtccctgatgaatcggatcaaacgagccgcctaaaattccgatctttctcatgccggaagttcaaacttgctgtttttcttcgcctggcggaataagatgatcttcttgccgatgacttttacaacagcagaatgtgtgcgctctgcgatgacctgtgcaatctcccgcggatcatccgcacaattctttaatacggaaatcttaatcagttcccgtttctctaatgcttcatccagcgcctggataatctccggtgtcaggcttgccttgccgatctgaaagattggatctaaggtgcttgcacatcctccgagataggcgcgctgcttacttgtcaattccatatcctgcttcctcctctttacttataataatcaaattcaaaaccgtacatgcgcacggtatcgccgtcctcaattccctgtgcctccaggtcttttaaaatgccctgctccttcatgaacttctggaagaaaaggaatcccttctcggaatccatattcgtatagccaagcatcttctcgatcttcggtccttccacaacgaatgcaccgtcgtcagccaccgtaatcgtgtatggctcatccttaaagaaacggagtgccggatcgaattcaggctcatagacaaccggctccttgctgcactggtcgagaagctcgctcacgcagtacaacagttcctttaatcccttgccgcttacggcagaaatcgggaacacacggattccgtctttttcaaaagtgtcctttaacttctggataatctcattctcgtccccgtagaccgcatccattttatttgccgcgatgacctgcggcttttttaacagtgccggatcgtaagcttccagctccttgttgatcgcgataatatccgccacaggatcacgtccctcggtgccggcagcgtccaccatgtggatcattaccttcgtgcgctcgatatggcgcagaaattcaagtccaagtccaacaccctcggaagcgccctcaatcagtccaggaatgtcggcaatgacgaaacccttcgcgccgtctaaatccaccacgccaagattgggctgcagcgttgtaaaatgatagttggcaattttcggctgtgcgttggtcacgcgcgataacagcgtggatttcccgacattcgggaagccgaccagaccgacgtccgcgattacttttaattccagcttgacttcaatctcgatcgaatctccgcccggctgcgcatattttggtgcctgcatcgtcgatgtcgcgtaatgctggttgccaagtccgcctctgccgccccgcagaatgacctgtctgcggttctctccggacatatcggcgatgaccttgccggactctgcatccttgatcacggttccctccggcacctttaagatgagatcctcaccgtttttgccgtggcagttgcgcttgccgccctcttctccgggctgtgccgcaaactttctgcgatgacggtaatccgtcagggtgtttaaaccttcatccaccacaaagaccacgtcgccgcccttgccgccgtcgccgccgtcaggaccgccatccggcacatatttttcacggcggaagctcacatgcccgtcgccgcctttccctgattttatgataattgttgctctgtctgcaaacattatattctacctcaattcaacttcaggcagcagatgctgccacctaccgaacggttacaaatccagatacaagaagacccggctatagacgcctgccatcaggtaagcgctgcatagtcgggtctacactctgcatcttattactcagctactggataaacagaagcctgcttcttgtcttttccttttctctcgaatcttaagataccatctgtcagtgcgaataatgtatcatcaccgccgatgcctacattaacgcccggatgaatctttgttccgcgctgtctgtataaaatgttgccagccttcacgaactgtccgtctgctctcttagcgcctaatctcttagactcagagtcacgaccgttctttgtagaaccaactccctttttatgagcgaaaaactgaaggttcatattcatcatgttctacacctccctaaaattcagaatgatataatcattcccataagtattctgtattccctgcaggccaagtaccagcgactgcatcagcaatccggcatcgtgaccggccggtgaagtaaatcgcaggcgaatctcgccatcgtcttcgtcggcatccgtctcgcatggttcgtcggtaaacagcccgatggaattgatcgtattgataaccagtgcagaaattcccgcacatacaatatcctcgccttcatcggcatacccggcatgtcccaggcagtcgaagcccaaatactcaccgtcatgattgcggaaaatcgttatctttgtcataacaaccttccaggattaagcgttgatcttctcgatcttaacctgtgtaaacgcctgtctgtgaccgttcttcttgtgatagccggtctttctcttgtacttgtaaacaataactttcttggatcttccctcttttacaacggaagcctctacagatgcgtttgctacatcagaaccaaccttaattccgttgtctgatacagctaaaacctgatcaaaagttactttctcaccagcttctttaccaagcttttcaatggtaatgatatcgccttcggatactttgtactgtttaccacctgttgctataattgcgtacatatggcacctcctattatcattactcgccagttgtggtgtcgcccgggcaatccggacggactttgagacctcactgtgcggcatactcgattataatagcatagcagtctggtttcgtcaacagattttttgttttttttgccaaatttcttgactttttcctatggatcgtgctatactctcttcgctaaaacttggtgtggacttttcaagtctgactttttttcgccacacaatgattcttttaagtcattgtgtggcgttttctgttttattctggatacaataaacccagaccattatataggacattatagtaggaggaaataccacatgaacgaaacatttatgaaagaaaaaccgatactgccgctgcttacctccatggcgcttccgatggtcatatccatgatggtaaacgcactttataatattgtagacagtctgttcgtcgccagaatcaatgaaaatgccatgacagcgctgtccctcgtcttcccgattcagaattttgtcaacgcgcttgccatcggattcggcgttggtatcaatgcgctgattgcctattttctcggagcaggcgacaaaaaaggcgccgaccgcgccgccacacagggacttgttctggcactcattcacggcgttgtcgtcactgtgttaagcatctccatcatgccggctttcctggacatgttcaccaacgatgtgcaggtatatcagatgggaatggagtacgcggtgatcgtatttgcgttttcgacaatcaccatggcgaatctttcctttgagaaaatcttccagtccgtgggacgcatgaaagtatccatgatcggactgctgtgcggaagtattaccaatattatcttagacccgctcctgattttcggcatcggaattttcccgagacttggtatcgccggcgcagcgattgccacagcgatcggtcagctgtgtaccctccttctttacctgacggtgtacaacaagcgcccgatcccggtcaaaatccgcaaagaataccttgcttttcataaagaaaccgaccatcgtctctactcgatcggagttcctgccatcttaaatcttgccctgccatcgctgttagtatccgtcttaaacggtattctggcagcttactcccagatctatgtagtcattctgggaatctattacaaattacagaccttcctctatcttccggcaaacggcattgtccagggcatgcgtccgctgatcggctataattacggtgccggcgagcagaagcgcgtgaaaaagatctatgagattacgcttgcgatgagtgctgtcattatggcgctcggcacaattttatgcctggtggcatcgcgcggtctgatggaactgttcaccgaaaatgccgagacgatcgcagccggaggaaccgcactgcgcatcattagcgcaggctttatcatctcctccgtgtccgtcacagcctccggcgccttggagggacttggaaaaggaacgcattcccttgtcatatcgctgttccgctatgtaattctcatgatcccggcagcctttgtattgtgccgtatctttggaccaaccggagtatggcatgctttctggatcaccgaagcagtcacctcggtcatcgccgcttatgtctaccataaggcggccggaagcagaaaataacatctgtcaaaaaagaggctggtgctttaagcagacatttcttttctcccttttctgaaaagtgtgtctgatgctattatcagagaatttgatgaatatttatactttcgctaactgttttggcgatttgagcgatttgctgggttactaaaccatactgcacccagctatcctcccagactaaatttgagttctggttgaaagcataaagaaaggctatccaatcttttgacttggtagcctttgaaaatttttattcagtttttaatgattattcagctttaggaagtggaagtaataattcttcaactactgcaccagcactgaactctactttgattgcaccgccaatggtatcaagagcatatacttttgccaattctgcttcatcatttgttgttactctaataatgatgttgtttgtggtctcatatacgccagacgttacaacaaatgggatttccttatttaccattgcatttgttatcttttcctgtaactctgtgagatatgccaatgtgtaagtaccttttacaaaagtagtattgttttcacttctgccaagttccttacaaatagctgttctattagctggtgtatcttctgtaagaacgattacaaattttccattagcatctgtataggaaccaccaaaaaactctgaggtatctttggttaagtcactgctatttacttcttcgttatattctcccttattgtctgcaggaacatcttctataatagtttctgaagtatcttcgatttctgtacttttactttcttgaatgtttacagattcttctttgttgttctgtaaatcctcaactttattattgttttcgattggtaatgactcaactgttggtgtgttggtatcctctactggtgataagtgtattaccataggaatacataaaaccaataaggcaaagcatgttgcgattgttccccacttaacccatgcaaaattattttttctcttgttgttcatatgagcttccttaatatattgattgttaatgtcaccaagagtatcaaacaaatcttcttttttcataatacataacccctttccgataagtattctttaagtttagaacgtaatcggtttaatgtaaccgatacattactttcagtcatttcataccgccttgcaattgatgaaacgctgtcagaataccaatatctacagatgaatatgtttctcttttttggtggcaaggtttccagaaaagaattgattgttgcgacaagttctcgtctgtcaatttcttgctctacatcatctacgccagatacacactctgcaagttcgtcaagaacgactgctatttctccgtttccacgtttcatcacatgattatgtttgtatttgttaaaagctaaatttcttgtgattttcccaaggaacgcagatagaattgttggtatagttggcggtatagagttccatgtacttaaatatgtatcattgacgcattcttctgcatcttcattattacctaggatattttttgcaatagaagtgcagtatttcccatacttctttgcagttgcagataatgcacgctggtctctatttaaatacaactgaataatgtccttgtcgttcatactcaatcctcctttctgattttttcccttacacctatataggcaacttctgaaccataatcttacacttttttcaaaaaatttttttctaaatttatataccaaatatatcagattgtcgaaagaaaggacatagcaaaaataaaccatgctatgtcctttaggaaaaattttatattgatttggagcaacaataaaccgaaccgcttttggaattgctaggatgtagatttatacatccaaaatatagaattatacacgcttttcattcagacacacaattccgaaaagggagtttctttttgaagtgataagtaatatgatagacagcttatctgttgatttcagctggaatgcataggatacattctgttcaaaaaatgcggcatttctaaccagccgggatttgcatctgcgatgatccgtgtctttccaagtttggaacactccacggactgtgtccgcaagccaacagacaattttaggacttttgtgcgtgctccttgtgccaccactgagcaaaacataaccgcgcgaagccgatgtttgaattggcatctgccatgttttcaatagcagatgccaacgagtttcggttcgcgcggttttatattgtctgtgaagcggtggcactaggggcactaaaaagtccgctcattgtctgtggcttgtcggacacacaccgggagagtccaaacgtggaagagacacggaatcagatgcaaacctccggcaggaagaaatgctctcatttttttcaaataattgtatcctatgcagttccagctgaaatctacatgctgtgttttctggcatattacttatcgcttcaaaattcactgccctctaaagtaccagcccctttttggacacttcctcctgaaagatcatgcgaagctgccctttcagcggaacattcagttccctcagggtgtcatccaatgcatctaacgtctcgatcatgtccaccacgttcgcattgctacccatgtgtccgatacggatcacctgccccgctagggagtcaaacgatcctgccagcatgataccgtgcttctgccgcatggtctgtaaaatggcatccgcggtcgtctctttcgggacgtcaaacaccgtgacggtattggagaaaccggacgcaaggtgtaagttcagtcccgctccgcggactgccgccctgcatgcctcaccgatccgcgcgtgccgcgccagcatatccggatcacccgcgatattgtcgaacgcggcgcgcagtccgtagatatcactgatcggcatggtgtacgggaaccactttttctcgtaatatccctcaaacaccttaaggtttgcataaaaagaggcaatcggtacatttctgccatcgatggctgcccatgccgcatcactcaccgtgacaaacgtcagtcccggaggcgccgaaacagctttctgggaaccgccgcagaggacatcaatctgaaaatcatccacgcgcacatcctcgccgaacatgccggagacggaatccaccaccgtgagtatcccgtattttttcagaagcggacaaagcgcagagatgtcatttaacatgccgctcggggtatcgcagtgcacgagcgttgcatatttgtaatcgtgatgttcctttaaatattcttccagggcggccggatcaatcggatttttctcatccacggaatacagaaccggctttccgccatacatggaaacgaaatcagcaaaccctctgccgtatacgccgttatccagcaccagtaccggatcgcccggttccgtcagggaggcacaggcagcctcaagccccagaattccctctccgcctaaaatcagggtctcattcccggtgtgcagcaggcggctgatcagttcacaggtctccttataaaaatctacgaaagtttcatccagatccggattggtgcagggaaaactgcgcgccatgcggacattctctttgacctgcgtaggtcccggtgtcataatcttatacatggaaacgcctccttagttccacagttttgcagctactttctttaacggtgcaatgatgataagaacgatcacagctgcagttccgatctgaagcaggttgcccggaatcgatgtcaccggtgtaatccagttgccgtaaataattccctctgcgatgtaatatccgccgatcttgatcgcgcaggcagcaagcattgccacaacataccactgaaagccctgcttcttctctgtaatccatcccatcacaaatcccatgcatccgacgatcacaaaggtaaacggtgcccatgccgtccagccggacaacagatcaaacagtcccatgccgactccgccggcaatggctcccgtctttttgccaaacaggattgcgaaaataaacagtgggacatttccaagatgaatcaatccgccctgcggtgcaaacggcagacgaatgttaatcagccaggtaaatacatataccagtgcgattccgatcgccgtgacggtgagaaaacgcacctgctctgtgctggttgtttttgtgctactcatagttttggtttctgacatgactctttctctctttcttttttgttagagccatgataccccatttctggatgaatgaatatgtccagttttactatttttgaccagtccagttcagctttcatctccggtgaatcccatatttctccggtattcgctcggcgaaacaccgcagcagcccttaaacagtttcataaagtgcttctcgttctcatagccgacggcctgggagatctccgcgatgcgcatatcggttcctgcgagcagccgctttgcctccttcatgcggatatcccttaaataattgacaaaattacttccggtatactgcttaaacgaataagaaaacagggaataattcatggacagataattagagacaaccgccatattcagatcactggcatagtgttcttcaatgtaggcgaccgcctgcttcattttctgctgattcccgtttgtgtcaaactggcttaaaatctgcgcctgcagaccggtcacaaaggccagcagcttctgttcgtagcagtcgattgcatcctccccgaacagatccgtgatctctgccatttccccgcggttttcttccagcacattccggtatgttttaaatgcctccgcaaggaaatccgtcatgcactcctcaaagtcccggacaccgatgcggtcatgctttacctcgtaaaaaaattgcgtccagacgtgctgcagttcctcggtgcggtcggttccaagtaactgcacccgctgcagcttcatctcgtctgcaaccagctttgacgcctcctgcaccagcttctgtgggacacgcggcatctcctgcccatagcgcatctgactgcggttcgtgcaaaacgcgcacctgcgcatttcccgcgcctccagatatgcctcgcgcagttcgcggattccctgatgcggccggctgattccggtatattcctgcaaaaaaggatattcccccggacggtccgaaagtgcttccgcctcgattaaaaagagatcatttccctcgacatcgcccaggaacaggcagtccttcgggcaggattcctcctcttttttccggttcctgcagcagaccacatacggctttccgctcagatctaaaataaaatgctggtcatactgggtctccaacatggtaagctcctcttccggcatctctgccagaagcatcagatgacggatctgctgctgtccgagcttctggcgcgttttctcctgctccctgccctcctcaatctcctgattcagcctggcaagtatgtcgcagattttttcgcgctcgatcggttttaacagatattcccgcaccccgttgtgcatcatcgccaccgcatagttaaagtcatcgtaaccgctgatcgcaacggtgagcggtatgtgttcacattcctgcatgcgctccaccagctcgattccgtccatctttggcatacggatatccgtaaacatgacatcgatggactgctcttttaaaatctcaagcgccgtctcaccgttgttacattccataatcacttccaccgggacaccgctccgctgaatcatcttgcggagtccctgccggatcaatttttcatcctcaacaatcaatacagtcttcattctgcttctcccctgtgcgtcatcggaatgcggacgataattttggtatagcatccgatctgcgacgccacttctatgccatacgccccgccaaatgcaatctggatccggtcctgcacgttttttaagccgattccgtttccggaacccccgctcgaatccagttcccctgcaatcttctgacgaagctgtgccatctcttcctcggtcatgccgcgcccggcatccgtaatttcaatcacgcagtcgtttccttccacgcgccccttgatgtagatgttggtatcttccgccatctgctcgattccgtgatagatggcattttccacgatcggctgcagcgacattttgggaatctcctgctgtaaaataatctccggcagattgagtgataaatagatctcgtaatcaaaccgcagattgattaacgccatataattcttgatatattccagttcctgctccaccaggacattgcctgatacccacttcatgctgtagcgtaagagcttcccgagggatgtgaccgcatccgaaatatcgtactcctcgtcgatctccgccatcatcttgatggactccaagacattatagataaaatgcgcgttaatctgattctgcagcgcacggatctctgaattttttaccagcatttcgcgctttagattgtcgtccatgagctgcttgatcctcgttaacatcttgttgatctgtgttcccagctctcccatctcatccggtccgcagtgctcgatcaccacgtccagatctccgccctgcacgcgccggatggcgcgcagaatctcgtacagctgttttaacagatgttttacgatcgcattgataaaaaatgtcagaacaaccaaaaacacgagcatgaccgccacaaacgtgttgcgcatgcggtatacgtgatgaatgttggacgtaatatttttcacgcagagcagggtcccgtttaattcctgcaagggaaggtaggatacaatcagatgctgtccctgcagcttcagatagcaggtctgtatttcctcgtccgccgtatactgtgccatgatctcggcgagcagttcctgccgtcctgtgttttcgtcctccccgtcaccttctccaaaataacacccgccgtcctctgtcagaaaacagctccactcgtcctcaatgttctcgtagagactgggaaacatgttttccatcgtcatagccgcctcgatcattccgaacgtcccggaatcgctgtcctttatctccgtcacgagcgataagatcttgcggttctgtctcatcgtgtaagaattaaaaatctgatcgttaaagtcgtaatgccagccggtaacagtctcctccgactgccagggctgcttttccatgcgagaggctgcatagagaatcggcatcatctcctgtacccggtcgtttgacgcatacacacgcacgccgtagagaagcgggttgttgtttaccagacgctcgagggatacaatatcgctgttcttaaagctgtaccattcctccgccgaaaaagtctccccgtccttcgttcttttgagcatttccaaaagcggctcatcgctcaggaaaaactgtgtggacatgttgatggaattgatcttggttgcaacggcatctttgttgcgctccatggtgtactccatatatccggtattctccgatacgacgtttttctccatattgtaaaaaaggatgccggcaagaatgccgatgggaatcaccataaacagaataatcacaagggtaaactttacattcagtttctggctgacaaaccgttttttccaattcatgtaacactctccgtctctttactggatgccaagcttctctttggcgctgttcatatatgccgtcttcttctccatgacatccgtatagcccagctcatcccgcttctcaataaattcttcaaaaagggtgtcaaactcctcctccgatggtgccataagaagcgccggaagcgtctggctccagagctttgtaatcttgtcctcctccgatgcctccttggagccggagtcaaataccacatcatactgaccgttgtatacgacatattttcttccccattcctccagctgtgccgttgcaggcgatggttcctgtttccactgaagctgcatcacattgtcctgcagcatccagtaggcatcgtccgccccgtattccctgtcgtaagctgcgcggtccgtgtccagaatctgcttgatgttatcgcggagcaccggctttccgtcctttatatcgtaagtcacaccctcgacgcccagataggtgagaagctgcccatgctcgctcatcagataatccagaaacgcaatcgcgcgctccgggtgtttgcagttcttggaaatcagcgtcaccgtccacccgttgatcgtggttgtcgggcgcagcggatcgtccccatttgcatttctcggaccttccaccgccatataaatgctgtccggatcattggcatataaaattttctgctgtgtcagcatatccgaatattgatacagcatgcagaagtagcggccctgcgccactttttcctccatctgtgtccgggtgtccacaaaaatatcattcgcaagataaccttcctctcccagctgtctgaatactttcagccagcgaaaatattccggatcggtatagcggtcatagtagacgccgtctttctcccacggaatggcaagaaaattcatcaggtatttgtcaaaggagacatttccctcgttgtcgaacacgtgcgcaccgatcgggatcagaggctccccgtctacttccggaaacatctccgctgccttctttaccgctgcgcaaaagccttccggtgttgtcatatccgggcttccgatcgcctcgtagatatccttgcgcaccagaaaggtctgattgctgcttaaatcctcgcactgctctacatcctgcggcgtgatggaggagttcgggtaggcgtaaatattgccgtcgtccgtggtataccagttcacggccaccgggtccgagacctcccagaaatacggatcatagctgtccgcaagctcattgagcgcatagaccatgccgttttctgtcatctcgctcacctgcggttcccaccatccgagcgtgattaaatccggcagcgagtcggacgcaatcagggcgttcagtttttcggattcatttccgagcggcgtgataaaatgaatatccacgcccgtctcctccgtgatcgtctgcgacaccagattctcgccccacggcgtcgaaaaccaggagtagttgatataccagtccagcgtcaccggatcgtctgcgtacgtctgccatgccggaagatccccgtccggctgcacttgtccggctgcttccgtttccggcacatttccggaagcgccggtcataacattcccgcaggcaccgcacagcgccgctgttataagagaaaaaagcgttacacacgcccattgttttttatatttgccacccattccaatcccccgtttttctccgtaaaatcaaagattttcctgtctctatcatataatatttcccggcatatttccagcaggaaaagccgtttcccacgctccttcgccagcataacgcacacaaagaagcaccttccgtttccggaaagtgcctctttctaagaggagaactatgaaaataaagttttgaaacctgctggcattttattctttgacgctgcccgccgaaatactgctgataatgtatttcgagcagaagcagaacacaatcaggatcggtatgacagagattgccaccgccagataaatagcgccctgatttctctgaatgtccgtcgatgcttttaacgtcgccatcatgaccggcaatgtaaacttctcatttttgtttaagataatcatcggaagcagataattgttccagtttccgataaatgccatgatcgccatcgtcgcaataccaggagacataatcggaagcgcaatcctgtggaaggaatataattcgcttgcaccgtcgattctggctgcctccaccagtgccggcggcatcaccgataaaatgtactgtcttaagaaaaacaccgttccgggtgccgcaaccgccggcacaatcagcgggatataggaatttaccagttttaatttggtacataaattgtaaaaaccgatcaggctgagctgtcccggaatcatcataaacacaaggatcgccgtaaagatcagcttgttgccgcggaatcgatacattgccagtccatatgccgtcatcgccgagaaatacgccgtcagcagtgtggcaggaactgcaaccagtaagctgtttgccattccgcggaacagattaaagaaactaaatacggtctcccagttttctttcagatgcgtgctcggtatcagcgtaaagaaatgtgtaatctccacaccgtccctggtcgcgttgaccatcatcagaagaaacgggaacaggcacgccgccgcaagcaggacaagcagaatataaataacgctcttttttatcttatcacccgtcgtcataactaatcctccttgttgactaattttaactgcagcacagatacaatcagaatgattaagaacaatgcatatgcaatggcagatgcatatccggtctgtgttgtgcctgtcgagaaaccaaatttatacagatacattaccacggtctcaattgagttgtaggatgccgccgtcttctccgacataaggaacggcaggtcaaacatctgcagtcctccgatcaaggaagtgattgccacgtaaagcatgatcggctttaacagcggcagcgtgatttttccaaatgtcgtccagcgccctgccccgtcaatcgctgcggcttcaaagtaatctttgttgattccctgcacgcctgccatcagcataatgaaggagttgccaaaccacatccatgcactgatgactgcgatgacgcttcctgcggtgccggaatttccaagccagtctaccggcgccttgttcactccgaagaactgatagacggaatttaagatctggttaaacgtaccgtatctccagtctaacagtgtcttaaagagaaaagcgacagaggtggctgcgatcaggttcggcagataatacagtgcccgaaacaccggcagccccttaaatttatatttaatatcactgaacacaacggtcagcaaaaatgcgagtcctaactgtagtacgatattaacgccccagatcctgattgtattccagagcgctctccagaaaaacttatcggtaaatacgcgtgtataatttttcagaccgacaaaatggtacggcattcctgccagcttgctgtcggtaaagcttaaaacgagtgtgcggaataccgggtacacactgaaaatcaggaaaacgatcacaaagggagccacgaaaaagtagcctgcccggttatactttgtgaggtttgatgtcttttttttcggatttgtttttgccataggaaatcccctctatctcattttgtattccccctccggcaccgccacaacatcctttggggacattgtggctgccgtccgggaggataccaagttaccctgctcttatctgtttactgtgatatcaggatatgtagattcaatcgtgtcatagaaatcattcactgcctcttccttggtcatctgtcctgtcttgaccgcagagatcgcattgccccatgcatcaccgattgcctgatcgtaacgggttaccttggaggtatcaatctccttcgcctgctctaaccagaactggtacagtttctcaccgccgtagattgcattttcatcatctttgtgcttctcaagcgcggatttcagggaaacggtatcgccctgggagaaatcgatccaccagtctgcggtgtcttcatttaatgtacagaattttacaaactcccatgcggtatctttgcggttggactgggaggaaataccgatataggtaccaccgtcaaatccggaggaaggtcccttgcagacgccccacaaaccggaggtgtcgccgacattatctctcatggtaagtacgccccaggacggcagtccgaacgcgaagaccgtcgtggtgtccatgcccttggttgcctctgcaaactctgttgcatcccatacgttgacagaatcatccgcgtaattctggatatctgcggttaagatcggaacctctcccgccattgcctgataccacggcgtggaccactggttggcatatgcggtgagatccttctgatacagatccacacaaagatccatgtaatcaaatcttgcctggtctacatttaagacaccgtcaaccacccatgcggaatcaccggaaaatacgcccatctctgcgtctgaggagaaaatacggtatcccgcgtccttcaacttctgcgcggtatccagaatagtcgggtaatccttaaataatttgccgacctcatccggatcatccgttccgaatacttccttggcaatatctcttctgtaatagatacctgccggggtgatctgataggaaatggctctctggatgccctcggaatcctgtccgactttccatacataatcaacgatctgatctgcatagtcctgtgcgttgtacggtgcctgattcagatcctcaaaaaatcctgcgtcgtaaaaatcctccagcatcttcggctcgcctacgataatatccggttcgctctcgccgcccaaaagcgctgtctgcaccttggtcggatagtttgcaggctcaatgacaaccgtgtcaacggcaactccggtctgctcttcaaagcgctcaccaaagtcgatcaggtcgtttgagagtgtccataccaccagcttatcatcgccggaagcggacgtgcctgcaccctccgtagattctgcggtacttcccccaccagaagctgcatctgtgcttgtttctcccgaatcgccgcatgcggtcattgataatgccataatgccaacgagcatgacggatactgcttttttccaattcataaaaatatcctccttttatttcaacatctctgttgttttgatacttgcattatagatgctttcatttcctcaaaaaatgatccaaattttaaaaaggtatcatttttttagtccacggcaacctccatttttctgacccttccggcgcggatatcctccgccagttttccggagactttctccccctcaacggtcgcctgactgccattttcatagaaaaacaccatatggcggatccggtaggttcccggcacataatccctgtgcccgccaaattcatagcacacggtcgtcttgctcataaacgcagcggaaagtctgccatcctccggaatcagatacgccggaatggccggtgcaagcgaaaagaccagttcctcctgctccgtccggaaaggatgtgcgccgaacatcatctctttccacatgctgataaattcgatcgttgatccgctgagtcttgccacgaatcctcttccgcggcaggacggatttggattcctgctgctggctataaacgaggaattttcgtaaatacttcttccgtaagtctccgggttctggaacggtatcgcagccttcttgaaatccgcgaaaaattcttcatagagaccgctgcgcagaagttcaagaagatatttatattccatatgaagccagatggattcgttttcgagccagcccggggtaaatgcacgcgcacgcccaagttcaaaagaggaatccgcaagggaagcattcaccttgtacatggacagttccccgtcgtagagatcgctctctttgaccgcttcgtacagggcacgcttctcgccctgctccacaggcagcttcagatagcgcaccggtccctccagaaaatacggcatatttttgggaacaaattttaacgggcggatgccgccgtcctttaacttttcatactccggcacctcgtaagtaaaatacgtcgggcagatctccccggagatccggcgcgcctttttgattccgcaggtaacaatctccaagaatccttccagaatcgccgcaagctgctccgtgtgatagaccatcttcttaccggatacgccctgataggtcttgtcgcggtaaatctccttcgcgtcattgatccggttccagaaggacaacagttcctcgtcccgcatgatattgtcgtgctccagccgcgtgatcagattcagttcatccaggaaacatcccagttcctctatgagtgcgacttctcccggatattgctttaaggcctctatggtgtaggagagcatgcgcgccagctcgtaggtctccgccatggaagaaccgaaaagtcccggcataccgtttagggcgtcataccatccgggctttccgccctccatctcgattcccattccgtaagcatccagcgtggcaaatttcacagcactgagcagtatcaatttctccatcagcgtcatggtcagcacatccccgctgccgtattcggttctcaccagtttttcccccaagtccgccagcctggacgcctcgtttaacgcccggtactgccttaagccattctccgtctccacatagcggcggaacctgcggttcacattgattctggacaaaaaggtggtatagacctcctcatagagcatttcctcctcctgctccgggaacacggaaaggtaatccagaatcagatcgagattgtaggtccagtgatcgctccagtagccttccccgaacgatccgttcaccatctcctccgcaaaatcaatgacccggataaataacgtctcatcccaggtatcgccgaatacctccccgaacttccggcagagtgctccaggcgtaaacggctttgtcgcgaagtcaagcagcgctcttctttgctcctccttcacgtctgccagcagcttctttgcccgctcctttgaaaggcggtaggtcagtttctcgacgccaagcggattgtacccgtccagctggatcagactgtagaattcctgtatattctttctgccgacgaacggtgcaaaaaaggtgtcgcagcggcggttctgattgacatcgcggaagttcccgtttccctgcgaatagaattccggcagcatggaaaagtaattgtaatcccgctccagatcaccgtgttttctggaatagacataaaagatcttattgttccccagctgcatcggataaccgccgcgcagcacattgtccatataggtgtacctgcagtaggcatcgaacgccgcggaggctgtcctggtgcggataccgtctgtcagcgcctctgcaagttcatcagcttctcttttttttgcctcaaaataggcggcatctttcttttccgcaaaatattcctttaaaagctgcttgttctccacctgtccgatcagttcatataaggtgacgcttccgcccggggcaagggtgcgcgtgatgccgtaaaagctgcacggcagcaggttctgcgtcatctgttcttccagaagaagttcctttaacgggcgttcttcaaaaccgaccggtcttttcagcgacagatcataggaaaaaatcaaagacggatccacgatcggttgtaaccgtctgccgtccgcttcgcagcatgccgagaagttgccgccgtcgatcctgcgcaccgccgcggtgtcatccatgcttgcccgcacgcggtagtacggcagaccctcgcttaaatcctcgacctgcatccacgctttcgcggtctgccccatatttttcatgctgtccatggacacgccgtacggaatcaccgccggcatgccgtcaatcagttccagctcgatgggctccccggactgattggtgacactcaccacgcgcacaagcgcgccgacattttctccgggcagtgtatagtacaccacttttgtgtccattccgcttgaccggttctgctcctcgattgcaagaccattcatgtgaatctgcatccggtgcgcgatgttctcatccgaaaacggttcaaaaaccgtaccgttcttctttaaaaatgtgcggaaccctgtggtctttacattctgatatgcctgatgcgccggataaaattccatgatcgcatgatctttattgtccacgccgaaactcaccacacactgtccgcggttcacatagtagcaccagatcgggattccccgtattcctgcaattcccggcagaaaactcgcaaatgtggattttttcccataatcattcattacaaacgtctcatttttccctgtcatctcattctcctttacaccagttccaccaaaatttcatgcgtgacatcaaaatccagctgctttaaccgctccctatcgatgcagacactgcgcgtctctttctctcccccggaataatcccacaattccccgtcaatccggatcgttcccgggcggtaagcgccgtactccttgtgctctttgttctcgtagaccagatgcagcgactgtcccgcaaacgaaaagaaaagctccgctctttcatccagatcaaactgttgccgctccagcttcggttccaacatcagattgccggcacatcccttcgcgccgaacatttccgtaatcacggtaagcatgtaccagcttgccgcccccgtcagataatggtacattccctttccgcggctgttaaaatactccgggattcccggataaatccggctggtttcaaaatggacagactgacggtaaagcgcatccaatgcccggtgcccttcctttacaaatccccgcttatagagggcgtttgcaaacatcaccgccatgtgtgaaaagaccgcaccgttttccttttccccgtaagcgaacccgaacattcttcccagatccattttcacttcaccgaaatccgtatttaaccggtaaccgcccatcgcgtcgcagtacagatatttgtctgcgctgcggacaatctctgccacctgttcatccgtcgcggtctgtgccataacggcaaacacctgactggtcagcatcatgcgcacgccctgcgcaaagacaccctccacgcacctgccatgattgtcatagtatccgttaaaccagccgtttccctcctcatcgttcacccactctgtggcacggatatgtccggtcagaaaggctgctttcttctgcaggctgcggacaagctctgtaatcgaaacctctgtcttctgcccgcttacttcatggatgcatgcatcggtatagcgcgttaagagttcctgctttttttgaaccgatgcatacagggtgtcgtcatccgcaagcagcacgaaaagatcccgatttaacggcacagactccttcccggttttctctgcgtagagtgcaagcagctccgcgagttcccggagattgcctgcataggcgttggtaaatgcaacgctctccccgcgctcgcccgccatatccagcgcatcgttccagtccgcgccgcgaaggcggatatgtccgtgttcgcccacctcgtagaaagccgtcagattctgcagcagaagatgctccagcacgcttccgcggtagacatttcccgcggcatccctctgccagcagccgtcctgctccttccatgccgcatccttctttgtcccgcgccctgcctgctgatccttaaaatatgggatctcttcctccagaaccgcaagatcgccggtctggtcgatatagagctttgtcgtcacaaacggccagaccccgtgatccatccacacgcgcgtaatctgattgcggtcggcgataaaggttccctccttgcttccgataatggtcgcattggttccgtcgatgcggacaccctgaaaattattgagaagcatctcgcgcacaccgtccggattcatcaaaagaagtgccagacagtcctgccagagatctctccagcctcttcctccctttccgtaatcatggtgcggcaaaaaggaacagccatagatccggcgcaggatcggctgaaagctgacccactgcatatagcggtcaaactggcggtctttcgtgtggtaggatacgtttactttctgttcccagtatgttttcatgcgctcatacgccgccttcgtctgcgccgccgtgcggtacgctgccgtcatgcttaaaatcgtctccccggcatgttccgtctttcgcaccgccccgatcatgatcgtgtatcctgcggtctcgcccggtgcaagaatcctctccttaaaatggagtccgccgaccgcctcacatccggcatatgcactgcccgccggcacaccggcaagatttttgacaaccgcctttggccgctcaaaattacctccctcgccgataaaatcctgcacggtcgggtaaaaatcttccggtgcctcccccgtctggtcgtatccgcacacaaagtaggtcatctcgttcgggcggtgcccccgctcgtcaaaagacatcgtcggcgtcacaagcacaccgttctccaccgtgcggatgcggtgcagcagcgatgtcacatgccggtgatccctcagattgtccgcgctcctgccatagaccggtatggctgcggtcggcgtgaatcgcacctgcatgttgcctgtattggtaatctccacatacatgatctccatcggatcgtccagcggaacaaacgatgtgatctgtgccgaaagctgatacttcctggaggttctcgtcacggtctgccacataaaaccggctgtcacttcgttttcatccgcaagatccgtaaatttttttgcgatttcttccgccgaattgcccgtggcggaccagcttccgtgcgttccgatatggcaccagaaatttctggcattccggttattgtgaagattctccacgctcaccggctccagcagaaacgtattctgatccagcttgcagtccccgccaagtgtcggcgtcaccgcgcttttgataccacactcccctgcgaccgggaaatacagatcactgtaatctgccgcccccggcagagaaaaaactcccttatcactgataaattgatatgtattctgcatcctgcaagtttcctttcatttttttattattctaaggaaaaaaacaggcacaaaaaaagataccttttttttaaaaggtatcttttttttagaatcccagaccgtccggaaaaatctcatgcagcggtctttttatttttttgcgggtcacctcgaccagaccgagtgcggtcatatcgataagctgcgccggaaccggatctttttgcagtgccgcccggaatgtcttaagcagttcctcttccgcggattttgatgtcagatttataaaatccaccagaaccattcccgagagattccgcagccgcagttgtctggcaatctcctctgccgcttccttgttcacgcgcagaaagttctcctgcatctccttttttgccacattctttccggtgttgacatccaccaccgtcagagcctccgtcggctgaatgaccagataggcaccggattttaaccatacgcgctcactcaatgcatttttcagctccgaccggacactgtagagtgctccaagggagagcgccggatccttgtaataacggatccggattccatccgccgtcattacatcgtccaccggcacgggcacgcttcctcccgtcgtaagcgcctgcttatggatccggcaggcactgcagatatcctcgaacattccgcggtcatctgtcacaatctcttgcagatcgtccttccgcaggtctctgatatggcgcagccatcccgcttcctccctgtatacaagcgtgtaacagttcttgtgtgccgccgcctccgccatcgtctcatagcgctccaaaagcacttccagttcaagcagaaccgtctcatcggaagcctctgcggcattggtgcggagaatcacgccgtactcccctgccgtctgctctacaagcttcaccagacgctctctggcctccccctttacctttgatgagacgctcttcttccggtttccggaagttaagacggcataggttcccgcgatcgtcaggtttgtcgtcaccgcgggatcttttgtcttaagcgcctcgcgcgagacctgtaccagaagttcatcgcccgccgcaagcgcctttgtctgcgacagctttctggtaaaaacgggattcttcacatcggacagcggcagatagcaccgtatatccggcgctatcttgacaaacgcggcatttagattggtgacaatgttctcgacttttccgacatagatattgccgagcagtgatgtctcccccgccgcctccggcaatacctcaatcatatgttttttctcatcataaagggcagaaatcagatattcctgcccttttatcttctctcgcgttatcatgtaacggttcattcgattacttctcccatcgcgcctaaggacacaaaatcatccccgtcggacgcatagacatccttcctgtgaatctgaatcgcattgggatcataggtaagtcccatgtgtaaaaacagcgcctcaagcaccagctccggcttcagattatccgtacttcctgtggaaagtttcagatagaaggatggcacgccgccgcggtccgtcacctgaaagccgtagatgagtggtttgatatccagcacgcgctcgctctttttcgtctgcttggtgatgagaacctcatccggtttctcaaagaaatcgcggataccgtcagcaaacgccaaaacagaaaccggtgccgcatacccttccttaaaatacagatcataatctgcggcggcaacgatcgacattgccgtctttgcctgatccggaagtttcacataaccggtgcactccacgccctccaccatgacgccgtttaacgcccggagggattcctccgtggatacactcgtgtgcacttcaatgtccatatactcgccgtcgctcgtgatgcccacgccgagcggcgcagcaaacgacatgatctggtgcggggaaaatccctccgaatagcagatgtcaatgtgtgctctgcgcattgccttctggaagtaccgcatcacatcgagatgtccgataaacttcatcacaccgtacttgcggaaacggattctaattttcatagcagacacctcctccgaacttcttcacaccgcagcccgaacagcgcattcggcagttcggcgtcacggtctctttcatggcattgttccactcacgctttaaaaattccttggtcacgccggtatcgataaaatcccatgggaaaatctcgtccatggaacgctcgcgcatcgtgtaaaaatcgggatcaatgccgcactccgcaaaggcgtccagccatctctgatagtcaaaatattcggaccatgcatcaaaaatgccacccttttcataaacctttaagatagcctgtccgattttccggtcgccgcgcgccaatacgccctctaaaactgtcacatccgcctcatgccagttgtatttaatgctctttttgtttaactgttccttgaccgtgtcgttgaccacttttgcacgtccgatgtaatcctccggcgggtacattcttgcccactggaacggtgtaaacggcttcgggacgaaaaaggaggtactgatcgtgatctggcatctgccgttccgcttctccttgggaacggtgtcataatagcgtgccgccgtctcattggcaagctccgcgatcgcccgcatatccgcctctgtctcggtcggaagtcccagcataaagtagaacttgaccttattccagccgccctcaaacgccatctgggcgccgtttaagatgacctcctccgtcagtcccttgttgatgacgtcgcgcaggcgctgtgatcccgcctccggtgcgaatgtcaggctgctctttttgatgtcctgcaccttgctcatgacatccagtgaaaacgcatcgatgcggagcgacggaagcgaaatattcaccctgcgctccctgcactcgtcgatcaggaaattgacaagttcctccagagagctgtagtccgatgaacttaaggagctgagtgagatctcctcatacccggtcgcctcaatcatctgtgtggcaagcgcctttaggcgctcaatatttttctcgcgcaccggacggtacaccattcccgcctggcagaaacggcagccgcggatacagccgcgctgaatctcaagcacaacgcgatcctgcgtggctttgataaacggtacgaccggcttttccggatagaccgcatccgtcatatccatcacgagctgcttggtcacagtcgccgggatttcctcatccaccggtgtaaacgacgcgatcgttccgtcttctttatattccacctgatacagggaaggcacatagattcccggaatctttgccgcctcatgcaaaaactccctgcggcttctgcccgcccgcttcatctcctgatagagatctaacatgcggtcatatacgacctccccttctcccatataaaacagatcgaaaaagtctgcaattggttccggattgtaggtgcagggaccgccgccgatcacgatcggaacggtatcgtcacggtctgcggcaagcagcggaatctggcttaagtcaagaatctggagaatattggtataacacatctcatactggatggtaattccaagaaaatccatattcttcaccggctcctgtgattccaggcaaaacagcgggatgttctcctccttcatgatcttgtgcagatccggccacggggaatacacgcgctcacaccacacatcgtctctcttattaaacatatcatagagaatctggatgcccagatgggacataccgatctcatatacatccggaaagcacatggcaaaacgaatcgatacctcgtctttgtttttacagacgctgttcaactcgtttccaatgtagcgcgccggcttatcaatcttcatcagtatctcatcggataacgctaactttgtcatttcttttatcctttcattctgtatgcagaagttctgcaagcactgcgtcgcactcctgcaaaattgtatcataccgattatcttcgatcatgtcaatcattttcgccggagtgacgccgcaaaccgtatttccactgtcatcccatgcaaaaaagaacaaaaacagcagcagtgccacaagaaagcggagctgtccccccgcgcgccctctctgtggctcctctctgtcaaaaggctctcccgcatccgctcccgtctcaaaggaactgcggacctgtgagacatacgctctccgccgttctacatagtctgtcatactgcacctctcctatcccgcctgtgctctaggatactatatgagatttttgggaaaaacatgtgcgcagaacatcgatcagttttgaaaccgcaaacgtcaaaaaacggatgatggtctgatccaaaatgacggctcccacaaatgacagtgcaaacgtgagaagtacggcaagcagacagcctcccacgatgccgccggacaggacattgacgtgaagcacctgcttgacggcatagtggagcacgccccagtgaatcagcagaatcgaataactgtacttcccgatgatgcgcacaaaggggctctctttgctgccgcagggcaccagccgctttatgagcacaaacacggcggcggcataaaacatcatcgtaggagcattgttgtaaatatagtcgtcataccagccatggaacagaatcacatagcaggtgatcagatatgacacaagacccgccgcaaggaaaaaattctccgcccgcctccctgcgcggttcgccagatagtagccaagcagaaatacccccacatacgaattcacaataccggagagtgccgccggcggcgtaacgccaagcagcggcacataggtgacatacgcattcagaaggaagatcacaagcatcacgccgttcatgaccggatcgggaatgttctgcaccagataccgcaaaaacggggtgagcacatacagccagataatgacatagaccagccacagatgcggcgcttccaccggcggtccgatgaagaaccgctgcagcatcagtccccactgcgacggagcgagccgtccgattccctctttggcacagacatacagattgtaatagaccacgagtgggatgaagacacggataaaacggcgcgcaaaaaaatccctgcaccgctctccttttaccggcagcagcaatgcgccgctgatcatgacaaagaacaggttgcaggacaaaaacgtataattaaagacttccaatacgcgaaaaagcagcgtccccggcgctgctgtcgtcttcgcgagcgcgacggtgtggacacagatcacaaacaccgtcgcaatcacgcgcagaacatccatataaacctttcgcggcggctttaccgctgggaaagttcctgtgtgatatcctcccatgtgactcctctttctgccataagcaccatcatgtgatacaggaaatccgagatctcgtattttacctcttccggatccggattctttgccgcaatcacaatctcggtcgcctcctcgccgactttctttaagatcttatcgattcccttgtcaaacaggtaattcgtgtaagatccctccttcgggtgtgccttgcggtcgagaataatctcatagacatcctcgagtaccttaagcggattcttctccacatattccttcttgacaatctcgttgaaaaagcaggtcggattgccggtatggcacgctgctcccacctgggataccttcgcgaggattgtgtcataatcgcagtctgccgtcaaagacttcacatactggatgtggccggaggtcatgcctttcgtccagagttcctgacggctccggctgaaataggtcatcttaccgatattgattgtggtataaaaagcttcctcgttcatgtaggcaagcattaacacctcatctgtacggtaatcctgcacgatcacgggaaccatgccttctgaattctttttcagatcatcccactttaacgccgggtcaaaattgtccatcttgatgcccgcggaagaaagctgtgacttgatctccatgatgttggtattcggatcgtttaagaaaccgccggcaattccgcgcgtgttgctccgctttaacacctcaatgatcttctcgtaatcgcaggtctcaaaatagaccacatacggaacatccgtaatattctcaatcgcatctaaaacactggtgtttaacaccagaagttcatggaaattctcattcatcttcgcctgatgtttgaacacgaagtccacgttctccaccgacacgaggatccggtcttttccgaaacgcttgctcgcctcctcggcaagctcgatgctgttcgccttggcgccgttgacaatgacctgaaggcatccggcatagataaactttttgatgtcctcgaggcggttgatgttgccgcccgcgcaggtcttgatctccacgttgcggttgatgttcttgatcgtgtgaatattcttctcatgctcctcatcatcgtcagagagatcaaaaatgataatcttgtcaattccgttgtcattgtaaagctttgccagctcgatgacgtccgccagcggggtgtgatcctcaatcccccgtaccgcctgtccgttctttaagtaaatcgttgcaacgatatttttctgttccataaaaatataatacctttctataaactgcccttcgtagacaaaatatccgtaatccgcggatcataagatgtcgcctcgtcgagggctcgcgcaaatgccttaaacatcgcctcaatcatgtgatggttattgcccggcgtcagcaccttgatgtgcagattcatccctgccgtgtaggagatcgcatagaagaactccttcaccatctccgtgtccatgtatccgactctctctacggtaaaattaccgtcgaaggacagatacggccgtccggagagatctaccgcgcataaaacgagtgtctcgtccatcggcagaatacagcttccgtaacgcttgatgccctttttgtccccgaccgcctttttgatcgcattgccgagcacaattccggtatcttcgatcgtgtgatgacaatccacgatcagatcgccctccgccttgaccgacagatcgaaaaaaccgtgtctggcaaagccctcgagcatgtgatcgaaaaagccgatcccggtatcgatctcgcttactccgctcccgtccagttccagactgagcgtgatgtctgtctccttggtctttcgcacataatctgctgttctgctcatactgactcccgttccttcccaacacttcaacttttattatattacggtttccacgaaaaaggaattacttttgttcagaattttcctcaaaccggacacggattgaattggcgtgtgccgtgagtttttcgcactccgcgaactggatgatgtccttgtatacattctcaagcgcctccctggaataggaaatgatgctggatttcttgataaaatcatccacgccaagcgccgagaagaacttcgccgtaccgttggtcggaagcacatgattcggtcccgcaaagtagtcgccgagcggctcggaggaatattcgccgataaagattgctccggcgttgcggatcttcgtcatcacctcaaacggattcttcgtcacaagttccaggtgctcggacgcaatctcattgaccgttgcaatcgcatcgtccagactgtcggcaaccagaatgtatccgtaattctccagcgattttgtgatgatctcctttctcgacagcttctccacaaagcggtcgatctcagccgccacctgcccggcaagcgtgcggcttgtggtaatcagaatagcggaagccatctcgtcatgctccgcctgcgacagcaggtccgccgccacataacgcggattcgctgtctcgtccgcaaggacaaggatctcgcttggccccgcgatggagtcgatgctgacataaccgaacacagccttttttgcaagtgccacatagatatttcctgggcctacaatcttgtccaccttcgggatgctctcggttccgaacgccatcgcagcgatcgcctgcgcgccgcccaccttatagatggcgtccacgcccgcctcctttgccgccacgagtgtggacggatagactttcccgtctgctcccggcggtgtcgtcataatgatctgctccacacccgccacttttgccggaatgacattcatgagcaccgacgacgggtagacggccttgccgcccggcacatacacgccgactctcgcaagcggagtcaccttctgtcctaagataatgccggattcctgtgaatcaaaccaggaattctggcgctgtctgctgtgatagtctcggatattgacaagtgccttgcggatcacggagaggagctttggatctaccttctcgtaggcttccctgatctcctcctccgtgacaaggatatttccggcatcaatgtcggcaccgtcaaactttttcgtgtaggaaaaaacagccgcgtcgcggttggcgcgcacctcctcgatgatggcgttcacacgcccctcgtactccccgtaggagttcgggctgcgctttaacagattctccagtatattctgctgtgtctctttggttaacgttaagattctcatgccagatccttcctttctatctctctctttaaatccgcgatcagcttcgtgatccgttcattttccatcttcatgctgacctggttgaccaccatccgtgcagacagcggacatacttcctccagaaccaccagaccgttctcgcgcagagtcgagccggtctccacaatatcgcagatgacttccgagagcccgacgatcggcgccagctcgatggaaccgttcagcttgatgatctccaccgtctgatgctttttattgtaaaaatagtccttggcgatgtgcggatacttggttgcaacacggatcagttcatggtgcttcagcaactcttccgcatccttcggtccgcagatgcacatccggcattttccaaacccgagatccaagacttcgtagatattgcgtccctcctccagtatggtatccttcccgacaataccgatgtccgcggcgccgtattctacataagtgggcacatccggtcccttggcaaggaaaaaacgaagctttaactcctcattcacgaaaatcagctttctcgtgtccttatccttcatctcctcacaggtaatgccgatcttctcaaacagttccagtgtcttttttgcaagtctgcctttgccgagcgcaaaagtcagatatctcatatcctccatttaaaacgtctctcccttctctgccttctacgcgaaaaactgcacgtttgtcatccggctgcgagctgcataatcctcgtaatctttcctttgcttcgtctcatcccacaacatcagctccacacagcgtccggctgcacgcgctgtcgccgctgcggtaatcgccttctgccgtttggcagatttatagaccatcagctccacacagcgttccaccggaacatcaattttctgtctctgcagtgcagccatcagctggtcaatcacaaacgcaaagccgatggatgctgaatcttttccaaaacaggtgaggagccggtcgtatctgcctccctttacaatcgcctctccgcttccgaacgtatatcccgcaaatatgataccggtgtaatactggtagttgctgatcgttccaagttcaaacgaaacataacgggaaacctcatagacttccagtattttatgaagttcctccagatccccgatcgcctttaagatcctgggataggatgctgcacattcccttgcggcagaaagttcatccgaacccgtgtagagattcccgagcatgccaaagagattctttaagttctcctcgaggtttaaagtctccacgaactcctccacaccgaaaaagttcttgttggaaatgagttcgcgcagttcctcctcctgctcctccaaaagccctgctgcctccatcagtccccggaagaaatccgcatgtccgatgctaagctggaactccttaagccccgccgccttcaggcaggaaatcaccatggagatcatctccgcatccgcatccactgatggatctcccaaaagctccgcgccaagctgtgtacattccttcagtcgtccctgatagctgctgttattgatgaaagtattccccatgtagcacagccggatcggaagttcttcctcgccaaaatactttgcggcacagcgtgcaatcgacggcgtgatatccggtcttaacaccaacgtgttgccttcccggtcaaaaaacttgtagagatccttcgacggcgtggtgccgatctcccgtccgaatatatcaaaaaactcaaatgtcggcgtctgaatcggatgataaccgtgcagacgtaatatatgatatagctggtcctgaagaagcattttcttctcacactcatcattataaatatcccgcacaccttccggcgtatgcaataactgtcttttcatgatcgccctcatttccctgatacttttatactttaccttgctactatggtagcatgatagcaagtgaaactctgtttattataggagatcttagaataattgtcaatccctgcgcagcaaatccttctgcagtgcatccagatacggaaccaaaacgccacgctgccgcggcaggaaatactccgggtccagttcctcatagcggaaactctttcttccgccctcctttgcgcgcttccagaactctaagagcatatccaggcgcagatagtagaactcatcccgcttcgtaaaactgagcaggaaaaaagatacccctccctgtttttcaaagttctccatgaacgcaacctgatgttcatgaatattggcaagtggaaaggtatccgtattacattcttttgcatcaaaacagaccggtattccctgtacggcaccgatatagtccaccgtgctcttctggtcaaaatacgccagcgtgatatgtctggtctgtttgtcgatattgatcggcgtgatcggtgtgggaatcttctgaatcagcgcaagaccgttctcctgataaatctcattggtacggttgataaactcttccagcgttgatccacgcagtcctcttgaattccaagttgccatattgcctccagatactctcttgacacaccggcagttagctgccgtcatgcatctttcatccttttcttttctctattatatagaattctcagtaggtacacaataaaaatatccctttgtcaaacctctccaattatgatatacttgaacccagagaggggttttacccgaagatcctagaatgaaggttagcaatgggagggatgccagatggtcatgaatgagtcaaacgagaattacctggaaacgattctggtcttaaatcatagattgggcaacgtgcgctctgtcgacatcgccaatgagatgaactttaagaagccaagcgtcagcgtggcaatgaagaatcttcgtgagaacggttatattaccgtcagcccggaaggatacatccatctgacggaaagcggacttgaagttgcagaaaagatttatgagcgccacacaatcttatccaactggctgacgatgcttggggttgatccgcgggttgccgcagaggatgcgtgcaagatcgagcacgatgtcagtgcggaaagctttgaagcgatcaagcgccacatcaattccagtgcaggaaagatttgaggcggtcagatgccacatccatttccgtacaggaaagatctgaggcgttcagacgccacatccatttccgtacaggaaagatttcatcgaaaacgacaaaaatggaagttcagcttaaggttgaacttccattttttgtgctgcaattctttctgccacaacctgtctaccggttcttacaccactcttccacgcgcgcgaactctgcgccgcagggtgcgatcacttctctcccgtccgcaaagacgatgcggtatgcgtgaagcatctgtgattttaccttacactgtctgcggaactgttcgtttatgccggcgtcgccgtactttacatccccgatgatcggatgtccgatggacgccaaatgcgcccggatctgatgggaacgtccggtgatcagatgaacctccagcccggtgtaaccgccgcccgtccagatgggccggtacgcggtctcaatcggcgcggcatccgcacttttgggttttaccgtactgacggtaactttattctcacgttcatccttaacgagccaccccttcaagtaatcttctctaaggacttccccttttaccacacaccggtaatacttctggatcgtccgctcctttaatgccttagacatctcctgaagtccctttaaagtctttcccgcaatcagaataccggaagtattccggtccaggcggttgcagactgacggacggaaggtgcgcatctcctcctcggtcagcgctccctccctaagcagatagcttaagatatattcattggcggaaacatcctcgggtctcgccttctgggagagcatgccggacggcttgtttatgataagaatatccgcatcctcataaaggactttaagctgccttaaagtcttttctgaaccactgaaagcttctggcatcaccgtttttgactttgcccggaacttctcgtaagtctcgtccgagagaaacagcttcacctcgtccccgcaggagagcttctccgtgccgtccgcctttttgccgtttaaggtaatgtttttcttgcgcagcatcttgtagacaaaactgccgggagcctctgccagaagcttttttaaatacttgtcaaaacgctgtcccgcgtcgttctcgccgatgtgcaattcctgcatagtctctctccattcgcccgcttactttttccccgcacctgcttttttatgatgaacattgcggattgtctttttcgtatttttcttctcggaagcatttgctcttccgcggttattcccgccgcctgccgtgcggcggttcttgtcacctccagcgtagcggtctttggcgtttgttctgccgtagccgatgccccgcggccgtaccagacagtgtttgtcaaagccgatcagatccgtccgccccgctttggttaacgcctccacaacaagatcgtaattcttcgggttccggtactggatgagcgcgcgctgcatggctttctcgtgggggtttaccgccacatagaccggctgcatcgtgcgcgggtcaagtcccgtatagtacatgcaggtggatatggtcgacggggtcggataaaaatcctgtacctgctccggcatatagccgagatctcttaagaattcggcgagttccaccgcctccttcaacgtcgatcccggatgggatgacatcagatacggcaccagatactgctttttcccgagcttctcgttcatatcctgataggccttcacaaaccgcttgtacacctccacgcgcggtttgcccatcttctctaagaccgcatcggaaatatgctccggcgccacctttagctgaccgctgacgtggtgttcacagagttctctgaggaaggtgcggtcctcatcgtagatcagataatcgaaacggatacccgaacggatgaacacctttttcacattcggcagttcccgtagctttcttaagagcttcaggtaatccttatgatccacctttaagttcttgcacggtgtcggaaacaggcactgcttgttgggacatacgccctttgtcatctgcttgtcacacgcaggcgcgcggaaattggccgtcggtccgccgacatcatggatgtatcccttaaagtccggttcccagacgatcttctccgcctccgccagaatggactcgtggctgcgcacctgaataatccgtccctgatggaacgtaagcgcacagaaactgcatcctccgtagcagccgcggttgctgaccagagaaaaacgcacttcctcgattgcaggaaccccgccctgcgcttcgtaactcggatgatacgtgcgctgatacggcagcgcatagacctgatccatctcgctttgtgtcagcggcttcgccggcggattctgcacgacaaaaagctttccgtcgtacgtttcaaacagacgtttggcgacaaacggatcggtattgcagtactgggtataaaagctgcgcgcatacgccgccttgtccgccagcacctcctcataatgcggaagctctatggcatcatagatgtcctcacgctttctggtcttatagaccgtgccgtcgataaatgtgatatcgctgaccgccagtccgctgtttaaggcatccgcaatctccacaatgctgtgttcccccataccgtaggagatcagatccgccccggaatccagaagaatggaccgcttcatcttgttcgaccagtaatcataatgcgccagtctgcgcaggctggcctcaatgccgccgataatgatcggcgtgtgcttataggtctgccggagcagattacaatagacaatggtcgcgtaatccggccgttttcccatcacgccgcccggcgtaaacgcatccgtcgcgcgccttttcttggacaccgaatagtgattcaccatcgaatccatattgcccgcagacactaaaaacccgagccgcggctccccgaagatacagacagactccttatctctccagtccggctgcgagataattccgaccgaatagccgtgcgcttccagaagtcttgagataatggcgtgaccgaacgaaggatgatccacgtaggcatccccgatcacatagacaaagtcaaactgtttgattccgcgctcttccatctccgcacggctgactggcaaaaatccgttgttcattctaatcctcatttctcttcggctgctcattctttaacgcagcaagctcttccgcggtcagtttccggtacgctcccggtgcaagatcctccggcagtaccaatggtcccatggaaatccgcttcaaatacagtaccttttttccgaccgcctcaaacatccgctttacctgatggaactttccctccgtgatggtaagcgtaatctctgacacatcctctttacagcccagaattaccagatctgccggtctggtcggcttctcctccccgatgtcaaccccgtttttaaaaaagttgacatcggtctcatccaccacgccctgcacccgggcgtaatatgtttttgccacatggcgggacggcgacagcagcgcgtgtgccagcgcaccgtcgttcgtgatcaaaagcagtccctcagtgtctagatccagtcttcccactggaaacagatctccccttgcagtgtcgctcagataatccatcaccgtgcggtgcatattgtcctgtgtcgccgacacacagccggcgggcttgtgaaacagataatactcaaaggcggtatagaggagacgctccccgcgcaggcatacctcatcgcctgtctcatcgaccttttgttccggcttttttgcaaccgctccgttcacggtgaccagaccggctttgatctgtttttttacctcgcttctggttcctgcccccagttctgtcagatatttatccagacgaagtgccatttttctccctcactgtctctttgtctcaccgaatgtgtactttccctgctgttcccagagatataacaccatcggatacgggtttacggaaagttcctgcccgttctcatcgttgatatagattccaaagtgcagatgcaccggaaagttgccggtggttcccggaatatcgctgtaaccggtatcccccatatagcccagatgggtgcctgcaaggactgtctccccaacttcaaactccttcgcatactccgccagatgcgcataataaaaataggctccggacggactgcggatgccgatgcggtacccgccgaggcgaagccatcccacattttccacgactccgtcggatacgctgtatatgggatagatgcctcgctcgttcaccgaagccataatatcacagccttcatgtccccgctcaccgccaaagttcctgctctgcatccagctgtctgcaaagctcactcccgcattcccgtcggaggccaccgtcccgaccggaaaacgttccagatcgtcccacacggcagaaagatagccgcagattcgcgcatatgcctgcggctgataccgttttgcatacagagcctctacggccagctgcccgggatcggtgacgcttccatcctccgcaaaatagacggcaagcagttctttttccgacattcctttttcttctgcctcctcctgcatccgggcaagcagttccccgctcacccggtgttcccggaaactgtaaagcgccgtctcataggaaaaacagtttatctgtctggttctctccagaatccatgtgtttataagaacgttccataggatcatggtaaacagtaacagcagcatacggacatgtctgaaattcatatcattccttttttatttacatttttttaaaaatgccaccagaagcttccatactttctcggtcgaggagatggacagacgctctttcggcgtatgaatatcgtaattgttcggtccgaacgatacacagtcaagatccttgatctttccggaaaggataccacactccagtccggcatgaattgcctcaaataccggctcctcctggaacagctcctcatatacggcactgatggtatcgcggatctcggacttcgcctgatactcccatgcaggataatcaccgcttacggcaatctctccgcctaagaactctgcgatatgctccagacggtcacgcagatcttccttgcgggaagacacactgcttcgcacggaggctgtcgcaagaagcgcctgatcctccaattttaagatgccaagatttaaggaggtctccaccagccccggcatcaccgtgctcatatgctgtacgccgtttggcacatggcgcaggtaaaaaatcactctcgccatcgccgtataggaaagaatcgatgcctcccccttctctccgaaagcacagtcaatcgttattcccgcatccgataccgcatactcctttttaagctccgccgtaagttccttaatataggtggtaagctcctcttttttctcctccggaatcagcagacctgccgtacattcacgcggaatggcattgtcctttaaaccgccctctaaggtcacaacgcccagttccatccggtcagagacgtattttaacacacgtcccatgaccatattggcattcgcatgctctttgtcaatctcacttccggaatgtccgccgcaaagtcctgtcaccgtcagcgtcaccgcaagtccgttctgggacatacggtcaaccggaatcgtagtctccaccgtcatgccgcctgcacagctggtcaggaaatgaccctccacatcggaatcaatatttaaaagcttgtgtccctttaacatggacagatcaatcgcctcggcgccgagcattccgatctcctcgtccaccgtaatcacaacctcaagacgcggatgcgcaatctccggtgagtccataatggcaagcgcataggcaacggcaatgccgtcgtcaccgcccagcgtggttcctctcgctttcaaaaaatcaccgtccacatagagatccagaccgtctttctcgaaatcgatcgcacaaccgttctctttttcgcataccatatccatatgtccctgcagaatgatggtatccgcctgctcatagccggctgtcgcctcctgcacgatcaccacgttgttagactcatcctgataccaggtcagatcatgttcttttgcaaaagcaaccagataatcgctgatagcctttgtatttctcgaaccatgcggaatcgcacagatctcctcaaagtaatcaaacactttctccgactgcaactgtaacacctgtatttcttttaaactgctcatagaatcctcctgttcttcatacattctagtatgaaaaagaaattgatattcctttgtctgctattatttattgcctatatcttaaccgccccgaaagatgccgttaacgccgcatccgtgggtctcgttctgtggtacacgcgcgttcttccgacgctgctcccctttgtcattctgtccaatatcctgatggactcgaattacctgcaatatctgaataaaatcaccgcaccgcttgtatccagactcattccggtcagcgacaacggggcttttgttctgttaagcggctttctgtttggcttcccgatcgggagtaaaaactgcgccgccctgcttacaagcggaaaaatcacccgccgggaagccgatgttttatttatcattaccaacaacatcagtccggtctttatcacaagcttcatcctctacacccagctaaagctgtcacatctggcggcggtcaccctgctgatcctgtattttccggcactcctgctgggcagtatcctgctctctgcagacacagcgcattccagagaccacaccgcgttccacgcgcaaaaacagccggcatctggatctcaaatgaattttaaaatcatagataccggcatcatggatggttttgaaacactgaccagacttggtgggtatattatgctgttttccatgatcgcctctcttctgcagaagcttcccgttccccgcatcgttacactgatccttacgggaatggttgaaatcacaaacggtattgccatgcttccggattccggtctgccgcagtctgtccagtatgtgctgtccgtggtctataccgccttcggcggactctccggcatcgcccagacaagttccatgatccgcgacacaccgctctccacaaaacgctactgtatcgccaagctgcttcttaccgtctgctgcggactgctcgcctgcctcgtctcacaaatcttccatctgtgagacagtgtgtccggtcagcccagcatatccgaagaaatctccaccttcgggccgtctgcctgagatgcctgcacatccgtcgtcttggattccggctcctcggcggtcggattgagctcggcacggttcgccgtcaccacatccaggaatccctgcagggaacttacataagcatcatggcgcgccttcgccgcatccatggaatgtgagatcgtgttctccagattccgcagaatgtcatccgtatactgcatggcacccatacggatattgttggcgtcattcgtcgcattatctaaaatctcctgcgcctgcttggtggcaatcatgaccacttcattcgcctgcgcgtatgcctgctgcatgatctgatgctcgctgaccagctcgtccgtcttgacctgcgcctgcgcaatgatcgcatctgcctttgcctgggcatctgccagaattgcttccttattgcttatgatcttctgatagcgtttgatctcctccggtgtcttgatgcggagttcgttgagcagctcctccatctcttcgcggtttacgataattttagaagaggaaaatgtctgcggcttgcagccatcgatatattcctcgatttcttctataatctgttcaattctacttgccataagcctctccttattttgagatgtgatatttctcatagatcctgtctatgaatctcgccggaacgaacttggagatgtcgcctccgtaggatgcgaactccttcacaatggtggaactcagataggaatactgcaggctcgtcgtgagaaaaatcgtctccacttccgggttctccacatgattcgtctgtgcaatctgaagctcgtattcaaaatccgtcacagcccgaagcccacgcactatgatcgtcgcgttgatctccttcatataatctaccaaaagaccgtcaaaagatgcaaccgtgacattcggcatggattccgtcatctcttttatcatactaacacgttcgtcaagagaaaacaacgaattttttgcgctgttattcagtacgccgatcaccagttcatccacgatttttgcggatctctcaatcatatccagatgtcccagtgtaagcggatcaaaacttccgggatatattgccctcttcataggtttcttctccttttcgcatgctccggctattttctgcggataaatgcgtgctcatttgtcttgtacatcttgaggcgtgaaagtgtcattccatactcatccagatagctgaaatccgtatctaacgcagcctctacgatcagaaccgtatcctcttttaaaagggaagatcctgcaagataccgtaaaacctcctgctccattcccttgcggtaaggcgggtccatgaaaatcaggtcaaactgatatttgccctccatggcgcgcagcgcgctcaacacttccgtcggatacagctttgtctgatgttcaaacttcgtaaaccggatattctcctcgatgcaggctgccggctttttgccattgtcgacaaacaccgcatagcgcgcgcctctgctgactgcctccaatcccatctgaccgcttcccgcaaacagatccaggaaatatgccccgggcacttcatcctgtatgatattaaacagcgtctccttgatccggtccgtggtcggtctcgtatccattccctccggtgccttaagcggcaggcttctcgccgttccagctatgattcgcatatggttccctcctctgtgatcgtgcgggcaagtaaatgaagcgccgcatctgtggcacttttccgcacctgcatccggtctcccgcaaacagatgccgttccgtgacaacccttccgtgcaggcagcagccgatgtagacaagcccgaccggacattccctggtcccgccgtccggtcctgccacgccggtcacagacagcgccgcatccgtatccgccgtccgcgccgcagataccgccatatccgcagccgtctcggcactcacaacgccgtagcgctcaatcgtctccggcttcacatggatcatcttcaccttcgcttcatttgaataggtgacatatccctccgtaaaaaatgcggagatccccggcacattgataagcgttgaggcaatcatcccgccggtcgcggactctgctgtcgtgagcgtataatgatatttttttaacaattcaaaaatccgatactccggcatttcatcaagcatcttgctgccggtctgtccctctgctgccatcttttcttccttctctatttctggtcttttaagacgtctttgttcttcacaatgtaatcgatcagagataccacagtcagaatcagcgccacatacgtcagcacgatgccgagaatctggaagaacggcatctggatgtcaaggatcagaacgatcaccatcagcatctggaacgttgtcttgaactttccccagtagcttgctgcgatcacaaccccgttgtcggatgccaccagacggaaaccgctgatgataaattctctcgcaatgatcacaatcacaatccatgccgccaggcggtcaagctcgatcagacagatcatggcggagcacaccagaagtttatctgccagcgggtccataaatttgccgaaatttgtcacaagattgtactttcttgcaatcttgccgtccagcatatccgtcaggctcgccacgataaagatcgccactgcaatatagttgccgtatgccgggaaataaggcgacagcagaaagaatacaaaaaacggaatcaaaattacacgcataatggttaatttgtttggtaaattcataacaattctcctatcaaatcatactcgtacgctcctgtcactctggcgcgtacaatatcaccggtcatcagttcctcgtccgtgttgatgaaaatgtagccgtccacatccggcgcatcgcggtaggtgcggccgatataggcattctcatcgctcacttttccttcgataaagacataaagctctctgcccttcatctcctcgttcttgtcgaagatgatctcctcctgcagttccatgacatccgcctgccactctttcttcgtctcctcgtcaatctgatccgggaactccgccgcaggtgttccctcctccggagagtaggtgaaagctccgagtctgtcgaactccatatcattgataaactgcatcagctcctcgtgcatctccttcgtctctcccggaaatccgcagataagcgttgtccggagcgtgatgtccggaatccgctctctcaaatgcgtgataatgcgcacaagatccgcgttgctggtgcgtctgcccatccgctttaacatggtatcgttggcgtgctggatcggcagatccaggtagtgacagactttctcattgcgggcaatggcgtcaatcagctcctcatagatctcctccggatagcagtacataatgcggatccagaacagtcccggaatctcatttaacgcatccagcagcttgtggagggacttctccccgtagagatccacgccgtaaagcgtcgtctcctgcgccactaaaatcagttccttcgcgcctgccgccaccagctccttcgcctgtgccaccagctcctccatcggaacactgcggtaattgccgcggatatacggaataatgcagtaggtgcagcgcttgttgcagccctccgcaatctttaggtaagcaaagtgtccgcccgtcgtcacgctccgcttggctgtaagcttcggcagtcccttcagcgtctcaaaattctcgtagaacttgccgcccagcgcctccgttatggcattcacgatatcttcgtaggaattggttccaaggatcgcatccacctccggaatctccttgcggatctcttccttgtagcgctgcgccaggcatccggtcacgatcagcgcctttaactttgcatcgcgcttgtgctccgccatctccaaaatggtgttgatgctctcttccttcgcatcgttgataaagcagcaggtgttgatgatgatgatatccgcctgatattcatcatcggtcatctcgatcggctgtccgtcaaatgtgccggcatcccggatcattccaagcatgaattccgtatctaccagattcttgtcacagccaagggatataaataataacttcatcgttgtctccatcattgtattttaacgccaaaaaggatgataagcatatcatccttttcccatctgaaaccatctgaaaaaatgattactcttcctcggactgtgactccggaataatctttaccttgccctcataaagttcttccacggcaatggataacggcttcgggcaggtgactttatctgccatcggctcatctccggcgatgatctggcgtgcgcgctttgcagctgcaatcaccagggaatagcggctgtttaccaccggttcctcaccgatctctacgccctcgttgactaccttcattaactctacataagatggatgtatcataataaatctcctttctgacgccctgttactgacgcgtgaagcctttcagctcgtttctcatttcacggattttgtctgcattgcgcgctacgcggtagtgctcattctggatgatctcatgcacttccctgaccgcttcctccagcacatcgttgactaccagatagtcgtattcctccagcccttcggcttcttctaacgcgcgtgccagccggtgttcaatgacgtccatggtctctgttccacggccgatcagccggttcttcaacacttccgcgctcggcggagtcacaaacaaaagcagcgcatccgggaactgtctgcgtacctttaaggcaccctgaatctcaatctccaagatcacgtccttgcccctggcaagctgctcttccacatatgccttcggtgtgccgtaatagttgcccacatactctgcatattccacaagcgcatcgtccgcgatcatctgctcaaacgcttcgcggctcttgaaaaaatactcgataccgtcgcgctccccggttcgcggtgcgcgcgtcgtcgcggaaatcgagagcgcgtaggtctcgctgtgtgcctgcatgagcgccttcatgatcgtaccttttcccgcaccggaaaaccccgatacgactgtcaaaattcctttattcttttgcatcgtcataatcctctgcggtattgccgttaaatcttcctgccagtgtctccggctgcaatgccgacaatataattttattattttcggtaaagatcacactcttggtgcgtctgccctgtgtcgcatcgattaacgtctccgtctccttgccgcgctgtatcagccgctttgccggagcggaatccgacgagatgatacttatgatcttatcggtgttgaccatattgccaaagccgatgttgattaacccagccatggacgccacctactcaatgttctgaatctgctcacggaccttctcgatgtccgtcttcagattgatgccgacgtccgaaaccttaagatcggtcgtctttgagaggatggtgttcgcctcgcggttcatctcctgcgcaataaagtcaagctttctgcccatgccgccgccggcaagcagggtctccttcatgcttaagatatggcttctgagacgcactgtctcttcatccacgcagatcttgtcggcaaaaatagtaatctccgccgcaattcttgcatcgtcgagctgtctgtcgcccaggagttcctgcactttgctctccagccgcatgcggtactcctccaggatctgcggcgagcgctcctcaatgtaatccacataggaaatcatgccgtcaagcttctccacgagatccgccctgagacgctctccctctttgatacggctctccacaaactgcgctgccgcctggcggagtgcctgctccaatcccgcccaaagcttctgctcatccgggctctgctcctccatcacgaagacgtccggatagcgggacaacgtgctcacgcgcacgtcattctcgatgccgaactgctctgccatctccttcagataggtcatgtactgctctgcaagccccgcattgtattttaacgaataattctcttctgtgtaatcttcataagatataaatacatccaccttgccgcgctcgatatattcctttaacagactgcggatcgcactctcaaagaaattcagcgtcttcggcagcttgatattcacatccagataacggtgattcacggacttgatctccacggtaaacttgcggcttgcatccgcaacctccgcgcgcccgaaaccggtcatgctcttaatcattcactgtctccctaacatgatagcttctgatgctaattcgatttattataaatcgaatccggtttgaagtcaagagctgcaaaatgattccttacgacatggcagcaattctctatgacatacaggtgccgcatggcatgccatgcggcgtgtcatgcggcatatcgtgccgtttaggcatgtgtctcctgctcgtagggcatcacttccgccagaaagccctttttctgcagtgcatgctctatctcgtcgagcacttcttcgctttccgcggaaatcttgtgaaaatgatagccggaagtcacattcaaaagcggaaccgattttccggttctaagatcatttaagaagccctgcacatcccgccggttcctgatattgagcgccgcttccacgcgcccgtaaaccctgtggttcaccatgacatttaagacggtgccgcccagatcaacgatcgtcgtgagttcctcctccacctgttcattggtatggcagaccttaagcacgcgggtcgcacatttcggttcgttgagcagatagcccttcgcggtcgacacaatcggatacccttctgttctaagcagcgcaatgtcctgcaccacgacctgccggctcacccccgtgacctgtccaagctgcgtcccggagagcggctgttccgactcccgcatcagaaagatcagcttttttcttctgtccgcaccggtcatttctttttccatagattttctcacccttccagcacacgcaaatgtttcagactgatatccaggatcggcgcagaatgtgtcagcgcgccgctggacacgtaatccacaccaagagatgtaatggtcttaatattttcctttgtgatattgccggaacactcggtctcggcacgtccgtcgatcacgcggattgcttccgccatctgctccggtgtcatattgtcgagcatgataatatccgcgcctgcttccacggcttcttttaccatatcaaggttctctgtctccacctcgatcttgcgcacaaacggtgcatatgccttcgctgccgcaacggcttccttcacgccgcctgccgcatcgatgtgattgtcctttaagagcacgccgtccgacagattatatctgtgattgcatccgccgccgatgcgcaccgcatatttttcaaaaatacgcatacccggcgttgttttgcgggtatccagaagcttcgtcttagatccctccagaagcttcgccacgctgtgcgtgtaagttgcaatgccgcttaagcgctgcagatagttgagtgccgtacgctctcccgacagcagtacccggatatcgccggtcacaaccgcaagggtctgtccctttttcactttttcgccatccttcacgaagaaatccacctgcgtcttttcatccagcagtgtgaacacacgctcgaaaatctgtaaacccgcaataattccgtcctccttgcagatcaactgtacgtcgccctttttgtactccggcatcacggcgttggtggagacatcctcactgttgatgtcctcctctaacgccatcttgatatatttgtcagcaacaagctgcatggtaattggattcatgttcttcttttcctttctgtgtaagttcgatcttttgtgcggcgcgctttgcaaagacaaggctctccaagagactgttgctggcaagccggttcttcccgtgaaccccgttgcagcttgtctccccgaccgcatacagatgcggcatagtcgtttccgaatcgcggtccacatggacgccgcccataaaatagtgctgtgccggaacgatcggtgccggctcctttaagatgtcatagccctcttccagacatttctcataaatatgtgggaaatgtcccttgatgatctcctccggtacgttctcaaaggagatgaattcatggtcgacaccctctttttccatctcctcgcggatcgctttcgtcacgacatcgcgcggaagcagttcgttgacgaaccgctctcccttgtgattcaagagaatcgcgccctcgcctctggcggactctgagatcagaaagcttctgcccggctttttgctgtagagacaggtcggatggatctgcacataatccatgtgctccaattctactccgtgctgctccgcaatccggcaggcatcgcccgtcagaatcgggaaattcgtggagtgctcatacagaccgccgatgccgcctgtcgccatgaccgtatcctgcgcatggatgtgcagcgtctcgccgtcccttgtcttcgcgatcatgccgcagcagtgatcattcacgacgagaatatctgtcattacagtatattccatgatggtcacattcgtcaattttttcacatgcgaaagcagcgtcgtggtgatctccttgccggtgatatcctcatggaaacagattctcggtctggaatgtgctccctctctcgtgtaggcaagcgtgccgtccggattcttcgcaaaacggaccccgagggaaagcagatcatcgatgatcgcccggcttccgcggatcatgagatccacgctctccttccggttctcataatgtcccgcccgcatggtatcctcaaaataggaatcataatcgttctcatcatgcagcacacagatgcctccctgtgccagcatggaatcacagctctccagatcttctttggacagcatcagaatcttcttgtctcttccaagacgcagcgccgtatacagccctgccactccgcagcctgcaatcactacgtcatagtacatatctctcatcttatttattccctcttttcgtatcccggcatctgatacgccggtcacatttcatccgagtatagcacatatctttacagatgacaagacagttgttatgacaaattgtcaagacaatttgtcagacaatttgtcatgtataattccaaaataaaaaagacatattatcgaaaagggatgccgtcgcttcagaccaggttcccaaaaggagacaactatgattaacgaagataccatttatctgctgcgcgagtgcaacgccggaacgcagatggcagtctattccatcggcgagattctggaaaatgtcaaagatcagaagctgcgtgagattctgatctcatccaaaaaccatcacgaacagcttggcaacgaactgcatattctgctgcagaaatacggcgatacgacaaaagacccgggcgtcatcgccaagggcatgtcctggatcaaaacgaacgcaaaacttgccatcgacgacagtgaccgggtctgtgcagatctgattacggacggctgccacatgggcaccaagacaatgcagcggcacatcaaccagtaccttgccgctgaccgcgaggccagaggcaaggcagaagaactcatccgcatggaagaactgctcgcatgcgaactgaaaccgtttttatagacagaaaaaccctgcgccgcatccggaatttacaccagaaactcccggattttttccagcacattttccgtctcatcatagatggaaagtgtgagcggcacagtaagatccattgtgcagattcccagaatggacttgccgtccaccgtgtaactgccccgcccaagatcaaacggtccctcgcaggcacttaggatattgcagaatcttagtgcgcgctccggcgcattcagcagcacttctacctgtttcacgaataccatacctcctgtttcttttatggtatagtattccagactttccgctgccgtaatcaatcatttacatctttttcctagatcagtgtctcgatctcgtcgagcacttttccgaatacatcgagtgcatcctgaatcggcttcggctcctccatattgatgccgacctgttttaacagatctaccggagacatggagcatccgccggagaggaacttcttgtagcgctccactgccggtgcgccctcctccagaatgccgtgcgcgatcgccaccgctgcggaaaagctggtcgcatactggtatacatagaaattatagtaaaaatgcgggattctcgcccactcataagcgatctgcggatcggagaccatatcctcgccgaaatacttctggttcagtccgtaatagagtttgcagagattctcggcatttaagctttcgcccgcttccgccatctggttgcttttcatctcgaactccgcgaacatggtctggcggtacactgttcccttaaagctgtcgagataatgatttaacaggtaggcacgctcttttttgtccgtcgtgttcgcgagcagatactccatcagaaggatctcgttgcaggtagaggcaacctccgccacgaaaatcttgtactgggagtaaatataaggctgatttgcattcgagtaccaggaatgcatggcatgtcccatctcgtgtgcgagcgtaaacatgttatctaacgtatcgttataattcaacaggacatacgggtgcgtgccgaacgcgcctgccgagtatgcaccgctccgcttcccctcgttctcatagacatcgatccagcggttctcaaagccttcctttaccgttgcaacgtagtcctcaccaagaggtgcgagcgccttaagcaccgtctccttcgcctcatcataggaaacctttttggctgcatccgcgatcatcggcgtgtagacgtcatacatgtgaagttcgtccaccccgaggcacttcttgcgcagctttacatagcggtgcatcttgtccatgttggcatttacggtctccaccagattgcggtaaaccttcgccggcacattgttcgcatcgactgccgcttccagcgtagacgcataatttctcgccttcgcatagaaaatctgctgctttacctgtccgttgtaaagtccggcaatcgttccggcaaactgtttgtagatgctgtaaaaagcttcaaacgcatcttttctgacgcggcggtcgcccgattcctcgaacggcacaaaattgccgtgggaaaggcgcaccttctccccgttttcatcctcgatctccgggtagatcagatccgcattgttgatgatggagtatacctgctccggcgtctgtgccatctctcctgtcatcgccaccagtttttccatctccgccgagaggacatgctctttggtgcgcaggatctcatctaccagtccgcggtagagttccagttcctttttttcagcaaaatactgcgcaagcgttgctttgtcggctgccagaatctccggcacaacaaatgccgtgcggctctgataatccgtcacaacaccgtacattttctgcgacattgcctgatgctcggtgttcttctgatcctggtcaaacaggcgctccgcataattaaacgccagatcgatcttctgctctgcacgcgcgccaagctccagcgccgcaagaagcttctctgcggaagccataacactgccctctaactttgcgagatcagaaacgatcgcatccacttccttaagatctgcctcccatgctgttttagaagcatacatcgcacttacatcccatgtatattcctcttttacctcacttctttttggtaattctcttgccatagataacctcctgtccggtgtccccgttttcggtcgcaccgcataaaataagggttataaaatccctctcttaatttaccttccctaagccgaattgtaaagaccaagtttgttttttctaactccccgcctcctctttccatttgtattttgcggcgttttctactataatggattcacattatttatgaaggagtacaaacatcatggcttttgacggatttgtcatatccaatttagtatacgaattaaacaacacgattctgaatgcaaaaatcagcaaaatcgcgcagccggaaaccgacgagctgctcttcaccttaaaaggatctaacggtcagtaccgccttgccatgtcggcgagcgcttccctgccgtttttatatctgaccggcaccaataaaccgagtccgctcaccgcgccgaatttctgcatgcttctgcgcaagcatatcgcaaacggacggatcgtggagatcagccagccgcacatggagcgcatcatcaacttcaagatcgagcacttggacgagatgggcgacctgtgtcagaaaaccctgatcgtggagctgatgggcaagcggagcaatatcattttctgcgatgcgaacggcagaatcatcgacagcatcaagcacgtatcggctgcgatgagttctctgcgtgaagttctgccgggacgcacctactgcattcccgcaacgcaggatgaccgtctgaatccgttggaggtcacggaggagacttttttgggcagcgccatgaaaaagccgcttccgatcgcaaaggcgctctacacctcctttaccggtgtcagccccctcgtcgctaacgaaatctgccaccgcgcctccatcgacggcgacatgtccgtggattcgcttaccccggatgcccaaaagcatctctatcacaactttgcctggctgatggaggacgtaaaagagcaccgctacgagccgaacatcattacccgcgacagggagccggtcgaattttcctgcttccgtctgaccgaatatgtcggcagcgacgatgccgcggaagccacaaattccaccggtgccgctgcaaacggaagcgaatacacgatgcagcacttttcttcgatctcagcggtcctggaacagtattacgcttcacgcaacgtctacacgcgcatccggcagaagtccgtcgacctgcgccggattgtcgccaccgccttagaccgcagccgcaagaaataccagctgcaggaaaagcagttaaaggacaccgaaaagcgcgacaggtacaaagtctacggcgaactgatccacacttacggctatggacttgcggagggcgcaaaggaactggaggcgctcaattactacaccaacgagatgatcaaaattccgctcgacccgatgcttgacgccaaggcgaatgcccagaaatatttcgacaaatacaataagttaaagcgcacgtatgaagccctcacggatctgaccgcggagacacgcgccgagatcgagcacctggagagcatcgcaacctcactcgatattgcactcacggaagatgatctcgtgcagatcaaggaagaactgatcgaatacggctatatccgcaggaagcgcaccgacaagaaggccaagattaagagcaaaccgttccactaccgttcctccgacggatatgacatctatgtcgggaagaacaattaccagaacgaggaactgacgtttaaattcgccaccggcaacgactggtggtttcacgccaagggaatgcccggctcccacgtcatcgtaaaatccggcagcgacgaactgccggaccgtgtctttgaggaggcaggaagactcgccggctattattccaaaggcagggacaacgacaagattgagattgactatctccagaaaaagaacgtaaaaaagccgaacggcagcgcgcccggctttgttgtatactataccaattattctctgaccattcatccggacatctccggtctgaccctgatcgagtaaaagcgccctaggcttcgatcagtcctgctctgcgcatctcagtataagcgagcaggaacgggccgacgccctttgcatcatcttttaccaccggctccgacatataataatcgtaggtgccggagcgcatctgttttccgccaagtccggcaaccaggcagatgccgtctaagtgcaggcttccgtccgcatcctcggagagatatttctcacagatgccgtggaatgcctttgcaccatatgcctgataactctccggcagaaagcccaggcgcacgcccttgagcagcgcgtatgccatgatcgagcttccgctggtctccagataattcttctccatacctccaaaattcacaacctgataccacattccgctggcatcctgatactttaacatggcatccatcaaatccacaaacacctttttcaggcgctcatatggctcgccaaccgacgcatccgccttgtctaacgtatcaagaagcgccatggaataccagccgagcgctctcagccagaaattctggcttaatcccgttaccttgtcgcaccagaacatctctctggaagaatcgtaggcatgatagtacagtccggtcttcggatcacgcatatgttccaccacattgaaaaactggcggaaaatatcgtcgtagttcttcttctcatgaaatctcgtctcatactccatataaaacggctgacacatatacagtccgtccagccagacctgattcgggtaaatattcttgtgccagaaatttccctcgccggtgcgcggcatctgctcgatctggctgtatacaagatcaatcgctttgcggtatttttcttttccggtcagatcgtagagttcaaacaaggttttccccgcattgacattgtcgatatttaactcttctaccgaatagccttcaatcgagccgtcctctctgaccttgcagtcgataaaattgtcggcaaagcgaaaatatttctcgtcttttgtgatcgcatacatctcaagaatcgccttgatcatgcatccatctatgtaattccaggtggactttaagccctgcagaatcttctcaatattccagatcggacgatccggggtactcttctccagtaattcgtcaatatagatttctattttgtccatgttctgctcctttatctcggggatttttcaaaaaacatccccttgattatagaagaatttcggaaactatgcaatagatatccctctcttttccagtggtgcatctcactcggcattttttaatgcctgatccatcggaatttttctgatccgcataaagtcaaacatcatcacgatcagataaccgatcagaacaaacgcgaacattttcacatagcccgccggaagaatgacaaaggaaaaccatccgctgtaactgtacatgatcactttccatgcggcattcatcacgagcgcgccaagcaccacgcagattgcatccgccacgatcacaacaatcgtggtcgacagcagataaatgctagcaatctcccggttctcatagcccaggatctttgtcatggaaattgccgtctcattcttctcaatgatgatctttgtgagaagataaattaacaccgcagacagcaggatgcataagatctggaaatagctcatatacgatcccatcgagtgatccagctgatcgcacatttttgtgatgtcccgctccgtgatcaccgtcgcgatattttcatccgcaatgtccgtaatctccgcgtccgagaaataaccgccaaacgcatccgcatcctgctcaaatacctcacggtaattttcgatcggcagaaatatggcaatgctctggcacttgtcaaaaatgcccgccaccaggaaagtatactgctgattctcgtacttttcatccagtgtgatctcgtcacccacattcacatcgtatttgtctgcataggaggcggaaatatatgcctcgttctcttttaaatgagtaagatcatcgatttttacataccggctgtcatcggagatgccgtagacagatacttcctcatcgagtgtatcactcttccgtaaaagagatgtcatgctgaatttttccgcacccggctcctttgttgtgatgacatcgccgtcctcatcctcccaggacgcaagcacatactgatacttcgcgaacatcagatccttggcattctccttgtaatagccgagcgtatccggcatgccgaccgccatcgccagcatgaccatacagaagaatattccgacaaaaaggaccgcataattcgccatattctgaaacatgacgcgcaggcggaaacggctcaaaaattgaaaccgtggcaggcgcatcgcttttttgcgttttgtcttctttaaatcatgccgcaaaaactgtaacggcgtatggcgcatcatccgcgcaatcaccacaaggttcacaacaaacatcagaatcagcggaatcagtgtcgtcttgataaacgcatccggattccatatcgtctcgtaggtcggaaggctgtagctgttataatacatcgaaaccacaatatttttgaacaccgtatatccgagaatgtttccgatcagcgccgcgacgagcgtcacaatgaccggcatcgacagataatgcgccaccagttccccgcgcgtgtaacccgaagcgcggagtgttccgatcgtggacgactccctggctatcgtattgctgattgtaatggcaaaaataaaagcgataatcacaatcagaatatcgagcagcacaccgcccatcgcctcgtcagatcccatatcatccgtcgcaaaatgaatggcagggttcgcatattccggtacataatcctcaagctccgcatccgcgacaaccacctgcgtcagcagggctttcataaaatcatccgacagatttttttctgctgcctcatccgccggctctgtcacatagttccatgcataatcatagtgcaccttctcgtgcaggcgcgcaaatccgtcttccgtcaccatcgccacattgaattttagcgcgtcaaacatcagatccgtacttttttcatgcagtgtggcatagttgacataggcgatcagtcccacgacacgatacgcctctccttggaccgttatggtatctcccaccgcaatgccgacattgtccgcatgcatgcggtccaccacaatctcatcggaagatgccgggaagcttccttccatcagacatgccagattgacctcgtccgtctttttgaaaacgcggacattcccgtccgggacgccgtcgccgtcgtgatcttcctcttcattccggtaaaaattttcaaataaattcaccggtaccgccgcaaaatcaggatcgttcaattcgtatttgtcttccgccttttgatatttttcgtcaatttcatccagaatcttgtcccaggcttcgtcgtaagccttctcgtacgcctcgtcatgtgccttcccatacgcctcgtcataggcggtatcgtaggctttctgatacgcgctctcgtaagcggcatcgtaggcctgctgataacttcccgcctgctttgcctgcgccaccgccgtatctagcatcgctgcagccatggtctcatccatcccctgtgccagcagtgtctgttttacctgcgtcgcaaatgtctggtcgaactgtgtctgaaattccgcattgaatttgcggtcaaattcctccttgaactggctgtcgaattcgtccttgaacttatcctcaaattcaccgtcaaacttctcatccagctcacgctttgccttgtccgtgtaatactgctttacatccgctttctctcccgtggcaatcgcagcgagcagtgtctgatccgcctcctcattcagttcaaaatgtccgtcctccagcttatatttcgtgactccctcatctgcagccttcatcatgctctcgttggcaacgtacattcccgatacaaagccgattgtcaaaatgaggaacaggctcacgagcagatattttctccagtctcccgccagttccctcggtatgcgtctgatcagcggatttcttgtctttttcttcttcatgccggtcacactccttaccattccagatctgccgctgaaactttatccgtgttgatctcattgtgacgtacttccccgtcgcgcagcttgatcacatgatctgccatatgccggatcgcctcattgtgcgtaaccataataaccgtattgccgtattttatattcacatcctcgatcagctttaagatctctttggacgtatgataatcgagtgcgcccgtcggctcatcacagagcagaatatccgggttcttgacgatcgcccttccgatggatactctctgctgctgaccgccggagagctgattcgggagcttgtatctgtgctcataaagtcccagcgtatgtaacagttcatcaatatccagcgcatgatcggacagatacgcgccgacctcgatattttcctttacgttcagattcccgatcaggttatacatctgaaagacataaccgagatgcttgcgccggtattgcgttagtttcttctcactcatctcctccagcttatcaccgccgatcgagatataaccggaatccgcactgtcaatgcctccgataatattgagcagcgtcgatttcccggagccggacggtccgagcagcacgcagaactctcccttcgccacggaaaagttcatcccgcgcaatacctcctgccgtgtctcgccgcttccaaatccctttttcagatcaacaatttccagaaatttcttttcttcctccgacataatctcctctttccggaacatccccatgcaggaatattcctgtttcctttttgcaggcagctgttagttttaactaacttttttcacattatatcatagtcccgcaagattgcaagagccaaaccgcagggaagcctgtagaaaaaatggaagctttttcctgtttttttgacaaaaactgcatgtttatctctcttaaattctcacatactattcctgaacaaacgcagatggcgcaagttcagacgaagtctgtgacccaaaagtctaagacagacaaagtgatcataacaatgataacaaaggatcattaacacaccaaaggaggaaacaatcatggcaaatcgttcatctaacagagcagcaatccctgaggcaaaaagtgcactggaccgcttcaagtacgaagtggcgagcgagatcggcgtgccgttaaaggacggctacaacggagatcttacctccagacagaatggttctgtcggcggttatatggtcaagaaaatgattgaggcacaggaaaagcagatggcaggcaagtaacccgcccgttgcaaacattccgagaaagagaaaaaataccaaagaaaaagacgggaccggcgcttgcaccggtcccgttttatgtgtgaaattataagctcatctgattctgttcccgcataaggaaagcttcgagataatgccgcaggttctcatgctcaccggacataagatccgggtcttccccgagaagttcgccgaccgcctccgatgcatcccgcagcacggcagcatcctgatagatgtcgccaagtgcaaactgcagttcgccggactgacggatcccgaagaaatccccaggtccacgcagttttaagtcctcgctggcaatccggaatccgtcattggattcatttaaaatctttagcctgcgctccgccgtctttgcgctcgagcagttcaccataatacagtaggactgcgcatcgcctcttcccacacggccgcgcagctgatgaagctgcgccagtccgaaccgctccgcgttctcgatcatcatgaccgtggcattcggcacattgacgccgacttccacgaccgtggtcgccaccagcacctgcacctcatttttcataaatgcctccatgactttgttcttctgcgccggcttcatctgaccgtgcagcagtccgagctggatctcctccgggaaaatctgccggagctttttgacgtagtccgtggcattctccgtctccataccctcgacttcctccaccagaggacagatcacgtatgcctgatgcccgtttttgacctcattttcgataaatgcatacgccttgttccgatagcccgtattgaccacgcagtttttgaccggaagacgctttgcaggcacctcatccaccaccgagatgtccagatccccatataggataatggcgagcgttctggggatcggtgtggcgctcatcaccagaatatgcggatgtctgcccttttccgcaaatatttcccgctggcggacgccgaagcggtgctgctcatccgtgatgacgagcgccaggttatcgtagatggcgcgctcctggatcagcgcgtgtgttccgaccaccatcgcattgggataaagctgcagcgcctcgtatgccatgcgcttctgacgcgccgtcatggagccggtgagaagcaccaccggaatctttaatccaaactcttcgcacaacttctgaaacgtctcatagtgctgtctggcaagcacttccgtcggcgccatgatcgccgactggtaatcattgtgcgcggcatctgccatcgccaaaaacgctatgatcgtctttccggaaccgacatctccctgaatcagccgctgcatgacataagggcttcgcatatcgcgcttcacttccgagagcgcccgcttctgcgcgccggtcagctcatacggcagcctggcaatcagctcatcggtaaaagaatcctcccggagttcaaattcgttggcttccttgatccgcttctccttgtggtactgcatatttaaaataaagagaaaaaactcatcaaacacgagacggttgcgcgccgcgatcagcgtgtccatattttccggaaaatgaatctctttgatcgcataattgtactcgcagagtttgtagcggctgcggatctcccggggcagatattccttaaacagttcttctctgccgagcaccgagcgcacggtctttgtgaccagattgttcgagattcctccagtcaggccatacaccggcaaaaatgcctgctccatggcggcgtacgcttccccggaatagatggctgcctgctccatcacaagacggctgcctttgcgcgccaccttcccgtaaaatacataggtattgcccggtgcaagctggcttttgatgtatggcatccgaaaccacaccagttcaagttccgcctcatccgtgccgatggtcgtcaccgtgaccggcatgcttctcgtgcgtctcacaacgggtgtctttctcaccctgccgagtaccgccgccgtctcgccgtccgtgacctccgccacctcttttgctaccgggaactgcacatacgtcctcggataatgaagcagcagatcccccaccgtttcgatatttaatttctggaacagggcggctgtcttttccccgattcccttgatctctattatggatgtactctgattcatactctgtttcctttagaaaaaggctgccgcaccgtcaaccgcctcaagcgatgtccgtgcagcagccctgcctgtgcttatgttatttacacttttcgtcttactcgacggagatcacgtaataatagatcggctgtccgccatagtggacttccacctcgacatccggatgcgcctctgtgatcttttcaccgatcgcattcgctgcatcttccctggcatcctccccgtagtagatgctgacaatcgccgaatcctcatcgatgagctgttcgatcatatccaacaccgtagtctcaagctccttcccgacagaaaggattccctgatcgccgatgcccataaaatcatcctgcttgatctccttgtcatcgatcacggtatcgcgcaccgcataggtcacctgaccggtctttaccgtgccaagctcctcgctcatgcgctctgcattctcctccggtgtgctgtccggaatatagttgatgagcgccgtgattccctgcgggattgtcttggtcgggatcacgatgatctttttgtcctccacaagagaggctgcctgattggctgcgagaataatattcttgttattcggaagaataaagatattcttcgcgttcactttttcgatagcgtttaacatatcctcggtgctcgggttcatcgtctgtccgccctcaataatgtagtccacaccaagtccctgaaagatctcattgatgccgtcgccgatgctgacagagataaagcccatctccttcggaggctcctgctcctttggtacttcctcgccttttaactgcttctccacatcctcgatagtctccgactgcatctccttttccttgagtgcagagatcttctcgtcacgctctaacttcatattctcaatgatgatcgtcgtaaggcttccgtaagtcagaccgcgctgcattgcaagtcccggatcattcgtgtgcacatgcacctttacaatctcgtcatcagcgacaacaacgatcgaatcaccgatgccctctaagtactctttgaactccgtctcctgtcttgtggaaatcggcttctccaacataatcaaaaactgtgtacagtacgcaaacttgatctcctgagccgcctgtgcctcgatattgtaggaggtgcttcccgtctcggccgccggctgcttctccggtgcctcaatcgagtaatcgatctccttgccctgcagggaatcaagcgcacctttcatcacctgcatcagaccctgtccgccggaatccactactcctgcctgctttaataccggaagcatatccggcgtcatgctaaggacatgatccccctctttgatgacttcctcgcagaacgcaagcagatcggtcgtctcctcctcactcagttctaccgcacgtaccgccattcctttggcaaccgtaagaatcgtaccttccttcggcttcataaccgccttgtatgcggtctccactgccttctcaaacgcatcggacaatacctgcacatcaatctcatcatactctgcaataaccttggtaaatccgcgaaacagctgggaaagaatgacgccggaattacctctcgccccgcggagggaaccggaggaaattgcctttgcaagtgacttcatgtccggctctgccatcgccgccacttccttcgcggcagacatgatcgtcatcgacatgttggtaccggtatctccatctggaaccgggaatacattcagttcgttgatccactctttctttgcttccaagtttttcgctccggccagaaacgcttttgcgagagcctcggcatttatcgtagtgatctccacctcaaaaatcctccttaatcaatcactcgtacgccttcgacgtagatgttcattttcttaatttccattccggtaaacgcctcgaccttatattttaccgtctcgatcagattatcggataccgtgatgatgctgaccccgtaagatacgatcacatgaaaatcgatcgtgatcttgttctcctcatcaatgacgacattgatgccgtgtgtgagataatccttctttaacagcttcaccagaccgtccttcatgttgactgcagccatgccgacaattccaaaacattccactgcaaccgatcctgcatacgttgcgatcacttccggatctattgtaaccttgcccaactgggtctccatatgtccattcatataatacgatgctcctttcaaagccatattaacgctagtttattgctattataaccgctttttgcacaaattcatagccctgttttttgaattttatattttttttaaattttgcttgcaatatgtactttcttctgatagaataatcatgttgtgagcctgtatgctatacaggttttacctgtagaatgtgcgggcaagtcctgcatcaccaggataaaatatgcaaggaggtgcaaaatcatggcaaaatgtgcagtttgtggaaagggcgctcatttcggtaacaacgtgagccattctcatagaagatcaaatagaatgtggaagtcgaacatcaagcgtgtcagctgtaaagtgaacggaacaccgaagaagttatatgtatgtgcttcctgtttaaagtccggcaaagtagaaagagcttaggaaaagtaataacatctgtttcagtcctgctgattcagatgttatttttttctcttccctactgtaattttaaaggcggttatcccaaagataatcgccttttttctgcttttatgcaaaatcaaacagcgacagctggttcgactccggcagttcgccgagcagtcccagatctgccataagatcgatgaccgtcttggtcgccttggtgcgctgcctgaagtcgtccttggacagaaacttgccatccttcgccgcctcggcaaccgcaatcgcagcattgtcacccataccgtcgatcgtgtttaacgccggcatgagtttgccgtcaatcacctgaaaacgatccggctttgcgcggtacacgtcgatcggcgtaaaatcaaaccctctggcatacatctcctgcacgatcttcatatcgcggtaggtatcctgctcctttttggagagtgaatcctttctccgcgtgtaatccttgtaaaaatattcaagacgctccttgccctgacacatgatctcgtagttaaatcccgtcgcacggatcgagaaatatgccgcatagtaagcaagaggataatataccttacagtaggcaatacgccatgccatcataacgtatgccgccgcatgtgccttcgggaacatgtacttgatcttcagacacgaatctatgtaccactccggcacatcatgcgcacgcatctccgtcttccactcttcctttaagccttttcccttacgcaccgactccatgatcgtgaaggactgctcactgtcaagtcccttctggatcaggtagatcatgatatcgtcacgggtacagatcgcggtggaaatcgttgccagtccctgctcgatgagtgtctgcgcattgccgagccatacgtccgtaccgtgggacagaccggagatacggatcagatccgagaactcctgcggcttggcatcaataaccatctgcatggcgaaatcggttccaaactccggaataccgagacatccgagcggaattccatgaatgtcatccggcgtcacaccgagtgccgatgtattcttaaataaggacatgaccgactcatcgtcaagcgggatcgttgtcgggtcaattcccgtcagatcctgcagcatacgaatcatcgtcggatcatcgtgtccgagaatatcgagttttaacaggttgtggtcgatcgagtgataatcaaaatgtgtcgttaccgtcgctgtcgtcatatcattcgccggatgctgtaccggcgtaaacgtgttgatctcctctcccaccggaagcacgacgattccgcccgggtgctgtcccgtcgtcctgcggacgccgacacatccctgcacaatacggtcaatctcacagttccgcttgtggacaccgcgctcctcgtagtaattcttgatgtatccgaacgccgtcttgtccgccagcgtaccgatcgttccggcacggaatgtctgaccgtatccgaaaataacctcacagtaggcatgcgctttactctgatattcaccggaaaagttcaggtcgatatccggctccttgtttcccttgaatcccaggaacgtctcaaacggaatgtcaaacccgtcttttaccagcttcttgccacagaccggacagatcttatccggcatatcacatccgcttcgcccggagaacgctttgacctccggcgaatcaaagtcgctgtacttgcagtaggcacagcggtaatgtgcctgcagcggattgacctccgtgataccggacatggtcgccgcgaacgaagatccgaccgaacctctggagcctaccagataaccgtcctcgttagacttccacaccagtttctgtgcaatgatatacattacggcatagccgttggaaatgatggaattcagctcacggtccaatcgctccttcacgatggacggaagctcctcgccgtacatgctgtgcgccttggtgtagcagatgtcacgcagcatctgatcggaattctcaatgaccggcggacacttgtccgggcgcaccggtgcgatcttctcacacatatcggcaatcttgcccggattcgtgatgacaacctcctccgccttggtgcttccgagatactcgaattcctttaacatctcctccgttgtccgaaggaacagcggcgcctgatcatcggcatccttaaatcccttgcccgccatgataatacggcggtatacctcatcctccggatcaagaaaatgcacgtcgcaggtggcgaccaccagcttgttgaatgtctcgcccagctttacaatccgccggttaatatcctgtagttcctcgacggagttgatggcgctcttctcatcctgcagcatgaagctgttgttgccgatcggctgaatctccagataatcgtaaaacttcacgagacggataatctcctcctccggtctgccgtctaaaatcgcacggtagagttcgcctgcctcacaggcagatccgagcagcagtccctctctgtactttacaaattcgctctttggcacacgcggtgtcttgtgaaaataagtcaggtgtgacatggagaccagacggtagagattgatgcgtccgatatcgtttgtcgccagtatgatcgcgtgatggctctttaactttttcacaagttccggcgacgtcgcgcccatctggttcacatcgtctaacgtctccatgccgcgttcatgaagcatctcgataaacttgacaaaaatctccgccgtacatgccgcgtcatcgaccgcccggtgatggtgatccagcgatacaccgaccgcctttgccacggtatccagcttgaaacggtttaactgcggcagcaggattctcgccagcgccacggtatctgcgatggtaaaatcaaacggcagtcccatgcgctcgcagttcttgcggatgaatccggtatcgaactctgcattgtgtgccaccatgacggttccctcgcagaacttcatgaattcgggcaggatctcctcaatcctgggcgcatcgagcaccatgtcatccttgatggacgtcagctgctcaatattatacgggatcggcacctccggattgacgaaggtcgaaaaacgctccgtgatagctccgtccaccaccttgacggcaccgatctcaatgatcttattcttatccggcgaaagtccggttgtctccaggtcaaatacgacatagctgtcatttaagctctgtccttttgagtcaacgataatatccttcaggtcatccaccagatacgcctccacgccgtagataatcttaaaatctgaatccggcggaaccgcatggttcgcgtcagggaaagcctgtacatcgccgtggtccgtgatggcaatcgccttgtgtccccacttcatggcgcgttttacaatatccttgacatccgagacgccatccatatcgctcatcttcgtatggcagtgcaactccacgcgcttctccgggctggtgtctgcacgtgtggacgtaaaatccgcaatctttttgatgccgaccacagaaccgatcgtaagctcactgtcgaacttgtcgatcgtcgtcacacccttgatctttaaaaacgctccctttgcgagtcccccgtcaagcagttcctgcagctgatcgtttctggtaaagatttttaacacaatcgaatcggtaaaatccgtcacggacataatcacgatcgtcttctcattccggatctctctggtctctaacgtcatgacctggcagcggatcgtcacctctcccatctctcccacaatcttctcgatcgcgatcggttcatcctcaaaatcacgcccgtagatcacatccggattgtccgactttttaaagccgccgccctcgaatctgcgcttgaattccttcttccctttttcgccatttcctgcagtttttcctgcatgttccgcaggttttgcagcattttttgcagaagaaacggtatttgtggtggcattgccgcctgtaccaccagatgttgttgtgccatcggaaaccgcctcggcaccgccttctacgaccgccggcacactctccccgtcgtcattgcggatatgtacctttttcatgatgtttttaatctcaaactgaatctgcagatcactgtttttcttatatttgctctccttcggctcctcataggcaagctccaccgccagatcgagtccgcagcgctcacagatcaccttctctaaaaactccacgatctcatgggaacgtgtctgtgcgataatcgtgttctccagcgtgagcagcatgtggctttcgctcgtaaactccatcttcgccgtccgaagaagattgtattccatcaggctgtaatctttcagttcttctaaaatgctgtcgcggtacagatcaagcagcttttccggcgtatactgttccgagagatgatacttttcaatgaccttgacctgcatcatcctgcccttaaaaatctgttgtgcaatggcagattccaactggcggatatcttttttgtgaatcaaacgcgtgctgcttaaatagacgcgcagatgatcgcgctcatgattcatacccaccttcgttacttccgtctccgtcagcagatttttcatgtcgccttctaccttcagtgatggaaatacatcaaaaaaccgttttgccatgcccttttctcacttcttcctcagtctgttctacttctgctgctcattccagtgcagcagctcatagcgcaatgcctcaagcagttcgccctccggcacctttttatatacttccccgttcttgatcaaaagtccctctccgattcctccggcaataccgatatccgcttcctttgcctcacccggtccgttgacaacgcagcccataaccgccaccttgatgtctaacgggatgtctgccaccatattttccacctggttggcaagcccgatcagatcgattctggttctgccacaggtcggacaggacacgacctccacgccgcctttgcgcagccctaaggtacgcaggatcagcttcgcggacttgatctcctccaacgggtctcccgtgagcgatacgcggattgtatcgccgattccctgatgcagaatgagtcccagcccgatcgaggatttgatattgccgctgatgatggtgccggactccgtgatgccgacatgcagcggatgatccgtctgtgtcgcaatcagctcgtgtgccttcacgcacatcatcacatcggaggatttgatgctgatgaccagattgtcataccccatatcctcgatcagatgtactttatcgagggcgctctcgacaatcccctccgccgtcacaccgtgatatttttccacaagatctttttccagagatccactgttgacgccgacacggatcggaataccgcgctcttttgcggcatccaccactgcgcgcacacgctctgtacttccgatatttcccggattgatgcggatcttatccgcaccgtgctcgatcgcggcaagcgccaggcggtaatcaaaatgaatatctgccacaacgggaatgctcacctgctttttgatctcggtcaatgcctccgccgcctccatggtcggcacggcgcagcggataatatcacatccggcagcggtaagcgcctgaatctgcgccacagttgcagccacgtcctccgtctttgtatttgtcatggactggatcaggatcggattgcctccgccgatcacccggtcgccaattttcactacttttgtcatctttttgcctttctatccgaacagcttgcggatatcgttaaaaaatgtaaagaacatgagtgcaaacaacagcatcatgccaataaaatgcaccatgccttccttgtcgggatcgacgcgctttccgcggatcacctcgacaatcagaaacaatagtctgcctccgtccagcgccggaagcggcagcagattcatcacaccgaggtttgccgataagaagatcgcaatataaagcatctgcaaaaataccatataatagccgtacgtcacgctctgctcatagctgtccccgatcatattgacgatcccgaccggaccgctcatgtcattgacgctcacctttccgcccaccagagacttcaggctgtcaatcgtcacccggatccagtattccacctcatatacgctgtattttaaattggaaagcacagaacctttcgtcttttgcgcgcttccctgaaagccgtacatataatagccgtattcttcgttatatttgggcgtgagcaccgtctgatagcgttctccgtcccgctcataggtcactgtgaccgcgtccccggaatgaaactgtgtgtaggcgctgatgtcccggaaaaaatgtatccgggtgtgatcaatctttaagattgtatctcccgcctgcattcccgcctcctcggccggatatccctccgtcactccggcgagcaccggcagatcatagccgatattgcataacagaataaaagcaaagacaaacgccatcaggaaattgaataccggcccggcaatcaccacactgatgcgcgcccagactgattttttcccgaacgccctgccgtcctcgctctccgtatcctctccctccatcatgcacgctccaccgatcgggaacagatgcagggagtatgtcgtctctccctttgtgatgccaaacactttcggtcccagtccgagacagaattcattcacccggattccgtttgccttcgccagaaggaaatgccccagttcatgaaaaataataataagactgaatatcagaattgcgataataatcttcatgcaaaaacctttccccatttgcctgcaatgtgttcatatgcggctgcctccgtctccaggatctcatcaaccgtcggattggcaataaaatcagctgcctccatacacgattcaatcatctccgggatctgctgataggcaatatttcgatccaggaaaagcgctaccgccttttcattcgccgcattaaatgccgtcggaatattgccgccgcggcgcatcgcctgataggctaacgcaagaccgcggaacgtctccgtgtccggtctctcaaacgtcagctgtcccaatgcaaacagatccagtctgtcgcccgagagcggtctgcgcttcggataatagagcgcatactggatcggcagacgcatatccggtgtgccgagctgcgcaatgactgcgccgtcctcatactgcaccgcagaatgaatcacactctgcggatggacaaccacctcaatctgctccagttccacatcaaacagccactttgcctccataacttccaggcctttattgacaagcgttgacgaatcgatcgtgatcttgcgtcccattgtccagttcggatgacgcagcgcatcctccacctgaatgtgtgccagatcttccggctttttcccgcggaacggtccgccggacgccgtgagaagaatcttcgcaatgcggttcccgttttctccctgcagcgactggaaaatagcgctgtgctcgctgtcgaccggcagaatcggcacgccgcatttttttgccagcggcataataatatggcctgccgtcacaagcgtctccttgttcgcaagcgcaatctttttccccgcttcaatggctgcaatcgtcggtcttatgccgagcatcccgacaatcgccgtcacaaggatctcgctctccggctgtaccgccacctccagaagtccatccatgccggacaccacgcggacattcagatccttcgtgcgatcgcgcagttctttggcggcgtcctcctgaaaaacgcataccagcagcggatgaaactctctcatctgctcttccagctttttgatgttgcttccggccgcaatcgccgtcacctgtatgtcgccctgctcccggacaatatctaacgtctgtgtcccaatggagcctgtcgatcccaaaatagctatcttcatcataggtctctcccaaaattacaatacaatcaaattagcggcaaggaaatagatgagcggcgccgtaaaaatgacgctgtcgaaacgatccaggataccgccgtgtcccggaatgagttttccataatccttgatgccgtaattgcgcttgatagcggaagctgtcagatctcccaccatggataccagtgcgcccgccgcactgatggctgccataatccagacatgtgacatttcacttcccatcgccccgcgaaataccatgccgtaaatcacggtgagaagcgcagctccgatcacacctcccacggcgccctccacagactttttcggactcagcttcggcgtcatcttatgcttcccgatcagcatgccgacacagtacgcgcaggtgtcgcatccccaggaacacaggaaaatcagccacacaatgtaggttccggcgctaagcattctggtctggtacacgtaggacagcatcactgccacatagaacacgccgaaaaatgcggcaagaagctgctccgtctgatacttcgggtaggtaaacacatacacgaacatcaatacgatcagaaggcctaaaaccagcatcatcagatccggcaggaagccgaagcgcagattcgcatagtagacggccgccgccgcatacccgacaatgccaggcgcagacttctcaatgtgaaaaatccggtataattcaaacattccgatccaggaaatcagcaatgtggacaccagcagcacatccccgccggtaataatcaataccaatgcggcaatcacaagaacgattccgctcaataatctcgttttaaacatatctcctccatccggcagtccgtcctacttgttgtccgtcaaaccgccaaatcttctgtctcttttattatacgcttcaatggcacgctctaattcctctttgtggaaatccggccacggcacatcggtaaagtaaaattcactgtatgcgagctgccaaagcaggaaattggacaatctgagttctccgcttgtgcggattaaaagatccggatccgggatgcctgcggtatccagatactcctcaaacacgctttctgtgatctcttccggctttctcttccccgccgcaacatcctcactcatgcggcgcattgcgcgtgtcatctcgtcgcggctgccgtaattgatggcaatctgaagattcaagccgtcattttttgcagaggcagcctccagttcacggatgcgctcctgaaagcgatcactgagtcttgtcgtatcgccaatcacgcgcacgcgcatattgtttttgtcggctgtcttaatgcagttcttcagatagctttccaaaagcttcatcagcgcttccacttcgccctccgggcggttccagttttctgttgaaaatgcatacatggtaacatactttaccccgagatcatgcgccgcctggcacaccgtctcgacattcttggctcccgctgtatgtccgtaatttcggggcattccctttgcctttgcccatcttccgtttccatccagtatgatcgctatatgctgtggaatctttcttcccgtctccatacctgtgcttctccctcgtctctgtactgaagtatcaactatacaaaataacggaaaagatacagatgtatgcctccataaacacctgtatctcctctcgtttcaaatctatccaaactatacggtaaggatttcctttgtctttgcctcaacggcacgatccacatctgcgatgtacttatcggtcatcttctgtgcctgatcttccagctgcttgatctcatcctcggagacatcctccttggcaagctttttaaaggaatcattggcatcacggcggatattgcggattgcaaccttcgcattttcgccctttttctttacatcctttgcaagttccttacgtctctcctcggtaagctccgggaacagaagacggactgtctttccatcattcgtaggattgattccaagatcggaagtaaggatcgccttctcaatctcctttaccatggatgcctcccacggctgaatctgaatcatacgcggctccggaacactgacattcgccacctgctgaattgctgtcggagtaccgtagtaatccactctcaacttgtcaagcacatgcggattggcgcgtcccgcgcggattccgccgaactcctccgcaagattgttcattgttttgcccatcttttcatcaaataccgctaatctctgatccatatatataccatgcctttctatcaattctaagaaaccgtaaccttcgtgccgctaaactctcccgtcatggcttttacgatactattctcttcattcagtccgaatacatacatcggcatccggttctccatacacataatggaggctgtcagatccaccaccgcaagcttcttgtcaattacttcctgaatagagacttcatcatacttcactgcgttcggattcagcttcggatcactatcatacacgccgtcaatcgcttttgcgaggtagattccgtccgcctccatctcaatcgcacgcagaacaattcccgtatctgtcgaaaagtatggatgacccgttccccctgcaaaaaacacaaccattccctttgcaaaatacttattcgcacgatccttggaaaacagctttgtcatgcttccacactcaaaaggtgtcagaatctgtgtctgcatgcccacagagcggaaaatctctgaaacatagatgcagttcatgatcgttgcaagcatgccgatctgatccgctttggtgcggtcgatcgtctcgctggtgcgtcctctccagaagttgccgccgccgatcacgatgcctacttcggtaccaccacccacaatctgctttacctgttttgcaacctctgtgactgtcggctcgtcaaatcctgtgtgcttatcacctgcaagcgcctcaccacttaactttaacagaactctcttcatgatgcttagtttcctttcttggcattgaacaggctctgaacatccacatctgcatagcactgggagcagaatccctcaatcacagcgccgttgttgatctgaacagaacgtgacttgatgttacccataaccactgcggaagtatccacaacaaccggtccctgcacatcgatgtcacccttgatggctcctgcgatcactgccgagttggatgttacattacctataattacagaaccaagaccaatcttaaccgtaccggagcttacgacttcaccctctacctgtgcagaatccgcaaagaattcggaagtgttgctgttaccattgacaacacctgtcacggtaagctttccgttgcaacttacatttccgtctacctgacctctgatgtcgagagatccgtttgagatcacatcaccgttgataatcgttccctctgtaatcacggaaacctcgtccgatacaatcggcttctcctgcggtgtggtctgcgatgctgctgtctgtgctcctgtctgtgctacctgtactggtgttactgtattatcagccattttcttctcctcctgtgctgctgccattgcatgctgtgtgtattcttctcttgttttctgtggttccaccgttgctgcctgtgtccgctccaaagccggctcctgcttcgttacctgctctaacagaccatccagcttcgacaattcgctcgccacatccacttcatcttccagtgtgttcacgaccatgtcatcatccttgtccgtgctttcgagattgtcttctcccggcataagttcattcactgcctgtgagaaatcatccttaaagtccttgaaaaatcccatgttcttacctccatttataatctggtcatctggcactgtcggctttgacatactggataacctgtgtatcttcatcaatcggtaaaatctcggcatccatatcctgcaatgcctcgatcagcggtcctaccgcttctaccgttgttgacctatcttccgagtcgtgcaaaagcacaaccgaggtcttgtattttgaaacatctgaaacaacattctcgaccagttcttccggtgtatatgcagcatttgccgcatcgcctgccgagacgttccagtcgtaataaacgacgtcctcgctgtttaaaaaccggatcagcgaactcatcggcacattgctgatctgattgctgctcccgcccggaaaccggtaatagcggctcttttcaccggtcacctcatagagataatcctgcagctgatgaaaatccgcctcgaacgcatcctccgactgatagatcagactgtacttattagaataggaatgcattcccagcgtatgcccctcatccacgatcctctggtagatggctgccgatgcctcatcctcttttccgaccacaaaaaaggttgccttgacatcgtactccgacagcacatctaaaatggcgtccgtattctcagacggcccgtcatcaaacgtcagataaactttatgtacatctccatcctgtgccagattgtctgtctcgtcgatcccggatgcaggtgccgtcacagccactgtctccgtatccatgccgctggtctcttcctggggtagtgcctccgtatccggcacctgctggttcatcacccgctgcatctgccagagttcatctaactttctctccatggatctcgtccggacaagcagaaaaatgatcagaatcatggacaggatgatccacccggcaattatcgcgattatggtatgtttcattcttgcaatccgctttctccgcctgcgttgattgcggagtgcctcagaatccttatcctgcatgtagaacccccaagttaatcataatactttatctattgtatcacatttttgtatttttcaaagaaaaaagcgcaaaaaaatcgtatgatttttctacactttttcatgtattttctgaatttttatgtttctcccgctaaaagcccggtgaccaccgcccccacactaaacagcatcacgccccaggcgatgacagccggcgatgtcccgcgcagcgggattttccctaatatggcaaccggggacgccgccagcagcccgaaaattgcccagtaggtcagcctctcaaacctgcagagcagatattccatcagctttgcgacaagaaaaatacctccaagcacgccgcatccgaacgggactaataggacaagacagtaccacgccgtcccggcatccagcatgaccaccgccacaacgaacgcattgatatggtcaatgaccggcgtgtaatatccgagcgccatcaaaagcatcgaaccgctcacccccggaatgaccatcgtagccgcggcagccagccccaccgcaaaaagcttcactgccgtcccaggaccggcggcaagaacctgttcgctgccttttccaaggaactgcattccaatcatcaggcagaagaatcccaaaaacagtgccagctccggcaccttcggatatcccctggacaccttgcgccagatgagcggcacgccgccgaaaatcagtccgataaaaagcatcgcggtctggaacggaaaattctcaaaaagataaccgatcataaaggaaaggcagataattccgatccccattccaaacagatacggaaacagctttaagatgctttcctttttatgacgaaaaaaaccggtgaccgcctgcagaagttcatcataaatccccagcgacaccatgatcgtaccgccgctcactcctggaactacattggcgattccgatcgtaattcctcttatgacattctttatgaattccatacatcctccacttttttgcatgctgcctttctctgttccgccgcaagcgattcgctcttcttatccggaagaagatgctctgccatccctgccagcagatttccggccggaagcaaaagcagggtcgttccgatattaaaaatcgtatgcatgttggcaatctgggcagccggtcgtcccggtgtcagctgcgcaaccagcgaaacgagcggcgttgtcatgcacagcacggtaaacaccaccgttccgatcagattgaacgaaagatgaatgatcgtcgtgcgcttggcgttccttccggtgcctatggcagccagaaccgccgtaatgcatgtgccgatattctgaccgaacagaacatacaccgcccccacgaaagatacagctcctccctgtgccagagtctgcaggataccgaccgaagccgaggatgactgaatggctgccgtgaacgccgcgcccgccaggattccaagcagtggatgttcaaactttgtcattgcctgaaggaacacctgcgaatcacagagcggctgcatggcttcccccatcatatccatgccgataaacaggattccaagccccgccacaatctcgcctgtgtaccggatccggtcttttcccgcaaacagaatcagaaccacccccaaaaaagccagaagcggcgcaacggctcccgcatccagtgcaatcagctgaccggtgattgtggtgccgatatttgcccccatgataatccagaccgcctggcgcagagtcatcatcccggaattcacaaagccaacgaccatgaccgtggtggctgaggatgactggatcaccgccgtcaccgctgctccgacgcccacgccaaggaagcggttctttgtcagccgctccaggatctgcttcatcttctcacctgcggcagcatttaagccctcgctcatctgatgcattccatacaaaaagagtgcaagcccgcccagcagtgcaaaaaaatttctatattccattttcttcttttcccttttcttatcctaatcttatgacgcttctgatacctgtgataaccaaaagggcaaatcttttttaccgtcggaattgtgcacaaaacgcaccatgcggtaacctgccaggcagatgcacgccgccgtgacggtaagcactaccgcctctgcatagggaatctctgctattttgaataaaacagcagtaaaaagatgaaaaaaaagacgctgctccgccgccccggtcatttttctcatcacgacaatcatactctgtgacaatcctgcttccggttccgctgagagcgcgtttgagacataatcggagtccgtcgtccgtaaaataccctgtgcttcccctccgacctctgccgtcagattctgcacctgggcgatctgtgtctgccacagacagacaccaagatgggaaaacagcagaaccgccatcatgcaaaccgcaaaaaatgcttttcttctatctgcactgcgcatgttccctgctcctttcccattccaagactctttcctcacgatagcaaagcacttacgacttgtcaatagatgcggatatattttccataaacctgcgcagtgtctgttccgtcgtcgcaatcgcttcctccggaataccttcggccagcctgcggaaaaacgcagcttttttctccgtcatctgctctgtgagcgcactgcattgctgcgtgagatataaatggcagattctcttatcggcagcatcccgttccaccacaagaaactgcttttccacgaggctctccaccgatctggcaaccagtcccttggacaccccctcgtactgcgcaatatcccgcgccgtattgcatccgccgttgtcgcgtgccaaaaaaagaagcaccagcaattcgttcggcgtgagatgatatttctccatctcatcctgaaagtatttccggtatgctttctctatcttaaaataattttcaaaaaagtcttccagcatattccccctcctttccgccggttcatgccttctctttgctttagttgatttgtgaactgtttatatagaaactttatttgaaatctgtataaaagtcaattaaaaaagtgttaagatttcagaaaaatcactccgactcggttgactttctacacaacaaccgataaaataatagttgatttgtgaactgtttaactggtaactctattaaccatattctagaaagtgtgtgatgctattttgaacaaaaaattaaaagagaaattcgacgaatctgtaagcgccgttcttcccattaccgtcattgtgctgttgctcagcatttttgtcgtaccgatggagaccggaaccattgccctgtttctggtcggagcgttcatgctgatcatcggcatggcatttttccagctgggtgctgagatggcgatgacgccgctcggcgaaggtgtcggttcccatatcatgaagacaaagcgtctttcgattctgattattgtctgctttgtgatgggtgtcatcatcacaatcgcagaaccggatctgcaggttctcgccaatcaggttccttctattccaaacgaaaccttaatctggacggtcgctctcggcgtcggtgtctttctggtcatcgctgttttgcgtatcattttcaagctgagcctccccatgctgctgtgtatcctctatgccgcactgtttttgctctcctttgcggcgccggctgatttcatcgcagtcgcatttgactccggcggtgtgacgacaggtccgatgaccgttccttttattatggccatcggtgttggtctctcctccacgcgaagtgacaaggacggctcgagcgacagtttcggtctgatctccttctgcagcatcggaccgatcgccatggtgctcctgctcggtattttctaccatccagccggcgcatcctacaatgccaccgaaataccggatgttgtaaccatgcaggatgtcatgcgccagtttgtacatatgctgccggactatggcagggaagtcatttcttccatccttccggtactgatcgtctttttactgtttcagcttatttccaggcgctaccacaagaaccagatgatcaagatgcttatgggctttctctacactatcatcggactgatcctgtttctgaccggtgtcaacgtaggatttgctcccgtcggaagtctgctcggcagcaatctcgccgcacagacatggcgctttgttctgattcccatcggcgcgttaatcggttattatattgtaaaagccgagcctgccgtgcaggtgctcaacaagcaggtggaggatgtgacaaacggttccatttcgcgcaatgcgatgaacctctgtctctccatcggtgtctccgcttccgttgcgctggcgctgctccgggttctgaccggacttaacatttactggctcttaattccgggctacatcattgctctggtgctcacccggtttgttccaaaagtatttgtcggtatcgctttcgactccggcggtgttgccagcggtcccatgacctccacgtttcttcttccgcttgccatgggcgcatgtaccgccgtgggcggcaatgtggtaaccgatgcgttcggcgtcgtggcgatggtcgcaatggcaccgttaattgccattcagatcatgggcgtactgtatcagctgaagcttaagagagcgacatccgacgcgcttatcatgatcgatgtcgacgacaatgccattatggatattgaggaggaataattatgcaggatcataccatgcaacataaaaaaaagatgccggcattccggtgcctcgtcattatcatagattccaatatccgtgataaactgaccgaatttctcaccgatgcctccatcccgatctattaccagatgcacggcgtcggcaccgtcagttccgattttctgaatctgtgcggtctcggcgacacccacaaaaccatcatgttatgcatcgtcccgaaggaacgcacccggatgctgctggcggagatgaatcaggcgctgcagcttcacaagagaggaaccggtatcgctgtcagcataccgttatccggcattcagggatggctctataaagttctcggttccggttctttggactcctccgagccggagatagaaaaagaggtgaaaaaaatgagtgaaacgattacacatgcaatgattcttgtcacaatcaatcagggatacagcgatgatgtcatgtacaccgcgcgcgctgccggcgctaccggcggaacgatcttaaagggtctgcgctgcagtccggaggaggttgccaaacatttcggtatggctctccaggaggagcaggaagtccttgccatcgtcgttccaaaggataaaaagaccgaaatcatgaccgccatcagcaagcagcacggcattgacacaccggcgcacggcgtcagctttgctctgccggtcgacgcaatcatgggactgtagcatttatactttatgacgcaaaaaccttatcgaatcataaccaggttcgataaggttttttcttacaaaatgacccctgcaaatagtgtctccaccattcgtaggggtcattatccttcaacagtttagcacaatatcaaattatgcgttcatctgtgctgcaacttctgctgcaaagtcttcctgcttcttctcaagaccttcgccagtctcaaaacgaacaaatctcttaaccttcacagtaccgccaactgccttggatacttcctcaagatacttggcaacggtctgcttgccgtcctcagccttaacgtaaacctgatctaccaggcatacttccttgagttctttgctgatacgtccttcgatcattccgttgattaccttctccggcttctgggactccttcggatcgttcatgatctgtgctaagaggatctctttctcatgagcgatgtaatcagcgcttacctcgtctctggaaacatacttcggattgagtgctgcgatctgcattgcgatattgtgcattgcttcctttacagtgtcatttacaacatcggtgtctgcatcaacgataacgccgattcttccgccgccgtgtacatacggtacaacacagccatgctcagctacaaccttctcaaatctgcggatctttaagttctcgccgatcactgcaaccttctcaaccagtgcttcacttacagtcttgctggcatcctcattccacttctcagccatgaaagcatccatgtctgctgcatcggaattcactgcctgtgttgcaacagccttaacaaactcctggaatgttgcattctttgcaacgaagtctgtctcagagtttacctcaacaaccgctgctgtctggtcatccttggtcactaccatgcaaagaccctctgctgcgattctgcttgccttcttctcagccttagcctgtccgttctttcttaagaactctacagcctcgtccatgttaccgtttgtctcatttaatgccttcttgcaatccatcatgcctgcgccggtcatctcacgcagttcctttaccatagctgctgtaattgccattttctcatcctccaaaaaataatttatcctgattctttatctttatgccacagaaagggacgtaacacgcgtccctttccgattgttgacatatgggcgatcctgccaatcaggcacccgttgtttccaacttattatgcttcctctgctgcatctgcctctgcggactcagcctcttctgcagtcatctctgcaccctggtttgcctcgatcactgcgtctgccatcttggaaacgatcagttttacggctctgatagcatcatcattgcccgggatcacataatcaagttcctcaggatcacagtttgtatctgcaataccgatcagggtaattcctaatgtatgagcctcctgaatacagattctctccttcttcgggtctacaacgaagattgcatccgggagcttcttcatctccttgataccgccaaggttcttctctaacttctcccactctttcttaagtgcgataacttccttcttcggcagtacttcgaatgtaccgtcggttgccattgtctcgatctcttttaatcttgcaatacggctctggatggtcttgaagttggtaagcataccacctaaccatctctcatttacatagaacatgccgcagcgctctgcttcggtcttgattgcatcctgtgcctgcttcttggtacctacgaaaagaatggtgccgccctcagctgcaatatcagatactgctttgtaagcctcgtctaccttgcctacagatttctgtaagtcgatgatgtagatgccatttctctctgtgtagatgtacggagccattttaggattccatcttctggtctgatgtccgaagtgaacacctgcttcaagtaactgtttcattgaaataacgctcattttcttacctccatggttgaaatcttccatatgcttcatcccacaaggcaaccattcggcaccggcccggtggtcagcatatgtgtattattgtgtggaaatgattttccacgcttgaacctcgcatattatatcacaaacatctttgctgtgcaagtacctttttactcttcaagcggtcccgcctgcagaatttttgcaatttcctcattcgacagaccgtaaggaatatcgtagttgccgacacgcatattggaagcgtagccgatctgcgataaatactgccggaacgtctccgcatcggaaatgactccgttctccgccagcttctcgcagacaatacggcagacatcccctttctgaatcaccagacgatatacgccggacggattctctgcaccagcagcctcctgctgtgcctgcgtctcctcatccgtgttcgcgctatcctcctgcgcctcagctgccacgtcctcagctgcagtttccgtattctgcgcggtctcttctgccgcggtccgttcttccaacagttcggatgccgtctgctcggtcacaacctccgtcttcgctccggtgtccgtgccgtccggatcctgctccgtatcgccctgctctgttgtctccgtctcctgcatgaccatgccaagctgtgccgcccgcgccatgatctcctcatcagacatcttgatctctttctttgaaaaactgactgccagtatcaccgttgtgacaatgattccgatccccagtccccgcaaataatatttcagtttcacgaatcactctctcctctgtaaagcccattgaccaggcgaacttcaccgattccgattccaagcttcttggcaatctgaacctccgtcattccgagttttttcaacttcagaatctctgcatgcagtccttcctgctttgtctcttccgtctccggcatctcttccttctgctctgccggtgcagcagccgtctctctctccgtcgtatctgccgtctcaaccggtaccggtgttactgccgaagccgcagataccgctgcggcacgctccgatgcagcctgcggtgcagtcaaaggtgctttctcctcaaggcttcttacatccgcagccaggcgctgcagatccgccgccataccggtaagctccgtgtgtttatcgttcagcatactgtataagaacataatctcattatgcgttttattcatgctctcgatcaccgtgtcggaatattcactgatcgccatgatcttatcgtttgtcactttttcaagggaacgatccaccttttcggaagactggtcaacctgctcatcaatcgcatcctcaatccgtgtctccgcattcttgagtccccggtcaatgattctctttaattcctcttcgctcaactctgcaatctggttcaattctgacggcgataacttttccgtcacaaaaaagcttccgatcataaaaaccacaccgatcagaagtaatatccatgctactccggtcatatgcttctcctcacctatctatatcttgatatcaaaatggctgccctgcccttttaatatgacttttccctcattctcaggctcctcttcgcggcgctttttgtgcctgccagattcgccctcatattcgttattgcccttttccttggcatcataacgatagccatcgttctccttttcctccggatcctgcacacgatgggtcagctggtcttcgtgcttctgctgttcaatctgaatattctgctgttcgacaatcggcctattatcctcctgctgcttcagattcccgacatcctgcgtcctctgaatcatcccgtttaaaacaactggtcttattgacatgcaacacacctccgctcatctgctactcagtcagaattcccatatagcttcccatctttttgcgcatcttaagcagcgcctttgtgtgaagctgcgacacacgcgattcagacacttccaatatattgctgatctcctttaacgtgagttcttcataataatacagaagaatcaccttgcgctctttttccgtgagcagatccattgtctcggacagaacttttttcagttcttcctcctcaatattgtcctccggctgtgcgaaatgggagttcccgcgcgcatccatcaccggctctccgccctgctccacgaactcattgagagataccacgtttgtgacttttaactgcgactgccactcattcagttcagccgccgcaattccaatctcccctgcaatctcttcatccgccgcagcacgtcccgtccgcgcctcgatatttttgattgcttcctcaatccgcttctgcttctgtctgacagtccttggtatccagtccatcttgcggatctgatccagaatggaaccgcggatacgcaggctcgcatatgtctcaaactttacgtcttttccgggatcaaacttatcaatggcatcgataagtccgaatattccataactaaccagatcttcgtattccacattgtatccaagatacatgctgagccggcccgcaaccactttcacaagcggtgcatattccgtaatcagcttttctctcagcgcagacgatggatttttctggtattctccccatagtttttctctgtcaaccgttttcattggaagcccccacgtctaaagattactgttctttcgcatcggcattctctgtctcctccgatgccgtttcattctcttctgcctcaggatcctcttcttcctgcggcaatgtaccatccgtggtttcctcgtcattcatcccggcaaaattgcggtcaagaacaattttgaccacaccgcccagaaggtaaaatacaatcaggacaatcaaaagcattttcatgaaatctgccacttccatgtgtgcacagatgcccgctacgcaggcgacaaacccggctgacagcatcacaatcgcaggtactgattttgttttcatacttacagcccttccttaaataatcttaagcggcttgcccaccgacttaatataaaattctccggtatcacaatgcagttccactgttctaccataattgagtcctgtatcttccgctaccagccggattccaagttcttttaaaatcgctttggcagcctccgcattcctcgctccgatatttcccacatccgaaagtccgcttacctcaaacatccgcgcgcccccggcaatcttggcgatcagtcttggcttacttgctcccgctgcaacaacacgctttaacaattcccgaattcccgtatctccaaacttagctatattgctgttgtttcttacttttgtactgtcaggaagcatataatgcaccatgcctcccacttttgtcaccggatcataaagaaccagtccaatacaggaaccgagacctaaagtcgtaattacatccggagccttgcaaacgttcaggtccgccatgcctacttttatgacttcgctcatatacgcattctccttatattgagataccaagtgacgttaatattttttcgtaagaatcctgctccggcatcaagatgaaatatccgttgatcgccacatccgcacagatctccgtctgtatcaacaatgcattgtcaccgtactgtccaaattcaatcgccggcacgctcaaaatcgatgctgccatgtccaccgcgatgtatggaacggacggagtgatgacaagattggtcagggaggacaatgcggacagataagatcccgcaatgatattgccgatctcttttaatgcggaaagttccatctcgccaaacggctggtcatccggttcgtttgtcatcatcaacttgttgaccagataacgtgcagacggaatatccagaaggaacatcatgcttccctcaatatctgtctccacctcaaggaaaatgccgacaattgtctcatcttccgctcctaccgccattcccaactgtgatacttccatcagtcggatgctcggtacattcatatcgatcttcatgccaagcatatttgcaatggctgaagtggcatttcctgctccgatattgccgatttcacgcaatacgtccaggtacatgtcattcacttgctctagtgtcatattacccatgaacgttttttctcctctcaacataatatatccatggttttctaagaggaatgtctctggttctctcccgctgcattccctgtagtaaaacaagcaggttagcggaatgtattccattccgctaacctgcgcacacgtctatgcacgcatatgttctgtgtgcttatgcgttgtcatccaccaccgagttaatctcgagaagtgagatcagatcatcgccgtgtttaccgattccattgatgaatttacccttgttggtcgatttttcaatttcatcctcacttaaattgacgacttccttcacctcgtcgacaatcacgccgatcgcgcctttttcttccagctttaagatgatgatacggctcgcgttcgtgaacacatcatcctccagccccatcttgttgcggatactcattacggatacgatctcaccgcgcagattgatcacgcccttaaagtaggactggatcttcgggacacgggtaatcttctgcatacgcacgatgttgtcaatatagctgatatcaattccgtactgctcgcttccgaccattacgacaatatactgttttgactctttgtcaattacttccacgttcttttctgccatgttgtccgcctcctcttacatcagtacattcacatcaaggatcagtgccacttcaccatcgccaaggatcgttgcgccgctgatgatcttgttgttgtttatgtatttaccaagtgacttgataacgatttcctgctgtccgatcaggttgtcgaccacaaggcctgccagattctcgcccttctgtacaatcacaaccgtcaggctctccggctcttcttctttcggctcaatatccagaacctgatccatacggatcagcggaattaccttgccgcggaggtgaatcacttcctgagcctccacatacttgatatccttcaccggaatatcctcgatgttggaaatggaaccaagtgcgattgcgtatttctcatcgcggatctctaccatgagtgcctggatgatcgcaagtgtcagcggcaggcgtacggtaaaggtcgttcccacaccgagctctgtctttacttccacatcgccgccgagagcctcgatgttggattttacaacgtcaagtcctacgccacgtccggaaatatcggtaatcttcttcgccatggaaaagctcggcagaaacagcagattgatgatctctttctggctcattgtctcagcctgctcctcagtgatgacaccgcgctcgattgccttgttgcgcacagcctccacgtcgattccgttaccgtcatcgccaacctggatgatgacattgttgccttcctggaatgcgttgaggaaaatgcttccgacttccggcttgccctttgcaatacgggttgcgttgtcttcaagtccgtgatccgcggaattacgaagcagatgctgcagcgggtcaccgatctgatcgactacggtacggtcaagttctgtatcttcacctgtcatgtacaattccatcttcttgtccagctttctggaaagatcacggatcatacgcgggaattttgcaactacactctcgattggcaccatccggactttcatcacggactcatgaagattggtcgtgatacgctccagatattcaatctgctcatggaaggactggttctggaaatctccggaatcggtggagctgatcgacaccagactgttctttgcgatgataagctcggatacctggttcatcaatgcatccagcttctcaatatctacacggacagtacggtttgtgacaggctttgcaaccgtctgctttttattgccgctgctctgtgtcttcgctgccggctttgctgcctgtgcctgtggctgctcctgtgccggtgccgcctcagccggtgcatcctgagacttctctgccgccgcagcgtccgcttccgctttctcctgctttgcagccagcgtctcgtattttacttcctcaccgacaaccttatcaatctcagataccgactttgcagcttccgcaatcttctcatacggctcgtccgacgcaataaaaatgctgaaatcgcagtcgaacttctcatcctcaatatcctgggagctcggattgtatacaaggatctctccaaactcttccactgccttgaataccaggaatgctctcgctgcctttaacaggcactctttctggatatagatggtcatgccataaatgtgtgcgccgccctcttccgcctgcttgattttatccttctcagactcgctgagaccgaactcaaaatactttttatcatctccgcccgcggtctgtgccggtgcctcttcttttttcggctccgcctgtgcaggtgcagctgctgcgccatcctccgccgcgatgaaatcattcagttccttgatgatcagttcgttgtcctctgttccctcatccgaacttgcctttacgttgtcgagatagccctcgatcgcatccaggcacttgaacagaaggtcaatcatagaactggtcactttgactttctcactgcggacctcctggaacacattctccatgtcatgtgtcaggcgctgcattctcttaaagcccatggttccagccattccctttaaggagtgtgctgcacggaaaatctcgttgatcgtgtccatgttctccggatctttttccagctccatgatgcagtcacttaaattctgtaaatgttcacttgtctcatcaataaaaatctcaaggtattggcttacatccatattactttacccccacattcttaataattgatttagctacgtcattaagaggaaccacttcatccacaacgcccgcctcggcaaccgccttcggcattccgtataccacgcacgacgcggcgtcctgtgcgatcacatagaccggcttcttcccggcaagggaaacaatccccttggtgccgtccgcacccattccggtgagaaccacgcatacaacctgatcgtaaccgcagtcccgcagggaatcgtacgtgatgttggcacacggcttcaagccgccgatcgcaggcatatcgttcaaccggatcctgtgacttccatccggctggcgcttcacttccatgtgcttgccgcccggtgcgatgtacaccgttcctttcatcagcacatctccgtcttccgcctccttgacatgaatcgggctgacctcgtccagtctgtctgccattgacttggtaaatccggcaggcatatgctgaaccagtaccatcggtgcgtccagattcttcggcagatatggaatgacactctgcagcgccttcggaccgcccgtcgaacatgcaagcgcaacgatcttgctgccgctcttgatcgcatgtccagctgttgcaaccggctttgcggtccccgcaggagccgatacagccttagtctgcggtgcgatgcgccgttcgcgattgtaactctgggtcgcgcataccgccgagagcacgtcgagaagctgttttttgaactcctcgccctttgcctcaataacattggttggcttcgtgacaaaatcgactgccccgcgctccatcgcccggatcgtgacatccgcatccttggttgtcgtcgtacttaccatgatgaccgttgcacggattctgtccttctgtaactgttccaaaagctgcagtccgtccatgcggggcatattgacatcgagaacaacgccatcatagcgcgtcgtcttaagcttctcatatgcctcaagaccgtcacggcaagtatctgtgacctgaaatgttccgtctgaattgattatatcacacatgacccttctcatgagtgcagagtcatcaacaatcaaaatctttttactcatatcttatgctctacccctttgacgcgctttgcgttcttcttcaaagatgaaccggatgatttcctcccttacgctgctgtcggtaatcaggaatttggctctggcctcgtagggcgtttccggcgttttttctgtcttgatacaggaaataattgttccaatgatataatattgtttgtctaaattttcattctgcagatgtatctcaaagagaacatactgattctcccgaagcttctgatccgtccgaaaccggataccgccgccgcttagatccacgatccttccggcatattcccggtctctgctctttccctccgcttcctgcagttcaataaatagggcttctcccgtctttaatgcggcttcctgttcctcaatggtgtaataattcatgtccataatacatggaaaccggaagaattctcttctctgatacttggagatctgggattttaattcgatctctaacatgtatacattctctcttttgtagcgctcccgcacctggccgacggcgcggtaaagcgttcccttcgagaaaaagataaactccatccggatgcccagcggaagcagcaccagttttcctctctccaccggcatggaaatctcaagattgccgttctcctttaaatccagcacctggcttttgtagattttcggcatggactggtctttttttgcccgttccacattctgtacgaaactgatgtcaactttatctcccggttgaataatttcagctattgtcatcattccactccttcattcttctgtttccaaaatcccgaaaacaatcttgacagtccaaaagaacgatatgcgtcactgctctcaccctgcagcaattccgcagccactacttcaaatgctcttgcagattttgacaacggtgcctgaagcgatactggtttctgcatccggatcgccttttcaagcgcgctatcctggggaatcatccccgcatatgtaatttccccctctaagaactgacctaccacagtattcagtttgtcataaactcctctgccttccgcagcagatatcacacggttggaaagaaccgatatcttggtgtactccctgttaaacttcggattccggtacagagactttaacagagaataagaatctgtcagtgatgtcggctccggtgttgtgaccacaagaacctccgggcttgccagcacgaactccagtacatgattggcaatccccgcgccggtgtccaccagaatcacatctgccatctgatccagttccccgaaacagtgaagcagataagagatctgttcatcggtcagattgcccagtccggtaactccggttccccccgagacaaacccgattcccatcggaccttccgatatgatctccgtgatctgttttccatgatatatcacatctgccagattgtacttgggaatggcgccaaacattacttcgacattggcaaggccaaaatccgcatcaaaaacaagcaccctttttcccatcttctgcatctgcaccgcaaggttcacagccacattcgactttccaacgccaccttttccacttgtgacggtaatgactctggcatccggcttataattttgtttttttaatttcacaacacttctaagcttctctgcctgatccatgtgttatctgcctcccagcagctgtttcacaatcttttgtgtatcaaatacttcaatatcatctggtacattctgaccgctcgtcatataggataactttgcccccgaatacagcttgatatttaaaatattaccataagtaattgtctcatccagctttgtaaaaatcaacttataatttgctatttccctgtaagtatctgcgatctccagcagatccttatatttggtcgtcgcactgagcacgaggtatacctctttctcgtaagcctcatccagtccgtcgatcagctttttcatatcctggcactgtgcctcattgcggtgcgagaatcccgccgtgtcaacaaataccagatcatattcgcttacgcgcgcaatggcatcgttcatctcctccggcgtatagataatgctcatcggagcatccagaatatttgcgtagatgcgcagctgctctgtcgcagcaatccggtaggtgtccgcagtcagaaatgccactttcttctctttgtctaccttatagcgtgacgcaatcttggcaagcgttgttgtctttcccacgccggtcggtccgatgaaaaaaatcaccttcggctttttgcctgtaagctcaatcgtctgcggctgatcgaactttaagatcagcttctgataaacgttggaaagaatagaatccacactgcttccgttgtgaagcaccttctccgcctcgtccatgatctgattgacatacttctcattcacatcattctccagcagcgtgcggtagagcatcttgataaactggaacccttccgtgcggttctccttttcctgcggctctaccggatgagacttgcgcatctcctccacggaaaactgcttttccagaatattcgacaggttctccagccgcttttccagtccctcattcgtagattcgcgctttgcttctttcataggaacaacctcctgttccgccggtgccggtgccactgccggtctggtgttctctcttgccacccccggaatggtaatcttttcatctgcagccagactgatcgtatcgtgcacaggctttgtctcgctgcggagcgtctgcgccgggaacgcttccttttcctccaccgcagccgtcacctcatacagcgtgttcttaaacatcttaaacatgcccttgggcttaatctccttcacgttcagcacgaccgcccccgcgcccagctcctgctttgccttctcgacggcctcttcctttgtcttgccctgatatttgttaatggtcatttatattgtcaccatccctactgattgtaattctacgttggattccacctcattgtaagacagcaccgtcagatccttgaagtaatcctcggtcagcttcttaaagtacatacgcacaatcggcgatgtcataatgatggcaggcttgcccatgttctccaacttcgccacttcctcctcaacggatgccataatcgccttcgtgcgctccggatcgagcgtcagatatgccccctgctccgtctgcttgacagaacccatgatctcctgctcgatcttcggatctaccgtgatcacgctggttgtctcattcgccgggaaatatttgctggagatcgcgcgctttaagctctggcgtgcgtactccgtcaacacatcggtatccctagtcgccggcgcatggtctgccagcgtctcaaaaattgtgagcagatctcggatggaaattccctccgagagcagattctgcagaaccttctggatctcgccaagtccaagaagcttcggcaccagttcatccacgagaaccggattgctctccttgaggttattgacaaggttctgtacatcctgtctggtaagcagctctgcgatatgggaacggatcacctcggtcagatgcgtcgcaatgattgacggcggatccaccaccgtatagccaaggctctccgcacgctctctctggctctccgtgatccagattgccggcaggtggaaggacggttcaaacgtcggaattcccgtaatctcctcctccacatatcccggattcatcgccatatagtgatcgaacaggatctctccctcggtcacctgaattcctttgatcttgataatgtactggttcggattcagctgaatgttatcacgcagtcggataatcggcacaaccgtaccaagttccagtgcaatctgtcttcgtatcataaccacgcggtctaagagatctccgccctggttcacatccgcaagcggaataataccgtagccgaattccagctcgatcgggtccacctgaagcagcgacacaacgttctccggcttgcggatctcctccgcctccgtctctgcctggctgacttcctcctcgatattctcaatgccgatgttcttgtccaccattctgcccgctacgataaacgcagcgcccagcgcagcaaacaataccacattcagcggtgtcacagcaccgaggaagatcaacgatccaccgaccagataaagtgccttcggaataccgaacagctgttttaccagaatgttggagaagtctgcattcttggatgccttcgtgacaaggataccggtagaaagtgagatcagcagggacgggatctgggaacagagtccgtcacccatggtgagaagaccatagcgctgaatcgcctccgaaaaatcaagtccaccgcgcatcatccccatcgcggttccaccgattaaattgacaaacgtgataatcagtccggctgtggcatctcccttgacatacttcgtagcaccatccatcgaaccgaagaagcttgcttcttcctgaatcttattacgccgctctctcgcctgtgtctccgtaatggctccggtgtttaagtcagcatcgattgccatctgcttaccgggcatagcatccagtgtaaatcgtgcggatacctctgccactcgctcggaacctttattgataacgacgaactgtatgatgatcaaaatgataaatacgaccgctccgacgatcatatcaccaccgcccacgaagcttccgaatgtttcaacgacgttacccggagcaccggtcgttaagatcagacgtgtcgaggacacgttaagagaaatacggaatatggtagtaaacaacagcaatgtcgggaaaaaagacatatccagaacttccttcacaaacaatgtgttgaacagaacaatcagtgcgatcgagatattcagcgccagcattacatcaagtaacgtagagttaatcggcacaattaaaaagatgactgcagcaagcaaataaagcgcaacacctatgtcagcctttttcatatctcttcctccttcgttttactgtctcatattatataccattgcaagaatctccgctactgcctgatacaattccggcggaatttcattgccgatttcgacattggcgtagagcattcttgcaagcggtttgttttctacaatttcaatgtgattctccctggcagcttcacggatcttctgcgccagataatcttcaccctttgccagaaccaccggtgccttatgcacctccggttcgtacttgatggcaaccgccagatgggtcgggttggtgataaccacatccgctttcgggacatcctgcatcatacggcgcctcgatgcctcgcgcatacgctggcgctgtctgccttttacttccggatttccctctgtatttttgtactcgtccttgacctcctgtttggtcatcttcatctcttcattaaagcggtatttctgatagatgaaatcagcaattccgacaacgagatacaccagactgatcttgagccctgcaccgataatcacatctccacacagtgcgatcgcctgatttaacggaatatcatataaaataaaaaggtcattttcgtgatccttgattgcagtatacgcgatatagagaatcagtgcaatcttaatcagggatttgaacagttcaaaaacggaatccttggagataatccgcttcattccgttcaccggattaaaccggtccagctttggctgcatcggtttcgtggaaaccttccaccccacctgcagaatatttacaagtagcgtcacggcgaatccgaaaataaaaaacggtgccacgattttgagcatctgtatattcaccggtgaaaagaaagacattaccgcataggtggacacatccatcgcattgattccgataaaatccggaatcagattatatacatagtaaaatatctgaagaaatccgtcgccaatcgtggagacaaaaatcttcagcatcagaaacatcacaatcagatcaaaggcggcggtaagctccttgcttttggcgaccttaccgtcctctctggcttctcttaactttttcgcggttgccggttccgtcttttctccgcccggtccatccttcgcaaaccactggaggtgatagggaaggatctgtcttctgtcctgttccaagctaatacattccctctatcatcgatacaatcattcgtttcatttctttaaacacaaaatcggaaattcccggaagcagcattaccgtgaggaacaataccgtaagtcccaggagcaccttcatctgcattccgaccgcaaacatattcatctgcggcgctaccttcgccataatgccgaggatgcagtttagtatcatcatgcaggcaaataccggcagcacaatgcggaacgcgatcacaaaagaatccgccatataggttgtcatggactctgccaggctgtcccattgaaacacctgcccgttgacggggattacctgataggaatcaatgagcgcccgcagtacataatgatgcatgttcgtcacgaccatcatcagaagcagcaggtactgatacagatttcccgtgatggtgacctgcgagttggtcatcggatcgaactcctgcgccatggaaagtccgatatccatgtcaatgatatttcccgcaaataaaataatggaattacaaatgtttgcagcaaatcccatgagcaaccctgtaattccttctcttagaacaatcaccgcatatccaaacatgcccgtgtaggtaaccgctgactgatcgaccgaagggaatatcaggatcgacaaaagaaacgataatccgatcttcactctggacggaacatttttcatgccgaaaaacggagccgcgtacacaaagcaggatatgcgaaccagtattaaaatgagtatttcaaaatccaccaacgaaaacgtataatttaacattcctcaacctaacccagatatatactaaagtctgaccagagcgtattgataaactctgtcagattggttagtatccaggaaccaaatatcatcattccaagaaatacacagacaatctttggcacgaaggtaagcgtctgttcctgaatggacgtcaccgtctgaaaaatactgacgatcagtcccacaaccagagaaataatcagcagcggcgccgagcacaaaataattgtatacaatgcctgtctggcaatgtctaatacctgtccttctgtcatttcacttcatctcctgttccaaatgcacgcatcagtaaaatgtctttacaacgcttccaatcaccagattccagccgtctgccagaataaaaagcagtatcttaaacggcagtgaaatcgttgtcggcggcagcatcatcatacccatggacataagtaccgatgccactaccatatcgattacaataaacgggatataaatgaggaatcccataataaacgcataccgaagttcgctgatgataaatgccgggatcacggttgtcatcggaacgtcataataaagctccagtgtcatctgatccggataatcttctccatcgatatccataaaaagatgcagatccttttcctgtgtctgaccgtacataaagtcacgaatcggtgtctccgccgccttgtatgcctcctcaatggtaatgtcgccattgtccaacggctgtatggcatcttcgttaatctgctgaaaggtcggccacataataaagaatgtcaaaaacagggcaagaccaacgaggatctggttcggcggtgctgtctgtgtaccgatcgcggtacgcaggaaatgcagcacgatgatgattctggtataagaagtcatcataatcagaatggacggtgccagtgaaatgatcgtcagcaccagaagtgccttgatcggcgtggatacggctccggtgtcgttgttgtatgtaatggacaggccgttgttgatatcgctcgtcgcatccgtcagtccatcgctgctatcggtattgctcaagccagtaatcatatctgaagatgtatctgccgcatagactctggtctgtcccatggacaacgtcaatgcgatgatcagcactgccaccgcaaagacaaacgacataatacaatatgatttctttaattttgattttgtcataatttaatcctgttttttcgggaaatgttcctttaacttctcaagcgtctcctggaaggtcatctgacctttttctccattgtatccgggagtctttccgttgcagatctctgcctccgtaagtcccatctcttcctcggtaagctttgcgagcatggtcacattatcttttgcaaccgcgatcacaagatacacatctcccatttttattacctgaaccagtttgttgttggcgatccgtatggtatcgaccacctgaaagctgcgtccggacatctggaccttctgatatccgccgatccatttggttgtgaaataggtaatcacaagaacaaacagaaaaataagcaggacaccaagcagctgtataaaactgttcaggcttgaactgagtaaaatcatattagcctactactttttttactgcctcgagcacacgctctgcctggaacggctttacgataaagtcctttgcgccagactggattgcctcgataaccatggcctgctgtcccattgcagagcacatgataatatttgcattcggatcgatctctttgatcttcttcagcgcctgaataccatccatatccggcatggtaatatccatcagaaccagatccggctttgcatccgggtacttctcaactgcaactgctccattctcagcctccgcagcgatctcataaccattcttggttaagatatccttaatcatcattctcataaaagctgcatcatcgcaaatcataatctttgccataacattctctccttgtttcttttcttatattgttttgcttatattgcttttcttatcctgcttccaatcactttacaatctcggtaatacggataccatagctttcctctatgattaccacttcacccttggcaacgtatttgccgtttactaaaacgtcgatcggttcacccgcaatacgatttaattctataatagttccgggtgcaaaatcaagaatctctttaatagattttgaagttcttcccaactccaccgttacctcaagcggtacatccttgatcagatcaatattttccggtccgtatcccaccggaacgcttccggtaaacgcctggaactgtgccggctgtacatttaccggctgctgtccatacatctgtggcatttgctgtgccatcatcggttgtcccatcatctggcctcccatcatcggcgctcccattgccggctgtcccatctgcggtgccgcctgcggctgtggtgccgcctgcggctgcggtgccggctgtgcttccggagcactacctttgctgcccgcagtcgaatttgtatcttcctccatgttctgtgtcacactctcacacatttcctttgcaaaaggaatcggatacagctgcatgatatcactgtcgaccagatcaccgatctccagtctgaaccgtatctttacaaactcgcctgccaggaactcatcgatgacgctctcatcgattgtctcctgtaaatctatcaaatccgcctgtggcgggctgatatcaatcactttgttcagcatggatgacatggacgtcgccgccgaacccatcatctggttcatcgcctcgctgatcgcactcaagtgcagctcgccgagctctccatccgtattggttccgtcaccacccatcataaggtccgtgattacctttacatcgtgttcctttaagaccagtatattgctgccatccagtccgacggtatatccgatccggataaacacgcacggcttttcatatgcttcacagatatcactccaatttgcgaaagataccaccggcgttgagatctctactttacggttcaccagggaaaacaacgtggttgccgctgttcccatgctgatattggcaatctctccgattgtatctttttctttctcagtcagtacctcttcctggggcttctgctcgccgctgtccgcagacccgttcagtaatgcattgatttcttcctgagacattactccatccatacttactgctcctctctgattactgatgtcactcttactgcataattatcaccggatgctcccggcagagcagtaaatttttttatatttccaacatacaccgacagatcctcatccactttggtgtcgagacggataatgtctcccacctgcagaccaaggaaatcattgactgatatactgctgttacccagcacagccttgatcggcatcggtgcccgtgcaataagtgcctcaatggtctctgtatattgctgttcatccttctcctgcaggctggaataccagtattttgtattcagcttgtccatcacactttccaatgtgatatacggcaggcagatgttgatcagtccctcgacatcaccaatcttaatattcaacgtaattaacgcgatcatctccgtcggggaaatgatctgggcgtactgcgaattcgtctcaatccgctccagtctcggtgtcagttcacacacactcgcccacggttccaccagaagattcacgcatacgttatagatccgctcaatcagaagaagctcgatttcggagaactccctcgtcttgtcaagcggcgccccctggccgccgagcatacgatccacgatcgtaaagccgacattctctgcaatttcaataatgatattgttattcagcggagcaaaatttacaattccaagcaacaccggattcgatagtgcattcgcaaactctgaatacgtcaccgcctccgaactcatcacttccacctgaacattttttcttaggtacaccggcagattcgttgaaagcaatcttccataatgttcaaaaataatctcaagcgttcgcaaatgctcttttgagaacttcgcgggacgggcaaaatcgtaatttttgacctgtttttcattatcatcttttatttcatctacatccagttcaccgctgctaagagctttcagcaaactgtctatctcattttgagataagacttcacccattctctctcaccacctactgtcttattctagtgtgcttccgttgccacgcttgagaaattcacgcccacgatatagtcggagccgaacagatcctgcatcttggataagatctcctccttcacagccttctgtccatctgcgttgaactcctcctcggtatacttggccactaccgtattgatgtcgctgcggataatggtctccttatccgtaagctctgtcatctcgtctcccccgtaggtggcataggactcgcttgtcttgttgacggaaagtcctacagaaaatacagcgtaatgcttctttccatcgccgttgtctgccagattcacggtaaaattatctgtgatattataaactgcaatttcttcgatcggcactgcggaactgtctttgttctgtccgccctcgagttcgatgttgattgcagcgcacacctgatcaatcagttcgtttgactttttggtctgcggaataatggaaaataccagcaccgcggtcagaatcagattcacgagaaccagtgccaaaataattactgccaataaatttttcttcattatgcttcccttcctattcgttcacaacttctgtcggttccacagtcgcacctgttgtcgctgcttccggcgtatctgtcaccgtctcagtgcttaaagccgcatccgcaggcgtctctgtacctgtgtcatccgtggatgtcccgctcacattcgagttgtatgagttatagattttaatctcaacccggcggttccttgccctgccctccggcgttgcattatctgcaatcggcacatactctccgcggccagacgactttatgtatgcaggatccagtgttgtggtatcccgcagatagttagcaaccgcaagcgcacggtacatggacagtacgttgttgtcctcatacttggaagaatgaatcggcacattgtccgtgtgtccctcgacctcaatgatgttattatcgtaagtaaccagtatcttgccaagcttgttgaccagcggatacgcctcatctctgagttctgcgcttgcagaatcaaacagcagcgcgccgttcatgttaagcgttacatactctgcattaaaatcaacctcgacgtcgtcctgtatcccatattgcgaaagtgcattttcaagctgctgcgccatatcctcagactcttccagttcctgctgttcatatgcttcggtaatgtctttttcttcctccgtctgtccgtcagactggctgctcagctgctggttgtaataagaatcaaaattctcaagctgactgattccggaagaaatcaattcaccctcgccgatcgatgctccgcctcccgggagtatgctgaatgtactctggaaagaggcaatgaccttctcaaacttttcctcattcacactggacatggagaaaagcattacgaagaaacagagcaggagattcataaggtccgcgaaggtattcatccatgcaggtgagcctttgggtggatcttcctttcttctcgccactattcctcacctccgacactgccctccgcagtttcctctctcgctgaaggtgacaggaatgacttcagtttttcttctatgacacgtggattctctcctgcctgaatcgacagaataccttccaccgtaatttccttcatcatcatctcgttattattgtttacagaaagcttggatgccgtcggattacacagccagttggcaatcaacgaaccgtacagtgttgttaccagtgcgactgccatcttcggtccgatcgttgatgcatcattcatatccttgagcatcaggatcaatccgatcagggtaccgatcataccccaggcaggaccaagttctccccatttttcccatacagcgattgactttttgtgtcgctgctcgatacagcccagatccgtctccatgatacctcttaccagttccggatcggtaccatctaccacaagcatgattccttttttgaggaattcatcctcgattccgtttgccgcctcctcaagtgcaagcagtccctccttgcgggcggtatttgacaaatcaatgatattccggatgactgccgcaggatcctgcggtacctccttaaatgttaatgtaatactcttcagacctgcaataaaatcctgaagtttgttggacgccaatgtacccgatatggaacctcccagtgtgataatgattgaagggaagtcaaacatattgaaaagacccgaagctccaccactggaaaatacaccgaacaaaaacattacaacgccaagcagcatccctgctaaagaagctatatccaattcttccacctaccatccttgatattatagtattgctgtctccaagcggagactgaaatctcaacaagttgtcatcctatatcttgtataattttactaaacttttgaccgcttgtctacttacttttgcaaattctgtgtttcttctttcatggaaccgggattttatcagggagacaaaaccccggttctccaaaatcttatccgtgatgctgctctgtcatctcgcagccgcttatctcttcaggttcacaagctcctcaagaagcgtatcggatgtcgtgattacacgggagttcgcctggaatccacgctgtgtggtaatcatctgcgtaaactcggtggagagatccacgtttgacatctctaactcgccggatgtcatcttgcttccgtccgccgtaatatccacaccgataccatcgaactcaccggagttcaaggtcgtgctgtagcagttctctccgactttctcaagacctgccgcattggcgaactgtgcgaccgcgatctgtcctaacaggttgcggttaccgttgtcataaataccgtagatctcgccgttgttgctgactgaaagtccgatcaggttaccgagcttcttacctgctccagtttttccgtctgtagcgcctttgctcatcgttacagtggacttgccgccgttgttcgtattctggcaggtgctgaagtccacattgatatttgcgaactgtccgccgaacagggacatgttcagtccaacactcttcgcatccgccacgtttccaacctttgaaaatgttccatcgtccgtgctgaagcttaatctgtgatatacactgttgtatgtaagtgtcagtgccccggttgttccgtcaaccgcatatccggtgccatttccggtgtaagcatccgctttcgccagaatgtccgctcctgcaccgtatacctgtgtcaggctgagtgcccctgctgtgacaaccgtcatgtccgtcgcactttttacctggtcatagctgtgtgtcgctgcattgtactggtagtaattaccgctcttgtccacgatgacgttagcggacacataagtgtaatccttgccgagcgtataactctttgtcgcatcctcggtgttaccgaacagtgcgtttaacgccggctgtcccgcctgaatattctcaggatcgtagtaggtatttccgtcgccgtctaaaacgttcaacagctctaccgtgaactctccgtccgttccggttgacttaatggaaaaacgtgcggtgtactcatatcccaggttatcgtagaacttgaggttcttgatcaatccgtcgtcactcaatacgtcggtatcgttcttatcaataataccgccgcaggttgcctcagaggttgcctccggtgcgcttgtcagattctccgtgctcatgacgcgcaacgcggatacggtatctttccggatatttccggttgtcttatctacctgccatcccatgaccgtatatccggtagacgtcatacacaggttgcctgcaccgtctacatagaaagatccggatctggtaaacagattggaagatccgttgttgacaataaagaaattggtggtcgactgatctgtcatacgcagatcgaaagctcttccggttgtctcagctgcacccgcggatgtaatgctgatatttaccgcacctgtggtcacgccaagaccgatctgcttggcattcacaccgccgactcccgtagccgcatttgctcccgatgctccggatgtgttctggtagagcatatcctggaatgtcacggaagaagacttgaatgctactgtgtttacattggcgatattgttaccaataacgtccatttttgtctgatgtgtcttaagacccgacacagcagagtacattgatctcatcataatgaaatgacctcctgtaatgtctggtgccctgctcccttctgtcattcggggagcttctgcctccttgtaaggtccggcatattatacaatcacggcaccgtcaatatttgtaaaaatattactctctgactcactctgatccatggctgtgaccaccgtcttgctcggaacattcacaataaacgccagtgaatccagaatcacgagtgattcccgtattcccttttcgcttgccttcaaaacaccggattccagtctctcgttctgctcgtccgacagattgatgtgtctgtcattcaaacgtccctgtgcatgtttggaaaaccgaagttcctgactttctgcggtcgtctgtttctgtcttaatatatcctcgaaagaaacactgttttcctgcgccgcagtctctgtgcttttgcgattcagataccggtcagttacctgttcgatggaagcaaattggttcgtaatcttattcataaccaacgctcctttctcagatcattcggctttcttctcaagctccgcaatcttagcctcgagtgctgtcagctgatcgtaggaatccttgctgatataagtcttctctgtggtggtcagcgaatcgtaattcttgcgaagtgcttccactgcttccttgttctcaagggtcagctcgtccgcggatggaatctgcgaaagcgcattgtcaaataccaggctcttcatggttccgtccagcttcacaaacgttgccagcgtatcgctgtcaatataactctgctgataagaagtcagtccgttgtacacggttgccaggttctccacatccgtctgatatgccagcgtcagcttatccgcatccggaagctttgccacagatgccttgaatgcctctgccagtgaaaccgcctccatgtactcggtgtctgccacctgatatacatcgtcgagtgaataacggttgccgttgacataaatgtatttctggttgttctcgtactgcacataatccacgaatcctgccaccgccgtcgtctcgccggtcgtctcggatgttgtctttacaatgacatactttccaaccagatcgtttgccttcgtgctctcaatgctgttctgcatgttcagcatggactccatctgtgaaaaagttgccagctgtgccacatactcggtattgctcgtcggttccagcggatcctgatactgcatctctgcacataacagctgcaggaactcgtcatatccgaggtcattgccggcactggtcgttgtctctgtcgtactctctgtaatcttgccgttctctacggcctgtactaatgccatatgtctctcctttctgtctgttatgcggtaaagtcaacggaattgccctgttctgccatcatcttcgccaccagagtctcctcttccgtcatcagcccggacagtccgtccagttcattcaggttgatgtgtctggtcgcattggctgccttttcccgttcctctgcctgctgttcttcctgttttgcattctgctccaggttcttctcaaactcatgtccgccgacggttacctccacggcatccaccttcacgcccgcctggttcatgttctgcttcagatctgcaatctggctttccagcgcctccttgaccacttcattctgtgcggtcagatgtgcggaaactgttccgtctttggatgtgatctccagataaatcttgcccagatgttccggattgagctgcatctccatcgttgtttcctgattcgccgtgtaattcactctcgtataggtcacgatctgacgcacgacatccgcgatgtccacctgtgcggcatattctcccgcactattggcgccctgcattgccacggtctctgtcagcgtcgggccggtatgtacatccacgcccgcatgtgcctgcgacgcaaaattctgctgtccggaattggaatttgatccggtctgtgcctgttccttatccgaccctgcagctgcatcggcagctgtctcttcctctgcgcctgcatttgctgtctttgcctgcgcatcagtctcttccggagtgatgtcttttgcttcttctgttctggtctctgtctctgctgcctgggcagccatctgcggctgttctgccgtatcacggattccatccgccgtatcagcgtaaaccttctgtgcatctttgacatctgtttcaccagcatccgctgtctggactgtctgcatcagatctgcatccatgtccgtctgtccggcatcctccaaaagctgcgtcaattcctcagccgtgactcccagctgctgcaagagatcttcggtcagtgttcccaccgactgcatcacgttcataaacgcttcattacagagaagtgcgctcatgtcttcggttccggttaattctgccaccagagctgcaagctgctgcggattcatcagatcggccacggtcagtcccaatgtctccattgcttccgtgatctgctcatccgtcacctgaagttcatccttgatgacgtctctcacactctcttcaaagctttccagcttctctgatacctgactgccggctgcccagtccttcgtgctttgctccggtatcttattcttctgatactggtaacggtcataattctgctccggactgtgcggtgtaagctgctgcatattctgcgctgtctgagatcctgtacttacgctgcttcccgggatctgtgtcatctgatcgaccatcttccggaatgtggtgccgatatccgtgccatcaacgcctgtgacactctgtccactctgcgtctgcatcagcattttcccaatgcttgcaacattgttgtctcccattctcttcctcctttcccatagctgcatctgcagcctgatttttgaaggaatccctctgccactatgaaaagcagactgtccttctctattctacaggttccatgatcgcggtcacctttgctgctgtagccgcgtccattttgcccagaatattcgctctcgattgtgcgtccatactgtctaagatatctgccaccagctgcagattatctgtcatggtatcaaaaattgcagccgcctcttttggcttcatggaagagtacgctttcacataatcgtccatctcatcattggctgccgtctgttctacaacctgacggtaaatgatctccgcatccgcaggatcaatgctctcataatactgcttatattcctctatatcgggtgctgaatctgaaaacacaacctcctgatagaacttttgcttctcagcctcaaaatccgcctcgttctgcttgtactgtgccagttctgcggactggctctcaagctgtgcgatatattccgcatttgcgctggacgtattctgtgcatccgcaagttctttctccagttccttgattctggcaaccgcatcgtcaatggaagtatagccgtaagcgtcatcctccgtcgacacttcctcagtcgcgctgtccggcaggattttgttcacataaggaacatcctttaacaccggcgccagaacggatgatccgaaaccgccgacatcgcacttgatcaacaggacgatgatggcaagccagattaaaataatgatcagggtaacaaagaacacggtaatctttccgccggtcgacgtctcgtcatccatatccagatcatcatttaactcttttgcctttttccggtccgctttcttctgtgccttcgcttctgcacgtgcagccttctcctgtgcctttgctgcctttttatctaatacttcgtctttctcttcttctgccatttgagacctccgtgcctatccttcatggtaattgtagctaacaagctcgtctatttccttgctctctgcctgggcgatttcctgcttaaattcttcaaacgcacgctccctgagcttctcatgcgtctttcgctccaccatcacccggttcagttcgattcgcgccatctccagcgtcttttccgcggcgtgcaccttcatcatctgtgctctctgcagactcttcatcacatcgatcgcacgcttgcattcccggatctcctggatatccagcgttccgttgaccagttcttttgattttctctcgtagccggccctgcgcatcaggatctctcgaagcttctcctgctcttccgcaagctgtctgctcgccgtcgcatatgcaatttttgcctgattctccagcttgatcttgatgtcaagaatgttctgcatccggtatgtaaactttgccatacactgcgcctcttttccgcggagcgttcttaatcttcaaatagtttcttcaataaatcgatttcctcgtcaaacaggaacttttcatctgtcctctggcacaggaactgattcactgcgttgatcttctgaaccgcatagtcaatctcacggttggaaccgctcttgtaagctccgatgttgatcagatcctccgcttcgttataagtagccagtacattctttaaacgtccggcaagctccttgtgctcgctggtcgctatggcgctcataacacgggaaatactctgtaaaatatcaatcgccgggtaatgattcttgtgtcccagttttctggaaagcacgatgtgtccgtccaaaatgcttcgggctgtatcggtaatcggctcattaaaatcatcaccgtctactagaacggtgtaaagtcctgtgatggaacccttgtccgaagtaccggcacgttccagaagcttcggcatctccgagtatacactcggcggatatccccttgttacaggcggttctccggacgcgaggccgatctcacgctgtgccatggagaatcgggtcaaagagtccatcatcagcagtacatcttttccctgatccctgaaatattcggcgattgcggtcgccgtcttcgcagccttgttacggatcagtgccggcttatcggaagtcgccaccacgacgacggaacgcttcattccctcttccccgagatccctctcgataaactcgcgcacctcacggccacgctctccgatcagggcaatgacattaatgtccgcttttgtattgcgggcgaacataccgagcagggtgctctttccgacaccggaacccgcaaagattccgatacgctgtccttttcccacggtaatcagcccgtctaccgcctttacaccaagcggaagcacctccgagataatcttacggctcatcggatccggcggatccgcctcgaccggatattcgcatccgccctcaatgactccgccgtcggtcggtcttccgataccgtccagtgtgtgtctcagaacgccgtccccgacaagcaccccaagcggatgtccggtattctcaacgatacatcctaccccgatgccttccacattttcaaacggcatcagcaaaagtctcttatccctgaatccgactacctccgccatcaccgcgtggtctttctctctgtcaatgacaattctgcagagatcgtttaactttgcatccggtccgacagattcaatcgtaagtccgacaatctttacaacctttccaaggcggttgaagtaggtcttttctccaagttgtaaatatttttcaaattgatgtgtcatcattctctcaccttacgaacataaagaccggatatctttgatcagattctcaagctgtgtaccgagactgcagttaaacacgccggaatcggtctctatcgtacagtcatttccctccaccgtcgcgtccgagacaatctcaagctcaatgtcatgtcccacacgatccaggatctcggtcttgtgattctccagaaacagtgcattgtcctccgccaccttcacccggaaccgcttgtcgtcttcaatatttaaaatggcatcttcaatcagatgcatcagtatctcttttttgtcgtcaaactgaatatgaaacactttttcaaagacggtaacgatgacatccaccagatcctgttccatatgttcgcgtttgtccctgtaatcgctgtcaagatctccctgctttttcctgtaggactcctcaagctgcacgcgaagctgctcattctcctgctccgccgaagctctgccctcctcgtacccctgcgtctttgcagatgtacggatctcctcggcatcttcgtttgcctgtgccagtatcgcatcggcattctgctgtgccgccgcaaggatctcctcggcttttgcctttgcctttgcctcataatcaatctgcggctccgctttgatgacctgacccggatcacccgtcacaagtccggctgaaaatccgcctttctcttcctgcacattctgtgccggtgtctgtgtctgcggcagttcctgtttcaggtgctgctgcaggatcacattggaatcgatgatgcgcgtgtttgtggaatccgtctgaacaacccactgtttataaagattagacaacgatctcgtcacctccgcctcttgagattacaatctcgcctgcatcctcgagtttacgaatgacgcttacgatcttctgctgagcctcctcaacatccttcattcgcacaggtcccataaactccatatcttccttgatcatcgcagcaagacgtttggagaggttcttaaatataacattctgtacttcctcgttcgccgccttcaaggcaacgccaaggtctgcattatccacatctcgcagtacacgctggattgcacggtcatcaagcagcagaatatcctcgaatacgaacatcttcttgcggatctcgtctgcaagctccggctcttcgatctcgagagactccatgatatgtttctcggtcgaacggtcgactgcatttaagatgctgacaatagcgtccacgccgccgacgattgtgtaatcctggttgaccagggaagaaagctttctctcaagtacccgctccacttccttgataacatccggcgatgtacgatccatcatcgcgatacgttttgcgacatccgcctgtttttccggcggcagcgcccccagaaccatcgacgcctgcggtgctgtcagataggacagaatcatggcaatggtctgcggatgttcgtcctgaatgaagttcagcagctggcttggatctgtcttgcgcacaaactcgaacggacgcacctgaagggatgctgtcagcttggagataacctcctgtgccttgtccgcgccaagcgccttgtcgagcagttccttcgcataaccgataccgccctccgcaatatactgctgagccagacagatctgatagaactcgtttaagacatcctccttgacctgcggtgaaatacttctggtatttgcgatctcaagggtaagttcctcgatctcgtcctccttaagatgcttaaagatatctgctgaccgctccggtcccagtgtaatcagaagaattgcagctttttgcagtcctgtaaattcctcgttttttgccatattactcccactcctcgttgagccagttgcgcagtaacgatgcagccgcctccggtttttcttctacgaatttttcgatcagtaaacgcgtctcggacttctcattgtagccgatgtcctcaagcggctcctggttctcttttgtggattccagcaggctttccacggaaagttcctcctccatctctgcctgtttctcctttctggtgctgcggaataccacataaccaagcaggagaagaatcagtaccgcaagtatgatctgcagataatctgacagggttcttccaccagaagaatactggaaaatcggctcgtcataagcgatgatgctgatgtttgcctcaggaaaccccgttgcattggcgatcatcgtgtaattatcctgatccaccgtcgtcttgaccgggtcactgtttgccgcaatatactcgtcaaatgtcatgttatccagcgcaccggatgtcctgagtgtgtcctcatcatagatcacataattttttaccacgatcgcaatggaggaagtatcgtaattgatcgttccggtcgccgccgtgcggtccgtcactttttcattgttctgatactttgtcgtggtatcggtgatcgtggactcggtataattgttatcctcaatcacataggatgtatcgtcattggaatctgtgcccggtgtagcagctgcgccgccgacactgttcgactcataattgctctgttcgtcgatcataccgttcgtctgaccgtccggtgccgaatactggcgttccgtctcgcggtatgcatcaaaattcatatcaagctttgccgccacttccgcatgatcataaagtccggagccgaccagaacatccttcacctcgctcttaagcagattctccgtcttggtcttgagggaaagctgactgcttgccgttccaatcgacgagtcggaatccccgcccgagaaaaggacattggagttcgagtccaggatcaggacattgtccgtcgtgtcattgccgagctgtgtcgctatgtactgtgccagtccctgtgcctgctcgtcgctcatatctgaattcaaggtaagaattaccgccgcgtaggaatcctgctctcttgcaagaatcgtgccatcatcattcgggatgtccagtgtcacagaagcactctcgacatttgacagtgtctccagctgatctgcgaaataattctccagatacagcttgtatttcttagtcttgtctgcctcggtggagctgaatccaccgctgaatacattatcgatggaaaatccttccgtcggcacgccgttctgtccaagcagaatcgacgccgccgcattgtccttttcatccacatagaatgtcagcccgtcatccgacatctggtctggtaggagatgcttccgtcattgtccagaaggtcttttacttcacccgcctgcgctgtggaggagcactcgataagcgttaccatgttcggcttcccgacaaccaccgccagaatcaccaatgccagtataattaccgccacaatgcttccgagcaggattctctgcttggttgtaaactttttccaccaatccgttatcttcgttaaaatcttttgcacctgttccggcataatttctaactccattcattaaatctgcatgttcatgatctctttgtatgcatcgagcatcttatctctcactgcaaccgtgtactgcagcgcctcatacgccttggctgccgcaatctgcatatcgtgaggattgtccgcctcgcccagcgcgaactggatctttgccgactgcgaatcattctgcagatcattcgtctcgttgagcatattgattgccgaagacaacaccgagtcaaagctctcatcggtgtccacagacaacagtgtcttctgtgttaccgcactcatgtaatctggtgaagtggcattcgtcaataaactgatatccatctgtatttcccccgtttcatcctaatctatgtcttactgaccgatcttaagtgctgcctgaatcatgctcttgctggcattaaacgccgtcgtgttcgcctcatatgcacgggacgcgtcaatcaggttcgtcatctctgtcaccgtattcacattcggataacgcacatagccgttctcatccgcatccggatgggacggatcatactccattgtaaaatcggtctctgtatcttccttgacggaggtaaccttcacgccgttgcctacagcccgcgctctggatgactgataatatttgctgaacggagtcagatccttttccgcaaacgtcacaatcttgcggcggtacggttcaccgtcctccgtacgcgttgtattgacattggcaatattctccgcgatggtgtcgatgcggaagcgctctgccgtcataccgctcgcactgatgtcaaaagactgaaataatcccatatgctacctcctgtttatttaagcactaatttcatacgattgaattcttcgttgatcgatgtcgtcagcatctcatagcggagctgctccgatgccagttccacctgctccgtatccacatccacattattgcggtccagacgataggaataattggaggaatccgtataggtagacacatctaagcccgaaagatccgagttcagtccccgcactttcttatccagcggaatatacttcgagctgccaagctcccgtttcagcgcagattcaaaatccacatcctgtctcttatagcccggagtatccgtatttgctatgttgttggaaattgccgactcacgtttccagctggcatccgccgccttatccatgatgttaatatagtcgaacgcattcgtagttatcatatgtatcgccctccgcttcacctagtttcccaaactatcttattccattataaaatatggtttcgtaattgcaagagatttttgttattttttacactatcttgtagatttttgcataataagtacaagatattagcaaaattgtcaaataaacccgcataaaaagccacgttccacggaaataaaaaagagcgcacccttcgatacgccctttcgtcctgtttattttttctgattctgctttttgatcttgtcgagttcgtcgaatacaacgtcgttcaatactttgatgtaggttcccttcatgccggaagagcgcgactcaatcacgcctgcactctcgaacttgcgcagtgcattcacaatgacggatcgtgtgatacccacgcggtcggcaatcttgcttgccacaaggattccctccttgccgtccatctcatcaaaaatatgaatgatcgcttccaattccgaaaatgacaacgtgctgattgcagatttgacaatctgaacctttcttgtctcctccgcattctcctcattcacggagcgcatcatttccagaccgaccacggttgtcccgtattcgctcaaaatgatatcgtcaatatcgtactgtctgtcttctctgtagacaaacagcgtgccaagccgctcacccgcaatatcaatcggcgtgatgatcgcagtgtattccttcacgtgatctacgaaacctaacgtctcaagattgacattctccttggtagagaggattccgagcagacgttcgtttagcagcgggtcgatgaaacctcccacctcgtccacgatcaattcctggatctcatccactccgggacacacgcccgttccaagaacctttccctttttgctgatgaccagaatattggatgcaagaatatccttcaacacatcgcagatatcattaaacacgacctttgaagagctgttattgtgcaacagcttattgatttttctggttttgtccaacaactgaacactcatgtccgtgcccccatttcgtctcgaatctctttttcgttatatttcatattttaacacgtcaattctgaaaattcaatattttcgtaatatttgacatatttttttaactattttgtatcctcgtccgcttttctgtcacgggtgtagccgcatcccgcatctgcacaggcgatcttattgccttttaccaccatatagccgccgcacttcgggcacttctccgctaccgggcgtgaccagctcataaaatcgcactccggattattctcgcagccgaaatactttctgcctttcttcgtcttgcggaggacaacgtcttttccgcacttcggacatggcacgccgattttttccagatacggcttcgtgttcctgcactccgggaagcccgggcatgccaggaattttccgtgcggtccgtattttaccaccatgtttcttccgcactggtcgcagacaacatccgtgacctcgtcctcgatcttgactttctgcagctccttctccgccacttccaccgcggcttccagatccggatagaaattccgcacaaccgtcttccagttcacagcgccctctccgatgctgtcgagcagcgactccatattggcggtaaaatgctcatccacgatgctcgggaaggattccttcataatctggttgaccacctctcccagctccgtcacatacagattcttcgcttccttgacaatgtaacgtctgccaagcagcgtcgtgatcgtcggcgagtaggtactcggacgtccgattcccagctcctccagcgtcttgactaaggatgcctccgtgtaatgcgccggcggctgtgtaaaatgctgcttctcatcgaaggtgtccagcgtaagcttcgtatcctcatcgattcctttcagcagaacattgttcgtgtccttctcgtcgtcctcgctcgtgtacacagacataaatccctcaaaggagacctttgatgccgcgacaccaaagcggtactttccggcaccgatcttcacgttcgtcgtctcatataccgcagaagccattctgcttgcggcaaaacgcttccagatcagctgatagaggcggaactggtctctggaaagagattccttaaccaccgccggtgttctcgcaatgtcggaaggacggatcgcctcatgcgcgtcctggatcttggcgccgcccttctgggtaacggtctgtgtcgctacgaattcttccccgtaattctgtgcgatatacgctctcgcatccgcatccgcctcatccgaaatacggacggaatccgtacgcaggtaggtgatcagaccgaccgttccctgtcccttgacgtcaacgccctcatagagctgctgggcaatacgcatcgtcttggagatcgggaaattcaatgtcttggatgcctcctgctgtaaggtactggtcgtaaacggcagcggcgctttcttcacgcgctcaccctttttcacttccaggacttcaaaccgctctccgcggatctcgtccatgatacggtccgccttctcgcggcaggtaatcgccagttttccgttctcgtccccgtggaactttgctgtcaacggcttcctttcgccgtccgccttgagctttgcatccagcgtccagtattcttccggaatgaatgcattgatctcgtcctcgcggtcgcagatgatgcgcagcgctaccgactgtactcttccggcgctcagcccacgctttacttttgcccacagaagcgggctgatcttgtaacccacaatacggtccagaatacgtctggtctgctgtgcgttgacaagattcatatcgatatcgcgcggctgctttaaggacgccttgaccgcgttctgcgtaatctcattgaagctgattctccgcacattcttgccgtccagctttaacgcctggcttaagtgccatgatattgcctctccctcacggtcggggtcggttgcgagatacactttgtctgcctttttcacttctttacgaagcttggcaaggatatctccctttccgcggatcgtgatatacttcggttcataatcatgctcgacatcgattcccatctggctcttcgggagatcccgcacatgcccgtttgaggcaactacctcataattttttccaagaaactttttaattgtttttaccttagcgggtgactcgacaataacaaggtacttagccattcatacatctcctttatgctgatttctcaaatccgtctgatataacaattcttaaatgcttccgtaacaaacccctttttcagaagaatccccagaatctgcgccagttcgggcacagacaggtctgtctcctccagaagttcttccatacttttcggtcgtaaatctacacaactatacaccaagcgttcttctttttcaagtaataatttttcaaaggtgcatgtctccccgcccgctccgggatccggcgcaagctcctgtacaaacgattcgagatcggaaactgcccccgctccctgccggattaagctgttgcatcccgccgacaaggcatctgtaattctgcccggaatggcatagacatccctcccctgctccagcgcaaaatccgccgtgatcagcgatccgctccgctgctttgcctccaccacaacaaccgcccggacaagccctgatatgatgcggttgcgctgcggaaaatatcccggaatcggctgcgtgccgggcggatactccgagacaaccgagccccgttccagaatctcctcatacagcacccggctgctcttcggatagcagacatccacgccgcaccctaagacggcgcagctgattccgcccacgtcaagtgctccctgatgccccgcagcatcgatgccgcgcgccattccgctcacaacaccgacgccgcgcgccgcaagcattctcccgagctcccttgcaaccgtccgcccgtattcggagcacattctcgcaccgacaatcgcaacggtctctccctgcgggaggcatccctttacatacagtccgtacggcggatttgcgatatggcggagcctctttggataagatgcatcctccagcgacacaaacgagatccctgattcacacatcttagcgtacgcttcctccatgtccgtcttttgcgcagcccggaccgcctgtatttcttttgccaataattgcatattttccatctgtttttcgctaaggaaatagatatcctgtgcattcccgaccttttcatggatactgattttcgcacagttggaaagtccgggaatatttgcaaaccaatacgcataattcatctcttcacctctcccagaactttctgtcaaagcttctgtagcagattgcctcctccagatgccggtcgcaaatccggcctccgccgtccatatccgccagcgtgcgtgccacccgcagaagcttatggtaagatcttgcggtaagctgcagctttccgtagatctcttccatatactgctcctgcttcttgtcaagagcacaatactcccggatcttcgtggcaggtatctggctgttatacgaaaatccttccttccggtagcgctcccgttgaatgtcctgtgccaccgtcacgcgcttctgaattgccgccgatgtctcctctttttgctgtccggttaattccccgaatgtcagcgccggcgcctccacacaaatgtcaatccggtctaagatcggctggctgatcctctctaagtaccggtggatcgccgtctgcgtacacctgcatttctgcatatcgggataatagccgcacgggcacggattcatcgccgccgccagcataaaatctgccggatagacataacttccgccaagacgcaccagatgaaccgccccctcttccagcggctggcgcagcgcctcaaccgtctccctggcgaattccggaagttcatccagaaacagcacgcccttatgtgccagtgagatctcccccggctgcgggattcttccgccgcccgtaagcccctgcacactcacggtgtgatgcggcgcccggaacgggcgctgcgtaagcagaccgttctccccggcaagcattccttttacactgtagattttggataactccatgcgctccgcctccgcaagcggcggcagaatggacgggatacgcgatgccaccatggtcttgcccgcacccggcggtcccacaaacagcagattgtgcattcccgttaccgcaacctcacacgcccgcttcatcagccgctgtccgtggatctccgaaaaatcaggaagcactgcgggctgtgtttcttctatattatattcctctgcggcgtacttctcccacgacgcatcctcaagaagacgcatgacctccccgatattttccacaccgcagacaagcatcccggaaacaagcgccgcctcttttcgattcgcccgcggcacaatgcagcgccggattccgcgttcctttgcctccgccaccatcgggagcacgccgtgaaccggctgcaccacgccgtttaatccgatctcacccacgatcagcacatcatccagtaccgcatgcggaagccttcccatcgcagccagcaccgccactgcgatcggcagatcaaacccggctccggatttgcggatgtccgccggcataaaattcacggtaattctgcgcggcggcagcgcacaccccacattgcggagcgctgtgcgcacccgctccctggcttctttgacctcagacgccagaaaaccgaccatctcaaaaacaggcatcccgtcgctcacatccgcttccacgcagacaggcacactctggataccgcgtatcgttgctgttgctactctgctatacaacctgttctccttttcattatagaaagatctggaatctctgtgcagtgaacactgctgaatatcttagaaaatacatttgttaaaaagacatgtttagtataacatcatttgtagaaaaagggaagcggcaatttatctcccgccccccgcgctttccattccttttcgcagtttttccagcgcccgtttctcgattctcgacacatacgagcgggatattccaagcgccgctgcaatctcacgctgtgtcatcggtttacaggcatagagaccgtaccggttttctatgatatagcgctccctgccggaaagcagcttcggcacaagtgccagcacctctctggtgcgtctgtcggtctcgatcgtctccaccacatccggttcatcgctctccacaatatccagcagatgaatctgattgccctctttgtccgttccgatcggttcatacagagagacctctctggccgtcttctttttggaacggaaatgcatcagcagttcattgtcaatgcatctcgccgcgtaagttgccaggcggcttccgtaatcttctttataagtagagattgccttgatcagaccgatggttccgatggagatcagatcttccatatcttcatcggaattctgatattttttcgccacgtgcgctaccaggcgcatattccgaagcgtcagttctttttttgcctcaaggtcgccgtctttcatttttttcaggcattccatttcctgttctggtgtgagcggagataagaaagttttcacaacgcacctgaaaagctttattgatacattctatgtatgggccatgttttccgtgcttttcccctcttttttccgcaaacaaatacatgccgtctttacatctcccccgccgcttcgctataatagcgttacatgaaacaggaggaatttttatgctgcgcacccttacctaccgcattttatccgccacggacgggcagaccattctgcattatttaaaaagtctcggctattccgggccgatactggtacatttaaagaaaacagaccacggcaccctcttgaacggcgtgtgggcgcatatgaatgaaacgcttcacaccggcgaccttctctgtcttcatctggaggagaatacttccggcacctccatttttccgcagcagattcccctcgcgatctgttacgaggacgaagatcttctggtgattgacaagccggcaggcatgccggtacacccgtctgccgcgcaccagagggatacgcttgcaaacgccgtcacgggatattaccgtgcaaaaggcgaaatccgcccgttccgctgcatcaaccggctggatgccgatacgagcggcctgatcatcgtcgccaaaaatatgctctccgccgccctgctcggcaaagccatgcagcagcgtatgatccgccgggaatacctcgccgtcgtatgcggcacgctcaccggaagcggcaccgtccacgcgccgattgcccgcgtaaagccgggcgatgtccgccggcaggttgattttctctgcggggatgatgccatcacgcactataaaagtctcttatgccacgccccctattccctgctctcccttcatctggaaacggggcgcacgcaccagatccgtgtccacatgtccgcactcggctatcctctggcaggcgaccggctctattatccggcattttcagacacaaaaataaaacggcaggcacttcattcccaccgtttgtctttttctcatcccgtcaccggggagatgcttacgtttacttctccgcttccctgtgatatggctgcgctaattgatccagaaccttctgctcataggggatcttccctgccagcagttcttcgcggataaatgtattgacttcctgctcgccccggacagcgagccggtacaaaagcagttcaagaagcgcccgcgtatccttgtgcatgacatgaaaatcctttccatgcaggtaatactctaatgcgctccggtcggtatagcgctccttctggtaatttttcgaggccgctacacggtcgatatacatctccaccacgtaccgcagaggcattttcatgccgcagagtcccttgtccccgccctcgtccggcacgccgtagtcaatccagtattccatatgatgcttgttccgccctttgtggtgcagccacgcggacgagtatcccttatccttgcgctctgcattgttcgggctcattgttccctgataatatttacagcccaccagaaattctgtcggcgtatatttcgacagatcatgtaataatccctgtttgtataaccccaccgcaaaacagcctttcatgaccaaatgcttgtgatggttgatcgtgcaaaaatgtttccatgctttcataataatgtaaccttattttcctgttaatataacgacagactgaccgcaaagttcgatccgcggcgcatccacccactcctcctcttttaggaacggtgcccgctctctggcggtgtccatcagcagataccactttttcttcccgggaagcttcggaagcgccaatctggtaggacccatgtgaaaattgcagccgacataaaggaattcctccccctctgttccatcgccatcctcttttccgcagtagagcatgcccaaagactgtctctcgccggaaagatctgaaatccacgcattctctccatgataggacaaatcgggataccccgttccttttgcatcggaaagctgttttggcatatccgcggcgagcacgggatgctccctgcgaaacgctgccatccgcgccacaaactcccggaaccacgcgtagcgctcatctttcttccagttcacccagccggtcggattgtcctgacagtatacattgttgttgccgttctgggaatctcccgtctcgtccccctcatacaaaagtgggactccctgtgcgaggaaaagcaccgccaccgcattgcacatctgccgttcacggattcttacgatccgctgcttgcggcttcgtccctccacgccgtagttggcactcatattccagtcacttccatcccggttctcctccccgttctcttcattgtgtttctgctcataacagaagagatcccgcagggaaaacccgttattatccgaaatgtaattgacaaatccgtgatactgatgctgctttcgctgctggcatgcaaatgcatccataccgccgtttttgtgattgagcagtgcccggacgggatacagatattcgtcattgtatacatacagatgcggataacggcacgggtgccagagcacagcattctcgaaaacggcaccaaaaatcttcgtccgtctaagccacgcatcctgtgcaatctgcgtaacgggcagattctcccccagcagatggaagccatccacatgatactccctgacccagtaacgcagcgcatctaagatcagattctgattgacattctcaggaaaatacatctccatcacacattccatgtgattctcatggagcgcgcggatgagttttttccattcgacggccgcatcctgccctttcgcgtaggacgcctttaccgcaaaataattggcgggcgcatatccccacaggttcacacgctccggcatcgcacatgcttccggcttgatctgatcctctttccgcacctgccagctgatatattccggcaataccgccttctcctttaagatcagttcctcaaactcatacaccggcatgaactccaccgtcgtgacaccaagttctttcagatagggaatcttatcgcgcaccgccgcaaaagttccccgctcctttgcagggattcccgcatccatcgaaaatccgcggatgttgagcttatagaggaacatctcatggcgcgggatctccggatgtacatccgtcccccacgaaaaagtgtcatccgaataaccgccgcagacccggaactcattcttaacgcgccctgcgtctctccagcgctctctgccgatgatgcgttttgcataaggatcggtcacgaccgtcccgctgattttataattataacgcaggctctctgccttaagccccgcgacaaagactgaccggatcgctcctctgcagcagctttccggcaccttaagttcctgccggattccgccgtctttcccgtacagaagaatactgcagtcctcttccttttctgcctcaaacgtaaacacgactccgccgcctgcggctgatgccccgtattgtctgtaatcgccctcttttatcgtatacgccatgccatcttccacctttgtcttcgctgcctgcacgcctgcatctcttcgcaatgcacctacacatcattttgctgtgcacctacacatcatttcgctgtgcacgtccggaaaatcagagatttcccggactcacgggctttcgccctatcagccatgaatttttaaaaattttgcctgcacaggcaaatttttaaaaattcatggctggcactgctcaatagccttcgcgtacattatatcattcccgcttgttttttgtatagttttttctttttcggggagaatgcgcttgtccggcatttgcatctcatgttataatattaagaaacgagagttcttattgtcacagtacgatcgaggtgatgtatatgaaacgaatacccacgacagatttaaagcccggaatgttcacagccagaccggttcgcactgccgcggggcagatcatcctggatgagggctgtcttttgagtgcgcagaccatcctgcacatccgtgactattccataccggaagtatggatcagggacagcagcgattcctccggcgggcttcacgattatctgcaaaagcagtacgctccggttcgttcccgttccgagcgtatccggcaaagcgaagaatacaagattttcagtcagaagtttgacagctgcactacgatgcttcacactgcgttaaacgactgtattttacgtgccaaaaagctggagacagacaagcttcttgcagggaccctggatttgtttgcgtcgcatactaccacactttccatgttcgacatgctccataacttacggcagatcgacgattcgacttacgcacacagcgtcaacgtcgccattatctcccgcatgctcgggaactggctcggtttttcggaggatgcccagaacacactgactctctgcggtcttttacacgatatcgggaaatcccggattcctgccagcatcatcggcaagccgggcaggctgacttccgaagagtttgaacagatcaagcgccatccccttttagggtacgagctgcttaaaaaccagcctctcgatccgcacataaagaacgctgccctgatgcatcacgagcggtgtgacggaagcggttatccgttcggtctgtacgcatcggacattgacgactacgcttcgatcatagccgttgcggatgtatatgatgccatgaccgccgaccgctgttatcgtctggggctgtgtccgtttgaagtgatcgcccagtttgaacaggaaggcttgcagcgctacaagccgcgctatattctcacctttctcgaacacattgcgcacacttacctgcacaaccgggttctgttgaacaacggacagaccggagagattatttttatcaataagcgtctgacgagacctacgatccagatcgccccctcacgtttcatcaatcttgaggagcatccggagctctacattcaggcgattatttaataacatccaataaaggagatatcatgatggcagacaaccataacaccaacgaagacgaggatatcctggtcaccctggatctggatgacggcagccaggtagaatgtgagattttaaccatttttaccgtcaacgagcaggactatatcgcccttcttccgctcaccgaagccggcgagccgaacgaggacggcgaggtctatatctaccgctatgcggaggatagcgatggcaatccgtctctggataatattttagacgacgccgaatacgaagccgtatccgaccgctttgatgagtggcttgacgaggcagaatttaacgacatggaggactgagacgctctcctgcctcggcaataaagcgcgagatatctgcatctttctgattcatctgtttgacggaaaagagatgcagatatttttttgcccgcgtcataccgacgtaaaacatccggcgctcctcctcgatgtcctgatccagcaccgccttcttgtagggcatcactccctcgttcacgtcgatcagatagacgttttcgtactcaagccccttggcggaatgcagcgtggaaagcgctacgctctcactctgcttttcctggctctggtacaggcgttccaattccctggtgtaattctcgatgtgcgcaaaccatccgtcataatcttcatagcctcttgcactttcctgtagttcatccagcacatcataaagttcatccgcccggatacgcctgtaatctgcatactcggcacagaactcgtcatatccgatgcctttccggatatagttgatggcggcaaacggattcatccggcgaagctgcatcacatcatgctccagcgtgacgatccgctccgccacccacggctgttccgcctctctgaaataccattcccacacatcgaatgccaccgtgtcctcgtccaatgaatctctgctgatatagcgcttcgggcggttcatgatctgcagaaaatcacggcgttcccggcttccctgcgcgatccggatataggcaaaaatatcccttgcgatccagtgctcgtaaaggttcggtatgcggtctctcgtcctaaacggaatattgtactccatcatctgctccatcagaagacgcggctgtgtgttggtgcggaacagcacagcaaaatcacggtagctctttcccctctccaccgcatcacaaatatcgcggatgatccgcagattctccttccgctgatcctcaaaaacggcatactccaccccggtctccgccgggagtgccgcgcggatgcgcttctggaagcgctccttattgtgcccgatcagattcagcgcatcctcgacaatattggcctgcgaccggtaattcgtgtctagaagcacggttttcgtccccggaatttcacgctcaaaccgcagcataatctccggctttgctccgcggaagcggtagatcgactggtcgtcatcccccacaacaaacagatttctctgctcacccgcaagcagcctgaccacctcaaactggatctggttgatgtcctgaaactcgtcaatcagaatgtagggatattttttctgccaggcagccagaatatccttccgctccttgaaaagctcccatgtatacaaaagcatatcctcgaagtcaatcagatgatgcgcatagagatattcgtggtactcgctgtaaactctccggaacacctcttccccgcagttcgtggaatagtaatgatcgagtgaaattccgctgtttttcactagaccgatctcccccagaagcgctgcgatgaactccgactcatcctcatattccagcctgtggcgcttaatgatctcacgcatgcagctcacccgctgctcctcgcggatgatgttctccgcctgatagtggtaggcgtgctttaagatcataaaaaagacggcgtggaaagttccaaacgtcactgcggaagattttccgcccatcaggcgcaaaaaacgttccttcatctccgttgccgccgctcttgtaaacgtgatgacaagaatgtttgccggattgattccatattctgttatcaaatgtctggtgcgttccgtaatgacaagggtcttgcccgaaccgggcccggccagtacgagcatgggaccatccttgtgacggatggcctcacgctgagacgggttaaaactcatagattacctctgattatttctgtaacatggaaatgccttttttgattctcgcaatggattcctctttgcctaaaacctccatcagctctgtcgctccgcccggcgtcatctgtttgccggacactgcggtacggatcggccacatcacatagccgttcttcacgcccttttcctcaacatacttaaggagcgtcgcatagagtgcatcattggaaaaatcctcctgcgcttccagcagcggcaggacgtcgcttaaaacctccagcgaggtctctgcattggtcttcatcttcttgtgtgtgtacatcgcaatatcgtactccggcagttcctcgaagaagtcgatgtggtcgcggatctccgggaaaacctcgatacgggtcttcaccatcgctgcaatcttcttcaaatccatatccttgtgaatgacctcgcgcagatacggctccgccatctcataaaaacggtcaaaatccatcgccttgatgtactccccgttcatccactttaacttggtgtaatcgaacaccgccggggatttgctgattctgtgatagtcgaactctttgatcagctcatccagggtaaagatctcacggttgtcctccgggctccatcccaaaagtgcgatgtagttgaccactgcctcggacaggaatccctgctctaagagatcctcaaaggaagaatgtccgctgcgcttggaaagctttttatggttctcatccgtaattaacggcagatgaatgtacaccggtgactcccagccgaacgcatcataaagacgctgatacttcggtgctgaggagaggtattcgtttccgcgaaccacatgtgtaatattcatcgtgtggtcatcaacaacatttgcaaagttgtaagtcgggtatccgtccgacttgattaaaatcatatcgtccagttctgcgttctccacggtgatatctccgtaaagttcgtcgtggaaggttgtcgttccctcattcggaatattctgacggatgacaaacggcttgccggcagcaagatttgcctcaatctcctccttgctaaggtgcaggcagtgcttgtcgtagagcgtgatctccttgccctcgaccacctctgtcttaagggatgccagacgctccttgtcacagaagcagtaatatgcctcccccttctcaatcagctctttagcatatttcatgtaaatgccggtcttcatacgctcgctctgtacataaggaccgtatccgccgtccttgtccggtccctcatcgtgtacaagtcccgtctcctgcagcgtgcggtagataatctcgacagcgccctccacatagcgctcctgatcggtatcctcaatgcgaagcatgaaatctcctccggcatgctttgcaattaaaaactcatataatgcggatcgcagattgccgacatgcattcttcctgtcgggcttggtgcgaatctggttctgactttactcatcttaaacctccattgtataacaccttacggtgctgtttctttcctgaataacaacagcctgtggctgtcctttgtcttgtgacatgaccacaggctattatataacaatttgatacttctggcaagcggacaaatcctgtgcctataattttttgaagacctctgtctcgcgcttcaaatctgccgcgatgtgctggttctcgtccatatggcgcgtgatgtcctccatgtcgcccacgagcacctgcgtgctgtcggcagcgctggaaacgcccttcacaccctcctcgatcgcatgtgcaatcgtgttgatggaatccgcgatctctgccatcgtcttctttaagacctccgtcttctcggtaaagtctcccatgctggtctcaatgtgggttgccttctcccggtacgcacttccggcatcgacaaacgcctcaaactccggaagaatggaatcattcatatactgcaccagtccgttggaatgttccgtgaggtttccaaccgcctccgtcacaacgcggttgatctgctggatacggttggctgcctcctggctggcggctgcaagctggctgatctccgtcgcaacaacggaaaatcctctgcccgcttcccctgctctcgctgcctcgatggaggcatttaacgccagaaggttggtctggcttgcaatatttaaaatatcatcggtcaggctgtttacctgatttacgctcttgctgtcctcgattgcctgatttaatacggttaaaatctcattgaccttggctccggtagactccatgttctcccttgcggaagcctccatggaatccgcatgttccttcatctcgcgggtgtacgcgttgatctctgacgtgcgctccgcgatctgatcaacttcctgctttacagactcggtgttcgtattgatgagggatgcattggctgacatctcctccatcgtggcagaaagttcttctgtgagtgccgacagatccgacacactgccattcgatgtcacgacgctgtcgcgcacctcgccgaccacagattccattctggttgaattgttcacgatcaccttgaaaatatcctgaagcttgtccataaacacgttgatgccgttgccgaccgccgcgacctcctggttggcgtgcacgctcacacgtctcgtcagatcgccctcgcgcttgtcaatgtcctcaataatatctgtgatctccttctgtgtctttaacagagggataattaccagctggaatacgcagatcagagttgcaagcagcgccgccacactgatgatgatggatgccgtgctcgccgcgattgccgtccggtagaccgctgcaagctgttcctttgccacatccgcattttcgctgacattggtgcggattgccgcaatgctctcctgcattgcactggaataatcggcgatcttgccgtttgccagcgcataagccgcctcgttatcgttgttggcactgtatgccatgaggttggcaagctcgtacttcattccctcgtagttggacaccagcgcatcgtattccgccttgttgtcgtctgtcacatattcctggaaatcatccagatatgtctctaaggtctcctgctcactccggatggtctcgaccagcgagatcatggtatttaagtcggtcgccacgatatgggacagtcccagtctgtggatcagaagcgtctctttctgaatatcgccgagctctgaaatacagctcatgtagccgtttgcaatctgcgttgcatttgcatttactctcttaatattggtcactgccagaatattggaaacgactgacacaaatcccaggataaataccggaatcagaataataaactttgtactgatatagctttttttcttcatatcctgctcctccccgttactgtaccgtcgactgtgtaattccagccacaagcgtatccatcacttcctgcggatccgttccgtttgtgctgcctgtcgccatcagattgccgaactccgtcgtcgcatcccagaagctgttgcccacacgctggagtttgccgtactgcgcctgcgcaatgactgcctggatggcaggcaccgcctgtacctgctccgacgcagccgcgtttttattggaaggtccctgatcgcgctcctcaagacgcagcatctggttctcctcgtttgtaaaccagtctgcaagctttaatgcccagtccttgtgcttggaataggcgttgacgcccatcatcttatagcccgtgaaagaggccatctggatctgctgtcccgcgcaggtgtaggtcggaagcttcactgccccgtaatcgttgccccatacctttttgatctccgatgcattccacacgccgctgacgcctgccacaaccgttccgtcctgcacgccctccatgaattccgtgtcggtacagcttaaaaacgccggattctgtgcgatggcaagcagcgcctcctcaatgtcggttccctttatgctgccttccgtcgcattccagtcgcagtagttcgtcaccccgtcgtcatttacaccgaaatccagtccggtgttgccgaaaaacgcatagaggtaccagccggaactccagtccatcgtcaccttcttgcccacagcgcccgctgctgccagaagcccatccatcgtctggacgtcctcttccgtcaggtaattcttatcgtaatacagaaaatatccgttgtccgccgtcatcgggtaagcgtacagcgtatcattcacagaagccgctgcaaccgcctcatccagattcgcctcccggatctcatctgcatttggtacctgctctaaggcaccggctgcaaccatgctggtaagctgatcgtccggcagcgggaagacatccgctccgttatgtacatctccaagcagcgtattgcgcgtctcagcatctgcattctccgcaagctgaatatcaaaatctgcctgtcctgcatatttctgctcgaagctgtcgatcatctcctgcagaacatcaaaattggcctcctctgcccatacggtcaatgtaaccttgccgtcatcctccgctgcatcgccggacaactctgtcgaatccatgaccgcctccgtctgcaatacggacggttcaccgtttacggactctccacctgccgtcgtatccgcacttgtacagcccgccattgctgttgtaacaaaggttgtcgctgcaaccgccgcaataacatgcttcttcatctgaaatccccttcctttgtattcgtatctgtatgtgcaaattctctctgccgcctcttctgttcttatacacgattttgcactcattttatatattttacacctattttacaaaatgcgcaatcggttgttccttttttttaatttttcttatcctttctcccacttttacatccgctgcaggatgagcagtgaccacagcagccacaatcttctttgtctttttttctttttcccatatacaaaagcgccaggatgatccacaaaaggatacaccccagcacaatcagatccaacgcatgcaacccactcaaaagaagattcctcctatctgataaaccgcaaatgccatcagccacgcgaccgcgcattgaagcaccacgacgagaaatgcccgcatgccgcttcccatctcacgcttcaccgccgcaatggctgcaacacacggcgtgtaaagcagcgtaaacacaaggaagcttgccgccgagcgcccggtaaacatacttccgagcaccctgcttagattggcagtcgccgtgccagtcaacacactcaaggtgctgaccaccgcctcttttgccgtaaatccggtaatcaacgccgtagaaaccctccagtccgaaaaaccgagcggtccaaacagcggtgcgatccactgccccaccagagcgagcagacttttctcactgtctgtcaccacattaagcttcagatcaaaggtctgcaagaaccagatgacaatcgttgccacaaagataatggtaaacgcgcgctccaggaaatcctttgccttatcccagatcagctgtccgacactctttgccgacgggaaacggtaattcggcagttccatgacaaacggaatcggattcccgcggaacgccgtatgattcaataccagcgcggataagatgccgaccacaattcccgccgtgtagagaagtatcatcacgaccgcctcgtttcccgggaaaaatgccgccgcaaacaccgcgtagatcggtattttggcagaacagctcatataaggcgtgagcataattgtcatcttccggtctctctcactcgacagcgtccttgtcgccatgaccgccggaaccgtacagccgaatccgatcagcattggtacaaagcttcgcccggaaagtccgatcttacgcagcggcttgtccatcacgaaagccacgcgcgccatgtagccggagtcctccagaatcgagaggaagaaaaacagcaccacgatgatcggcaggaagcttaacacactcccgacgccggcaaaaacaccatcgatgagcaggctgtgcacaaccggattcagtccgtacgcggtaagtcccctgtcgcagacggcagtaaacgcgtcgattcccatcgccagccagtcgctcagagccgcgccgaccacatggaacgtcagccagaaaatcaaaaacatgatcaaaagaaacatcggaatcgcaaggtacttgttcgtgagcacaccgtcgattttcacactccggatgtgttctctgctctcctgacattttttaaccgtttttttgcacaccttctctataaaggtataccgcatgtcggctaacgccgcattccggtccagtccgcagtctttttccatctccgcgatactgtgttccatcatttccagctcattctcagaaagagccagacgctctataatgtccgtgtcattttccacaatcttcgtcgccgcaaagcgcggtgacatcccgatatttaccgcatgatcctccacctgatgcgacaccgcgtgaatgcagcggtgtaccggtccctgctcgcagaaatccatgactttgggcggtatctttttgcccgcgacttccacgatcgccgcaatcagatcctcaattccctcgtccttcgccgcactgatcggaatcacgggaatccctaattcctgcgacatctgtctgtaatcaatggaacctccgtttccgcggacctcatccatcatattgagtgctaacaccatcggaatgtgcatttccagaagctggagcgtcaggtaaagatttctctcgatgttcgttgcatccacaatgttgatgattccatccggcttctcatttaagataaaatctctggtgacaatctcctcattggtataaggtctgatggaatagattccggggagatctaccacggaacaattcttcgtggagcggatttcccccatcttctgatccaccgtaacgccagggaaattgccgacatgctggttagctcctgtcagctgattaaacaacgtcgtcttaccgcagttctggtttccagccaatgcaaatatcatttttcttcctccggtttcacttcaattttcgctgcgtcctcccgccggatcgtaagctcatacccgcggatgcgtatttcaatcggatctcccatcggagccaccttacgcacctccacagcagtcttcgggatcagtcccatatctaacagccggcaccgcagtgtgccctctccgccgaccgccgtaatagcagcgcgctttccgattggtagttcctctaacgtcatattttccacacaccttttctcttttgatattgatattcattctcactaatactaatatgatgcctctgcattgtcaaccggcattccggtgtaatggaacttttttgcttcatggaataccaaaaggaattgtcgcaataagcccaggtctctttggggtgataagtaatattataagaaacgcacttggggatttcatgtggaaatgcagagggaatattcgttggagaaaaatgtgagcatttcttccagctgaatgtttgcatcagattccgtgtctcttccacgttttgacaatccgccgggtgcatgtccgacacaccggagacaatgggcggactttctggtgtccctaagggcacctcttcacagacaatataaaaccgcgcgaaccgaaactcactgccatctgctattaaaaacatggcagatggcaattcagacatcggcttcgcgcggttatgttttgttcgacataaaggtggcatttatgccacctgttgtctggtgccgcaagggacacacacaaaagtcctacaaattgtcttccgggatgcggacatgacccgcggagtgctccaaacttggaaggacacggatcatcgaagatgcaaacatccggctggttagaaataccacattttttgaaccgaattttcctctgcattttcatctgaaatcccactgtgtaatcttctgatcatattacttatcaaaccaaagtacgatatgcttattgcggcagttccttttattttccgcatcccggatcaaattcgggattacacatataaaagttactgcggtcgagatcgtcctgaatcatccgaagtccctcgccgaagcgctggaagtgaacaatctcccgctgacgtaaaaagcggatcgggtcgcagacctccggatccttgaccagacgcagaatattgtcgtaggtcgtgcgcgctttctgctccgccgccatatcttcaaacagatcggtgatcgcatcgcccttagactggaactcgcacgcattgaacggaatgcctcccgccgcctgcggccagatacccgccgtgtgatccacatagtaaggcgcaaaccccgcctcctccagttcctccgcactcagtcctttcgtgagctgacggacgatggaagcaaccatctcaagatgtgccagctcctctgtgccaatatcggtcagcagccccgccaccttccgatccggcatgctgtagcgctgcgacaggtaacgaaacgatgctgccgcttctccgtccgggccgccgtactgcgacaaaatgatctgcgcgatcttcgcattggggcttgtgatgttgaccgggtactgcaggcgtctctcataattccacattagcagccacctccttcccacggcaggggctgttttgcccaatcccagtaagcatctggatttgccgtatcaatcgtcagcggtccgaatttgtccgcatacacctgcatggcatttctgcgcatttctatatgatgattgaagtaacagatcgcttccgcatctatgggatgcgtatccagatactccgtaatgtccaccacagcaaagctcaccatattgatccagtgcagaagctgtgcctgattcatctgtgtcatctgattcatcagcaacgcctgcacccccttcccactgccagaaacggcttatcaagttctgggaatatggttccggtttcaagtgccttatccagttcgtaggtcgttttaaagtgctgccagggaacatatgccatcgcaaccacatattccggctgtctatcagaagctgcatccggttcacacgcacatcggctgcgcgtgtttcctgctgcattgtaatttctcatgcggctctcctattatgatatcttccctttactctatgccgcatcccattcacttgtgctaatctccctcgttaattttatctactgcatttaaaatcttctccatctgggggcgcatgcttccgaccttgtctaaaagctgttctgcctcctctttctgctcgttgacctgcgagagattgttctcaatccgtgcgcgcagcttctgtctgcgcccgatcagtccgtgcttgatctccaccatctccttgggatcgacgagcgcaaccgcttgtgttacccacacatgcgcatcgtacagttgataattggagagcatgcgcaccagtctgccgttaaaatattccagatcctcattggttctctgatatttctggcgttccttgaccgcctccagataatactgccactggttttccagttctccagcactttttacatggtatttttcacacgcataatcgaccgcattggcaacattgatatatttcagcttgaccttgttaagcagaacaatcgcacggttctggctccgctccgccacctgtatctccgacaggtcattctggattttcatgtaaataccgcacaccaccaccgcagttgcaaagatcagtcccatccacgcatagtagaaatccttttccagaataatctgtaaaattccgaacaccaccgcgagcgtcaccgccagaccgacaataatatacagcacattttttaactttttctgctgatggtccaggtattccttgcgcagattccactcggacttttcccgttccagatatttcatatccctctgcagcgtatcccggtgcagttcgttggtcttaaaacgtttgattgcctccggcagttcccgctcctgctgctctaactgtgcaaactgtgcatccgacagcttcttggaagagttgaggaattccgtgcgtgccttgtttaactgcaccacatttaccgcgatctcagaaatcttatctctttcttccttcggtatcttctccagagtctcaatatcattcagataggacgtcacaatccggtattcttccttctcatcgtccagctccttggtcagctcaatcatctgctctaagcgctccaccacgtactgttcaatcttaccggtatttttataatccttttttgagagaaccgttgtatttaattctcccatcttactctcaaaatcaggttcctttttctttctcttccaaaaaaacatcgtttcacgcttcctctatattctgcaatttttccgataggtatctttccactctgcaagcattcctgcaatttcatcttcctgcccgtcggcaaacagtccgtccacctgctcttcaaactgacggatttcgtccatccgggaaagttcggaaagcctgtgcgccgcctccgccgcctcctctgctgtcatgccgcattccgccgccgtattcttgaatccgtcatcatcgtgcagacaccggtacgcatagagacattcgcggagagattcgggattctcattgagtccgtacgccttccggtaacagtccgctgcttcccgaaaccggaataatccggtatacgcttttcccaggttatgccagacattcccgaccaggatcggattctccgctgcctgattcgcaagcagcgttctgtacgccgcgatagctgccgcatagcgcccgtttgtcacatagcggtcagcgcggatcttgctgcactcgtattcggatttgtgttccagctccgcgatctgctgcgcaatctgcgcgatctgcattctgtcacaatacccgctctgcgacagcagacaggtcacaaactcggacagggtgccgccttttctcacaatctcccgaagggcatctgcagcatcttttagtttcagttcccgttccagccagttgcagagatcctcattcataaaatcactgcggagcagatagacattgtggcagatataataacttaattcctccagcgagtaaacgccgattgccgcctcctccacataatatggaaatgccgccatattctgattgcacagaatcaattctcccatcgtcttctcccacacctctacggattctcttccgaaaattccatccggtaatcccacactttatccgaactcttaaataattccccgaatccaagatcccggatctggatccagacctttgtatccgaaaccggttttgccgtgatgcgaagcctcgttgccttgtccgggcgttccggcagatccagaagctttagcttctccaccttcgcctcccggcttcccggcggctgcagccagaaatcaatctccggcgttcccgcaaggatcacttcgcacattccctgcgtctcgtaccagttgtcccctgcactgatcagcgtatagaactctgcttttcccatattccggacttttaagctgacattgactttcatctcattgtcgcccagatatacataatcccagttttcctgctgttcactgcacaaggcggcgtagcaggcccccttggagtacagattcttcccgacaaacgctctcctgccctgacacagaaacgccacggactgtttcatccagtccccgtcaaatccgtctcccgtcaggtacaccgacgagacaatatgtccgcggaagcagtcctttagaatgccaagaaaattctcgtcccggctgtccgcattcatccggcgcacttcctccgccagcgagatcagctgcggcgtcgtgcgtttttccttatataatctgcagcagcggatatcctccctgcggtaatcgaacagatacacgtcgtgcatcgaaagttccggcacctgatggtaggcaaaatagtaaaaacattctttccggtcaagcagctgcaacttttcccggtcaattccaagcttcggcgccatcgaaaggaacagctccgtcgcctcccgcgacagcttttccatacagatgaccagccggtccggctcccatcttctgtcggggccgcatgccagtcgtatcagttttttcagatagagggtcagcagttcctccgccggataggtctccccatccacaaaaaccttctcaccgccgaccgcccgcgagagaagtctgccgttcgcctcctcgccctgtgcaatggcaagccgcactgcctcctcgccgacaaaccactgcccgattcctttcttcttggtaatcagcgccggaatctgatagatttcgctccctgcaatcgcagaaaaggtctccggttctttcttattcaattcatagctgctgatcacagcgtactggtcatccagatcgattcccagataaaaccggtgttccatatgttcccctctctgtgctacaatagccggtatgcctcttccgtcacttttgtcatgccataatagcgcttcatcttcccggcaagcttctctctgtcatcgagcgtacacgccagcagcatctcattcagccatgcgtagcggtctccgctgccctcttccataatatccccgttgcccaggcagccgctcgccccgatctgcccgtccgcggtctggctctccaggatataatactgaaccttctccccgaagaacaggataaagtcttttacatagattccgtcatacatttccgtcaattcatccgcaagatattcctgctgtgcctccagccggtaatgaacctcgatctgctgccccggcgcggtgtgatattccagaaagaacttatctgtaagctgatatttgcgcagcagcttttcgtcgaacttccggaaaaatgcaaaatacagattatgccggatgcaggtgtcaagaagctcgtccgcgatctttctgtcacgctccgacaggtgattctccgagagatattttagcagtgcaatccggcagacgcggtttagatcgcccccggtcagataacgctccctgatctggcggaacacatgctccggcacgacggcgtcctccgtgagatacatattggcaaaataagagagatacgccatgcagaccagatctctgccgccccctgcgcaataactttcgtagatctcttccatgtgcggcgtgtaatcggtcgtatagagcatctgtgtcagaatccgctcttccagatcaaacgtgtcgatctgaaattcgcccgcagctttccacaattccgccatctgcttggtcggcccattaaaatacttgcagaggtaaatcagcatgacatcgctgtattttccctgccggaaggtgctctccgcaaatcccagcagaaaatcatcctcctcatagccgtgatccgcgatcgcatagctgcagagggagacgcgccactccgtcttcagataatcgtagccgtcgatctgcaccatctgataggccttctcatagaggtggttctccgtcagaagcgcggccatctgcctgcgcacactcacgtcggaaagtgcctccgcgagctgccccttcatcagatccagttccccctccgaataggaaaaatccctgccgtcttttttctcgtaagaaatcagcgcaagtgcaagccggacgagataggttctggaaagtctgcctgactgcagcagctgcaatgcataggtcttctcggtatcgctccatgcctccggctccatatgccggctcatataccagagcagataggcgttctcccccggtgcaagcgagagacactgacccacataccgctccggatacatcagcgcctcatcctggtataccacactcgaacagaaccggttgccgttcgtatcttccagcacaatgctatactgtggcgtatacgccttaaaataggcggttccgttcacaaacgacacgctctgcggcattttcatctcctcatgccagatgatggctcgggcgatctgacggttgatgcagctgattctgtgtgtgaacaaaagcggcgccagactgtgtgccagttcttcatccagtatacccttgggcagcatctcatcgtagatcaccgccagatgatcgttgatgtgccccgcctcgatctgtgccattgcaaactgctccatcgtgcgctgatatttctggtatacctccggctgtttcgttctggctgctatgatattgacaaacaagaccgccttctgcgtataggaaagcgtactgtcatactggaaatacatctgaatcatgcgcggaactccgcccacctcacgcgcatccagcgacatcagatacgcctcatagagtcctgtaagccttatcttctgctcgattccgagctcataccaccggtggtactcggtttcgtaacactgtgtgcggatcagatatgcacagatggcagaaagcatctcctcctccggctccacctgatacgccgcctctaagatctcgtacagtacccgcgacttctcacgcacctccggcagcagatgcctgatctgctgtgcaagttcctttgtgaggactccctggcgcatcgcccaccgcaggactttcaattcatacgttcccagtctggttaaaagatagggatcctgccagatcagataatagctttccagatagagatacgggctgctgcatccgccctcgatccatgcttcaatcgccttatactttcttggactgctgtaatagtaggattcccgcaaaaacaaaagaatccagaacaacagcgaactcttcggattcttcttaaaaaggagttcaatctcatccgtcagcttatcgacataggacggttccctctcaatcagtgtgcacagatacagatagtatccccattccggcgtctccctgtccctgcagccgcgcttataatcctccataatccacgaagcttcctgcttctgccggttcacaatcaacgcctgcgctttcatcagcgcatacatctcacactccggttccattgccatcatatgatccaggagctccacggactgattcgcccatgcgccggtcacaatctttttcagccggtaatcaatatatagctgtgcaagccgcatccgtccgcgctgtaattccagatgctcctccgatacggcttttgcgccgtccgtcgtggcgcacacttcaaacgtaagcgtctgctccggcaggacaatcgaaagtcttccaaaattcttcccggcatgcatggcagcttttttaacataatatggcacttccagtgtgcttccgataaaatcctcatccgtcagctgactcttttccggcaaaagaaacggcgcgtccgactcaatcgaaatggagagatagccccactcatcccggtgcagcttcaggctctccctgcggtcgccggcgacctgctcgaatgaggcatgatccgcaagaagcgtaaccgcaaccggctttttctgtctgcacccgcgcagatattcctccaccttctgccatgacgccgtgccgtccgcctccccgtcatagagaagacgctccctgacctcggagggctttagtatatttttaaaatgaccggaataaaacagatgatatgcctcctgggcactgctttttgccagtcccgtaaaatcgttcagattcttaatgcgtcccgcagaggtatccgcatacaatctggatacagacacaacaaaagaaaggttatattctccctggttgcagattagaaaaaaatcccccttgacaatatccccttcgatcagtccattgctatgaaattggtaccggatccgcacctcttccccctcaaactggggtgtcagacattccattctggaatcagaagtatagactactccccgaaacggcacatggttcgtacttgtgataatgaaatctccggtgtaatctctaccctccgtcacctcaatgtcgactttatctgcagaaaaagaaagaagcggtctggcgtattggaactttccccttgctagctgttgtatccgtttacgcaaattgacacctgcttttctattgcttttttgaacgcaatgactataatagattataaactaatttggaggagtaatcaatgataaaacacaaggaccattttcatggaagtgatctcgagaaaatagaagaaatctacggcattaaaaaggaagaaatcgtcagtttttccgccaatgtcaatccgttaggagtatctccgctgttaaaacacacgctgtccgatcagatcgacgccattaccagctatccggacagggagtacacctctctgcgcagatgcatcgctgcatactgcggaaccgagacggagaatgtcattgtcggaaacggctccaccgagctgatctccctttttattcaggtcgagcatccgaaaaaggcccttgtcattggtcctacttactctgagtacgaacgtgaaatcgcgctgggcggcggcaccacactctattatccgctgcgggaagccgatgacttcaagctcaatgtcgaggattttctctcgcacttaaatgagagcattgatcttctcgtcatctgcaatcccaacaacccgacttcctcctcgatcccgcgcagcgacatgcgccacatcttagacgtctgcaagcagtacgacatctatgtcatggtggatgagacttacgtggaattcgccgataatatggcagaactcacggcagttccgctgacaaattattataacaacatcgtgattctccgcggcacctccaagttctttgccgctccggggctgcgtcttggatacgccgtcacaggcaaccgcgatctgatcaagtccatcaacacgcgcaagaatccgtggacaatcaattctcttgctgtcatcgccggtgagacaatgttcaccgacagcgcctacatcaaagagaccaaatcgttgatctcttccgagcgcgcccgcctgtgtaagctttttcacgagaatcctgacttcaaagtatacgatccaagtgccaactttgttctggtgcgcattctgcgcgaagatctcacctcgcaggatctgtttgaccgcgccatccggcagaaaatgatgatccgcgactgttcgacgtttccgtttctggataataaatacattcggctctgctttatgagaccagaggacaacgaccgtctgatccgctgcctcttccatcagaattaaagagaagcgggatccgtgatattggaggaaagcagataactggaagttccggatagaacagacggcggcaattctgaccgcaaaatccggtatttctaaccatgccgcgcttggcatcttcgatgatccatgtctttccaagcttggagcactccacggactgtgtccgcaagccggcagacaattttaggacttttgtgtgtgtcccttatggccacctctgaacaaaacataaccgcgcgaagccgctgtctgagtcggcatctgccctgttttcaatagcagatgccggcgagttcggttcgcgcggttttatattgtctgtgaagaggtgccattagggacaccagaaagtccgctcattgtctgcggctcgtcggacacactctgtgagtgtccaaacgtggaagagacacggaattggatgtcaagcacggcatggaagaaatacatgaattttgcttcaaagaattgccgccgtctgttctattccggaactttcggttctcgggtaatctcacaatatcacggatctcgcttctctttttatgtaaactgcttcatctcgtcggttctgcctcggatcgttccgatggctccctttacttcctccgcatagttccggttctgctcgcttatctcacgcacctgctcggcgcttgcagtcacttcctctgtcgctgcagacagctgtgagatattctccacaatacggttgttggaatccgacagtcctgtgatctgtcccgcgatctcattgatatctccgataagctgtgacatattttcattcagacgttcaaaagactctgccgcaaccgcaatcttctcattctggctctctgtcgcttccaccgaagactccaccgaagtcataacgtcgcgtgcattttcattcagctcgttgatgatcgtggtaatctcctccgtggacttcttcgtctgctcggcaagctgtctgatctgttcagcaaccacggcaaatccgcgtcctgcctcaccggctctcgcactctcaatggatgcgttgagtgccagcaggttcgtctggttggagatattgaggatcatgcctgcgatctcctcgacctccttggtcttattctgcaggcgtgtcatggactccgtcacttcatgattcgtcgccgcgatctgctcggactggttcttcaattcttccattacctgcagattctcctgaatattctcattggaatccgtcgccacatccaccatctttctggagcgctcgcccgtctcgtcaatagccgactggatactctgtgtcatattattctgctcttcgatattcttcgccgtcgtgttggttgcggaagaaatctcctgcatgctctgcgcaactgtctccgaagtgtgcaccagttcatccacaagactggtactcctctcagactcatcccgcacagtctttgagatgtcaaggattccttccagcatcaccttctgtttctcaccctcggacgctgcagaacccagtgcatgatcgctgaatgtcttggctatgctgcccacccggtacataatgaaaaataacagatacacacataatacccggcacaggctgtccacatcccgcaaaccaatccccttgattacacgaatgacctccaccagtgtaaataacgccgaaaaagcgatacaggtctgtttatatctcttcatatcataatacggaatctgcaatgtcagaatggcaataagtgcaaaatagataaactctgcatctgtctgcattccaatcaacgcaaattctacgccgacaccgatggcaacaaccctctttaatctcacatcagacttattgcgcagataaaacgccagttcaaccaccgcaaataaaataatcagcacaacatttccgaccgccgtaccgaccgcaatgctcttgctcgcaagcttcgccagcagatacaccccaaacagtacccataaaataaccactgcaaaaatataaaatgtattcatatagcggtagcgttcactcttatctttataaatgtaattcctgtctgaacccgatgtctgacccatagtcttactccctcctgtcactctttctctatcgattcaaaatctttttttattatagttcatttctcctattttttctactgtttttcaattattttgactaattttttacacattccttatcctcgcgcaacacaacgcatccgcttcttttccgtaagctgcggcgggttgctccagcgacataattctactccgacgcagtgagatcctgccgaagggctttttcattcataggacgtaatttcctatgaaaaaatccggcggatacttccgccggatctctcatccccactctttttcatatgccgtatacaaaaactccacgcagccgtctacgcggtacagcctgaaattctgtaaaaacaaaagtgccgcctcgtacattttttcatcctgctcgtccgcaaggcttccctcaagcagataactcatgccgttgtggtattcccgtccgtcctgtatcgtgtagtggcgccacagttcttttcgttgcgcacatgcggtctgctcccgcataagcgtctccagaaactgtacgcacggtctttccgcctcgctgtaatgattccggtacagatacacaaaatggtgcggcggttcgattccggaattcttcaagccatactggttgaccggataattgtccttctgctgcacccagccaaacaccccgtgaaatgtcaatccgccaaccgccgcaaactgcgtcctctgctctaattcctccggggaggataccttctctcccagttccgctgcaattcttccggcaaccacaaaaagccgtctgtgcatctgtgcacagcggtaaaaataccaagcgtcatagtacgtcgtgccggaccagttcaagccgcagcgcgccgtcaggcgctttcccgctctctccatggaaaatacactcatccgcgcattggcacgcaggaaaaattcaaggacagtctccgtgatttgcggctccgtcttcctgccggtgccgcctcccgtgtccttacacttctggcagcacaggccaaacagttctcccacaccgtcctcgtccagctttttttcgtgatagtcccgcaggatggcattggcaatctgatagagaatgttggctttccactttcccaccatgcgcacgatccccatgatatcctcataggattcacaccagagttcctccggatcctccgaatgttcaaaggtgtctcttccggggcggatccagctctcgccgtcgactgccggtctggctttttcgctttccgcctcccgctccttcgcctctttgagcagagactccagaaagagaacgctccacttttttctgccggtcttctccggaatccggtctgctgcgctgaccttttttgtcttcacccgctctgcttccattcctaacctttcgcattgtagcggctgccggtctgccgcgtctgattactgtccgacgcatagcggctgtaattgccgctggtcatataagaagttgcagaaagcgctgccgcctgttttctgcagttgctcttcacacccgaagccagcacctgcacgcggttcgacagcgtgctcttatccccgaaaatcttctgcaccgcctccggttttactgtctgaaacaccgtcttatcaaacgacagcgtgccgtctttctccagcgtgattccgatctgtttcagggcggtctcccgcgcggaaatctccgttttcagcttctttgcatatgtctcgtccacactgtccgacaagtcaccaatcttgcggatcatcatattgtaatcggatacaaaactttccatttccttcgtaagctgctttccggcgtcctctccctcctggtaaagggatttttctccctcctccagaaaacgcttcatatgcgtctccacacgctccgccgccagtcccgtgatctcataatcgtagctttttttctgattctccacgattttgtcgccggatacggctgtcccgttttgaaactgatttaaaaactgcatccacgcagatgtcctgtagtttttactctttggcgcgctctgcgtcgttcctttggatgatgcgcgtgtctttgtgctgctggaaaacgcacgcatctttgccagccggttgttcctcgcacccagaatggcagactggtctctgttataaattctcatactcattttccccgtttcttttctgtatccctatcgttcgttaagatacgtctcataagccgacgcaaaatcattaaacttctgtttcgccatcagaatggattccccgttcttcagcaggatcgttcccacctcaaaactttttaccgcggcaaaattcaccagatacccgcgatggcagcggaaaaacccgttgcctaaaatttcttccacctccttcattctggcataatatgcaatgattcccgtgtttgtgtgaagcaccaccttacgccccacactctctgcatagagaatggttttctgatccacacagcaataggttccgtctgttttaatcagcagcgggcgcttcctttctgcccctgcttttctctgtttcagttctcccgcattgtcaaacgcttttctgcggaaccatactggaatctttttctggcactcctctatgccactatccgaaaggaaaagaacatccggcattgtgccgcttccctcaatttcatctccgcaaagaatctgtacatcctctcttacatattcgccttccatctcttttaaatacttacgcacggatgcctcattcccgcacgccgcaatgtataacactcatattcctccccgctttcgcctccatgctctgttttctactttatatatcggtcatatttttcattcttttatttttcgtaacgaaatacgctgtttttgtcatcaaaaaacagttgacacgcttactgtattattgtattatcttattagtacagatgatttagtagaaaggagatgacactatggcatggacccttgattctgatcgtcccatctttttacagattgtggaacgaatccagacggacatcgtttccggccgctaccagccgggagataagcttccgtctgtacgtgatctcgcagcggaagcatccgtcaacccgaacaccatgcaaaaggcctttgcagaacttgaacgcaccggtctggtctattccaggcggaccagcggacgttttatcacggaggattgtcatatgatagaacagttaaaaacctctctcgctaccgagaaaatggaagaatttttagcacagatgcggcagctcggctttcagaatgatgaaatcctgtcgctcatgaatcagacgatgaaaggggaaaaacaatgagtaccttgttggaatgtaaagatctgaccaaatgttacggcaaaaaaaccgccatcgaccatatcaacctcgccattgagagcggacatatcatcggtctgctcggaccgaacggaagcggcaaaaccactctgatcaagatgatcaacggtctgcttgcccccacctccggttccatcttcatgcagcagaatccgatcggcgcagagagtaagaagcatatctcctacctgccggatcacacttatctgaatatgaacgagcgggttcgcgatattatccggtatttttccgatttctatgaagattttgatgagaagcgtgcctacgacatgttgggaaaacttcagattgacgcctcggatcgtttgaagaccatgtccaagggaaccaaagaaaaagtgcagctgattctcgtaatgagccgtcatgcggatctgtatattttagatgagccgatcgcaggcgtcgatccggcagcacacgattttattttaaatatcattctgtcgaattacgaaccggaagcttccattttgatctcgacgcatctgatcgccgacatcgagaatattctggatgaagtcatcttcatcgatcacggtcagatccggctcaccgcatccgtggatgatatccgtatgaacaacggtaagtccgtcgatgcacttttcagggaggtatacagatgttaaaaaaattatttaaatatgaatttaagagcacggcaaagatcatgttgatcctgtacgccattctgatcatcaccacatccgtaggttccgtggtgctgtattccttagatctggatcaggcgggtgaaagcaaactggcatccattctatccgtctccgcgattgtcctttatatccttgccatttttgctgtccttatcgtgatgtacgtgtacctgtgtgtccacttctaccgcacgatgtattccgctcagggatatctgacacacacgctcccggtaaaaacacttgctccctttcacgtaaaactgataacctccttcgtgtggatgtttctctccatggctctgatgactgcctccatcgtggcgcttatcgccagcgcctcccacggaaccgcatggcaggattttacttccgcctgggaggagttattcggtcaggacgtattttccttccgtttcatcttccagatggtattgagcgtgatctgctcctgcttaatctacctgctctgggtgtttgcaagcgcttcgatcggacagcttttctccagcaataaagtggctgcctccctcgtcgcgggcatcatcctctattttatgcagcagattttctccatgatcctcatgtttggaaccggtatgttccagtcgggagataattccgtgaatttctttgccgttaccacaacgatcgacaatacgaccacatcgacgacaagcatcctgccgagttcactgtttgccaccagcaacatttactcgatcatcgtcattgtcattttgtacctggtgtgcgccagaatcatcacaaaacatctgaatctcgaataacgttctatcaggggctgccacttaagaccggcaacgcctctggatgtgataagtaatattatcagaagatcacaccgtgggatttcagatggaaatgtagatgggatattcgttggagaaaaatgtgagtatttcttccagctgaatgtttgcatcgaattccgtgtctcttccacgtttggacactcacggagtgtgtccgacaagtcgcagacaatgagcggactttctggtgtccctaatggcacctcttcatagacaatataaaaccgcgcgaaccgaaactcgccggcatctgctattgaaaatatggcagatgccggctcaaacatcggcttcgcgcggttatgttttattcagaggtgccaataagggacacgcacaaaagtcctaaaattgtctgctgacttgcggacacagtccgtagagtgctccaaacttagaaagacacggatcatcgcggatgcaaacattctgttggttagaaattccacattttttgaaccgaatttccatctgcatttccacatgaaatccccaagtgtgcctcttataatattacttatctaatatttcttatgcatgaaaggaggctgccactcatgtgacagccccttcccgaatctattacgtatttattttgtgttcaagtatgcgtcaattcccttcgcagccgcttttcctgcacccattgccaggatgaccgttgcagctcctgtcacggcatctccaccggcaaacacaccactcttggatgtagcaccgttttcttcctctgccacgatacactttctgcggttcgtctcaagtccctttgtcgtggaagaaatcagcgggttcggagaagttccgagcgacatgatgaccgtgtccgcctcaatctcatactcagaccccggaatctccaccggacttcttctgccggaggcatccggctcgccaagttccatcttgatgactctcgcgccttttacacagccgttctcatccactaaaagctccgtcggattctgtaacaggtcaaaaataatgccctcctcctttgcatgatgcacctcttccttacgcgccggaagttcttcctcaccgcgccggtacacgacatgtacttccgcaccaagacgcttagctgttctcgcagcgtccattgccacgttaccgccgccgacaacgatcactttctttcccgccttgatcggagtatcgtactcctctaaaaatgccttcatgaggttgtttctcgtcaaaaattcatttgccgaaaatacgcccattgcctgctcgcccggaatgcccataaaacgcggaagacccgcgccggaaccgataaataccgcctcaaatccctcgttctccatcagctcatcgatcgtgacggatttgccgatgacaacgttcgtctcaatcttcacgccgagcgccttgacattctccacttccgctgcaacgaccttctgcttcggcagacggaattccggaataccatagacaagcacgccgcccgcctcatgcagcgcttcaaaaatggtcacgtcatagcccaattttgccagatcaccggcacaggtaagtcctgcaggaccggaaccgatgacagccaccttatgaccgttcaacttctctgccttcttcggcttgatgccatgctctctcgcccagtctgctacaaaacgctccagcttgccgatcgcaaccgcctcgcccttgatgccgcggatacactttccttcacactggttctcctgcggacatacacgtccgcatactgccggaagtgcggatgactcactgataatgtggtaagcctcctcaaaattgccctcttttacctgcgcgataaacgccggaatattgatggataccggacagcccttcatgcactgtgcatttttgcagtttaagcagcgcgttgcctccgccattgcctcctcggcattatatcccaaacatacctcctcaaagttcgctgctcgcacctgtgggtcctgctcacgaaccggtactcttgtcattacgtccataggaacctccatactctgtattttctatccggcagacgcgctcattctctctgcctccgccttctaacgatcacatctgccttctcagccgcactgtccgcagccgccgtgatgggtatctccctccgtcagctttaacatcgctctgccctcttctgtcttatattgctgctggcgcttcatcgcctggtcgaaatccaccagatgtccgtcgaattccggtccgtccacgcaggcgaacttcacttcgtcgccgacaaccagacggcatgcgccgcacattccggtaccgtccaccatgatcgggttcatggaaaccaccgtcggaattcccagttcctttgtcagcttacagacaaacttcatcataatcatcgggccgattgccacacaatgatcatagcgcacgccctgatcccagagttcctgcagctgcgccgtgccggttccgtgaaagccgtaagagccgtcatccgtcgtcacatagagattcgctgccactgcccgcatctcatcctcaagaatcagaagatccttattgcgggatcccataatcacatcacagtccacaccatgctcatgcagccactttacctgcggatacaccggtgcggtaccgacgccgcccgcgatgaacacaatctttttcttcttcagtttctcgatatcctcatctatcagatcagaaggacatccaagcggtcccacgaaatctgcgaacgcatccccctgctccaaggataccatgcgctgtgtggaagctcccaccgtctgaaatacgatcgtgatcgtaccggcttccctgttataatcacagattgtgagcggaatacgctccccctgctcatcaatcttgacaatgacaaactgtcccggttcgcaatactgtgcaacacgcggtgccttgacatccatcagatagatcttgtctgccagcttttcttttttaacaatcggatacataatttcctcctcgccctttgtactatcttaatataataaaggaaaagcccctacatttcaacggcttttcccatattttctgtttatatctgctattccgacttcgtttcggactgtatgtgacgttttttctccctgcgccctactcctgtgtctccactttggaaaataggatacggtcgttatcgagcgcctttcccgcgcggagcgcaaactgctccaacaagtcatccaccgacatcgccgcacgttcctctcccacaacgtccaacacaatgtttcccgcgttcatcatcaatgtccggttgccgagcgtcagcgcctggtgcatgttgtgcgtcaccatcagacaggtgatctgccgctctgccacaatctgtctggtcagatgcagcaccttctctgccgtcgccggatcgagcgctgccgtgtgctcatccagaagaagaattttcggtgtgaccatcgtcgccatgagaagtgtgagtgcctggcgctgaccgccggagagaagtcccaccggctgtttcatgcggtcttccaatcccatgtcaagcagcgccagctgctctctgaattttttcttatccgccgcgttgatcctgctgaaatatgcattccgggaggttgtcgtccgaagataggcgagcgccatgttttcctcgatcgtcatgtgcggcgccgttccctttaacggatcctgaaacagatgaccgatcactttgcttctcacatgctcctgctgataggtaatatcctccccgccgagcatgatcagaccgcggtccgggaaaaaagctccggtgattgcattgaacagggtagattttcctgcgccgttgctgccgacgatcgttgcgaaatctccggcgccaagcgtcagattgacgccgtttagggcacacttttcattgacggtgccgggattaaaggtcttgctgacatttttcataatcagcatggattctctttctgctgccatatcacgcatttcctccttttcccatccgttcttctctcagtaattccgcaatatactgctcattctccgcttttgccgcccgtttctgccggtagaacaccgcctgcttctttaggtacgggaaagcgatcgccaccgccacaataatggaggacaccagctttaagcactctgccgggacattcaggcgaagcgccaccgccacgataaaacggtatagacagcttcccagaatcacgccgatgacccgctttaacatgctgccctttccgatgatcgtctctccgataatcaggctggcgagtgcgatcgtcaccatgccggttccaaggttaatatcacaggacttctggtactgcgcgagcagtccgccggagagtcccgtcagcgcattggcgacgcacagaccgatcgtaatcatcattcccgtattgatactggatgcccgcaccatatccggattatccccggttgcccggatggaaagtccgagtctcgtatttaaaaacagagagatcaatacgccgaccagtgcgacaatcactgccgccacgatcagcttataccaggttccgccgatcgcgtcttttgcccatgtaaatacggaatcgcaggcaaacagattcaggttggaggcgaatcccatcaccgcaatattgatcgtgtaaagtccggtgttgacaatgattcctgccagaatcgactgtatgccgagtctggtctgcaaaaatgccgtcacaaaaccggaacacacaccggcagccatcgccgccaaaagtccgagtaccggatgtcctgccagcgtaaccgaagcgcacactgcacatcccagcgtaaaacatccgtccgttgacagatccgctatatttaaaatactaaacgaaatgaacagtgcaagcgcaaccagtgcataaataaatcccagttccagtgcactctgcacgatcgataaagtgatgattgatcccatattattcaaactcctctgccgttactgtctcaataacttccgaacacatatctttaaacatggagtagtccagtccaagtgcttctgccgtctctgtatttacggtcacaattccgcgctctaaggtctcgatcggagttgccgccggatcggctccgtttaccagaatatcgactgccatatcggctgtctttgtaccaagctcctcataattgactccgtaaccgcagaatgctccgtttaatgcgaaggagtccgctcctgtgtagtgcgggattcccgcatcgatgaacttctcaaagatggaaagttctgccgtcatgacggtgttgtcctgcggggtaaacactgcgtctacaccctctgccaccagggcatctgctgccgcctgcacctccgcagaggtcgtaccggtcttctccacataggcgattcccttctcatcgcagtatgcctttgcgtcctcaatcgcaccaagggaggaagcctgactcttatcatagagcagtccgacctttgcggtatccggatttgccgccagcatcagatcaaaaatcgctgccgtgtcgatggcatctgacgttcctgtaatattggaacccggtgcgttcacatctgccgccagtccggcgcccaccggatccgacaccgcggaaaatacaaccggaatctgattctcctcggtcgcactctgcatcacgactgcggtcggcgtcgcaatcgggataatcagatccacatcatccgccaccagatccgctgcaatctgtgtcagaatcgactgatctgcctgcccgttgaacgtgtaatccgcataatcaaaggtaactccgagctctgctccttttgctgtgagttccgcttcaatcgctttttcaatctgatttaaggaagcatcatccacatactgtacaataccgactttatatacggttccctccgccgctgtctggtctgcctctgccttctgtatctccgcctgcgcgtctcctcctgcctcattggtcaattccacggtcgtaccggagccggaactgcttccgcagcctgccaccgctgttgccaccatcgtcattgcaagaactgctgtcatcattttctttttcataatcatttcctcctttttcctattacataaaaaaagccgtctcaagctattgcttgagacggtaataaactaatattatcgcggtaccactcatcttgacaaaatgtccactcacttcatgcactatcatacatgccggatggataacgggtccggttcccggcggctcctacctgcgtatccactgttcaggccgccctcaaaagtccattcaacaaatccctccatactgcaatcccaccgcctgcagctctctgtgatctcggataaatgtctactactctttctcaaaggtttatcggtatgtcatttactttaatacattaacgtgtatttgtcaaccttatttttaaatttccatcagacggaacttctcgatcgtctgctccaaatcctgcgcgatattctgaagtgtctttgtgtagtccgtgatgtctgccatcgtcgtgttgacctgatctgtggatgcattgacctcttccgtcgccgctgccgactgctccgatacggatgcaatcgcctccatacgacttacgaccgtatccttgttggatgacatgtccgcattgagccggttgatgttctccatgccggcattcagctgctcaatctgcgtgataatctgacggaatacctcttccgtgcgctcgatcgctttctgctgctccgactgaagctcctcgttctcctgcatggtctcttccacctgcttggacttgtccgtaatctcggtgataatcttcttgatctcatccgttgattcctttgactcatccgccagcttccggatctcgtctgcaacgaccgcaaatcccttgcccatctctccggctctcgccgcctcgatagaagcattcagggaaagcaaattggtctgtgccgtaatatccgcaatcgcatcggaaatatagaaaatcttgtcaatgctggcaatcatctcattcatcactgcaagggacatgctcgacttctctacggtcttctgtgatttttcgatcagatccttcacgctgccgagtccctccgaactgatccggttcgtctcctcggtcatctggttgatctcgctgacacaatctctggaggactccagactgttcttgaggttgtccacctcactgcttgcctcctgcgtgctctccgcctgcttcaccgcaccgtcagccacgctcgagatcgcctccgcgacctgtcccatcgtgcttctggtatctcccgcgatctcggaaatatgatccgaagtctctaaaatatgtctggacttatcctccacctcacggatcactgtggatacatccttgaccatatcgttaaaatgcgtctccagcgcaccgaactcgtctcctctggtgaccgcaatcgtctgggtaaaatctccctctgccacagcagctgtcgcacgctcaatctttttgatctcacgcacaaggctgtacgcggtaataagcgcgatcacaataccgaagatcactccgaacgcacccgcaaataccagcgcaccgttgatcttcgcaagattgccggtgttctcgacatcgctgatgcagcccagaagaatccagcctgtcacctggtctgtcatcgcggtcaccgcacagtccatgccatctgcacgcatcgtgtatacagactccagtgtgatgtcggaagcgctctcatcgcccgcttcctccagggcgctcttctgctcctccagagacttcagttctccggaaatcggcgtccagaattccagacccgtcacatttccgtccgcaaaggtatttttgtcactgtcgatcacaatattgccgtccgcatcgatcagcatggcaaatcccgtgttgagaatgcggatattcctgatataattctccagttgcgccgcatcaatatccatcgccacaacgcccattaagacatctttgtatttgacctcctgcgctacggtgaagatctgcccgcctgtctgcggatcctcataaggctgtgtgatatagctgaaaatagaatttacttttgcctttctgccctggcagttcacataccagtcttccccggacagatccacattttcctcgatggtgttcatcgccgtcttatcaccgttgtcctcgtacttcacccatccggtgatgagttttccgctggacgtcgcataatagcttcgcaccgctccctgcgttaccttgcacgccgccaccagttcatcctgcacgttggcaatatagtcatcaaactgatcctcgtactccagctgcttgatggaagtcttgcgcgtcagcagatccaccggaaggctgatcgtcttctcatacgtctgcagactgttcaacgcgctctctaacgtctgctcgcttgtgagctgcatgttgctgtttaacacattcttcgtacggctgtatgtaatcactccacagatcacaacacttcccgcaatcgccacaagaaagctcaaaatcattttcggccctaaacccaattttttcatctgtttcctccgttcatactgcaatatgacactttattacttacattgtagatgtttcgcacatttttgtaaatatccggtattttctttcattgtattacattctaaacaaaaacctccctgccggcattctgccagcaaggaggttctcaaaaaatgcccacgcactctgctcctatgaaaaataaacaagttcgtcttccggcttttctgcaggtgtaatggaaatcggatacagtaccggtccttttcccttgtactctcttgcaaactccaccttgatctgcgcggtaatatgaatccaggacttgtgcggaatcttatcctcatccggatatttgcacttaaatccgatgaaggtaatatcctccacacagcaggtcatcgcaaaacgtcccggaacaaaaatgcccttcttgagcttgtcaggattgtatacaagcgccagaaagctgactttcttcccctcgtatttcttcgggttgtccaggcagtccatataccagattgcataatccgcatctgtaatctctagttcatctcccgagatgtcaaacggcagctcctcctcgcgctcgtcgagcgatccgtccgcgcgctcatacacaagctgtgccttacggttgagcgccttgacatttctgcggtattttcccttatccgtgctgtcgtcacagcggttaaagatcacgacgtccgcctgaaacagctgttccataatcatcgtgcgcatattggcaagatacatatcaaaggtggtcgcatccacggtcgcaagggactgcaccaccatccacccgcgcggaagctccgtctcggtgagcgtatccattccccaggttccgttatattcgatgaacacctgatccggcagatatttcatattgatggcattgagaaaatcagcagtaaaatcttcctcattctccaccatcacgaggcttgcattgatttttttcaactctgcctcatcatattccacctctccgtcttcacagcagatgatcaggctctttccctgatcggcaaacccgttctccagcagcgtctccttgatcagagtcgtcttgccactgtccatgaatccggtaaataaataaatcggtatctcctgcatgttctattcctctctgtcttatctcactattaaaaggcagtcttcacagcttaagcgattccaaataactcctctaatctgtgctcgtcgatatctgttccgatcacgcacagacgtcccgtataatccggctcgccgtcacgcagctcgtactcccccggcaccatgtcaaaataaatccaggagccgttctcatcctccaccatgcccttcgcacggagaatggttccatagtcgtccgtctcgcacagagtctttaagacatcctcaatctttgccttggtaaacttatgcggcgtctcttttccccagcttgtaaacacctcatccgcatgatgatggtgatgctcatgatcgtgatcgtggcagccgcaggtacagttctcgccgtgctcgtgatgatgctcatggtcatgctcgtcgtggtcgtggtgatgctcatgatcgtgatcctcatggtcatgctcgtcatgatcgtgatgatgctcatgatcgtgattctcgtggtcatgctcgtcatggtcgtgatgatgctcatgatcatgatcgtcgtggtcatggtgatgctcatggtcatgctcgtcatggtcgtgatgatgctcgtgctcatgctcctcggcttcttccttcgcatgctgctctgccatcagctttctctcaagagaatcctgtccctctaccacctttaaaatctgctctccgcggatggaatcccacggggttgtgatgatggcggccttatcgttgatggactgaatctgctttacgcagagctccagctgctccggcgtcgcattctggctgcggcttaacacaacagtggttgcatattcgatctggttattgaaaaactcgccgaatgccttcatctgcttgctcgcctttaatgcgtttacaaccgtgatgagcccgttcagctttacatcctcttccttctccacgtcaatcacagacttcatgacatccgagagcttgccgacgcctgacggctcgatcaggatacgatccggatgatacttgccgatcacctcatgcaggtttctgccgaaatcaccaaccagtgagcagcagatacagccggagttcatctcggtgatctgaattcccgcatcctttaaaaatcctccgtcaatgccgacctccccgaactcgttctcgatcagcaccagcttctcgcctgtgaacacttcatcaatcatcttcttgatgaaagtcgtctttccggcgcctaagaatcctgaaataatgtcaatctttgtcatatctatctcttcctttccttacaatacatcatttgttccaaaacacatatattttactcgtttttcctccattttgcaaatcatatgcatttttttcatatattttttataatatttctccggttcactgcttctgaaactgcatgtgatacagtttttcataaattcccttctttgcgaggagttcctcatgcgttccctcttcctcgatgccgttttcggtcagcacaagaatcttctcggcattcttgatcgtggaaaggcggtgtgcaatcacgaatgtggtacggtttttcgccagtttttccagggagtcctgaaccaccttttcactctcattgtcgagtgccgacgtcgcctcgtcaaagatcaggatcggcgggtttttcaaaaagacgcgcgcgattgagaggcgctgcttctgtccgccagaaagcttgatgccccgctgtccgatgtcagtctcatatccctgcggcaatgacatgataaattcatgggcattggcatttttcgccgcctcgatgacttcctccctcgtggcgtccggtcttccgtagcggatattctcatacacggttccgacaaacagatagacgtcctgctgtaccattccgatgtggtcgcgcagactctttaaggtgaggtcccgcacgtccgttccgtcgaccttcaccgccccctccgtcacatcataaaaccgcggaatcagggagcagagtgtgctttttcccgctccggacgctccgacaagcgccatgtaagagcccgccgggaccgtcagattgatatgctgcaatacctgttcagtattctcctcgtactgaaacgacacatcttcaaaagtaatatctccgcgcacatcggtaagctcttttgcatccgcccgatccttgatatccggctcgatctccatgatctcgcagaagcgctcgaaaccgctgtacccgttctgaaactgctccgtgaaatcgatcaatgtccgcacgggatcggtaaatacactgatgtagagcacaaatgtgacaagatcactgacattgaccttaccatttgcaataaggatggttccggcgagaatgacgttgacctgaatcagtgtcgtgaacgcgcccaatcccgcctgaaagcttcccatataatgatagctgttcttcttggcggacaaaaatcccgcatttcctatcttaaactttttcttctcaatctcctcgttggcaaacgactttaccacgcggatgccggagaggttatcctcaatctgcccgttgatctccgcaatcttcacacggttctggcggaacgcacgccgcatttttccgttcaggtaatacgcgtaagcaaacataaacggcaggacgatgaacgccgccagcgccagaagtgggctgatattgaccaggatcacaaacgcaccgatgatcttgatcgccgagagaataatattttccggtccgtggtgcatcagctccgtgatgtcaaacagatccgtcgtgatccggctcatcagctgcccgaccttctggttgtcatagaaagaaaaggataacttctgcagatgctcaaaaatctcggcacgcatgttgtactcgattttcgctcccattacgtgaccgtaattcgagataaagaacttgctatagcagtccgcgaccaccattgcaaacagcgcagccgcaatgattttgatctggtacataatctgcgccttatcctcgtacacgagcgtgtaggtgacatagcgtatcaccagcgggatcgcgagcgcaacggcagccgacaccgtcgcaaaaaacatatccgcccagaaaatgccgcggtatggcttatagtaagacaacatttttttgaaatttttactcattttcacactccttatctctttttcaaaagactcttctattttatctgctacgcgaaaaatgtcaagcgacacgccgcacgaactgtgctatactatacatagttacgattaccatttaaggaggcatcattatgaacccaagacaaatgcattatgaaacgcttgccggtaccatcatcaaaaatcttgccagacgccgcatggaaggctactactgcgccaccgtcgaggacgctgaaaagatggcattctctttccttaccccgggctgcacagtatctttcggcggctccatgaccctggaggataccggaatgctgaccgccctgcgccacgatccgggaatcaccctgctcgaccgcgcccaggcaaagacaccggaggagacaaaaaagatctatcacgatgctctttcttccgatttttattttatgagcaccaacgcgatcaccaaagacggcgaacttgtcaatatcgacggcaccggcaaccgtgtggcagccttaatctacggtccggaacacgtgatcgtcatggcaggcatgaataaagtggctgcaaacgtagacgaggcattaagccgtgttcatggtaccgccacaccgatgaactgcaagcgtctcggtaaaaatacgccttgttccgctaccggcgtctgttccgactgcctgtcccctgactgtatctgcaatcaggtcgtcatcacaagacgaagcggcatcgagggacgcatcaaagtcattctgatcggcgaggaacttggatactaaaatccaggtttccacccgacaaggcagaaaaaatcctgcttgccggatttccacgccgcgcatggctgcttgcgacctgaattctattacgaaaaaaagagttaccgcgaaacggtaactctttttgcatacattagttgtactttctttttcttgctgcttcagatttcttcttgcgttttacgcttggcttctcgtagtgttctctcttacgaatctcctgctgaatacctgcctttgcgcagtttcttttaaaacgacgtaaagcgctgtctaaagtctcgttttcttttacaattacactagacattatctcacacctaacctccctccagttgcgtattgtgcatattcaactgtttgggtcatattcattgcactatataagattataacacatatttttttcccgtcaactgtttttctaaaaaagcgaaaaattcagacaatttactcttcccgcagtttgaatttggtaatcagaccatccagggaatctgcctccgccgaaagttcctcactggtagcagatgtctcctcggaagctgcggaattgctttgaataacatccccaatatccttcacgccgtttgcaattctcttaacggactctgcctgctgatcggaagacacacggatatttgccacttcctgaataatatcgtcaagttccgtcaataccttgttcagggattctgccgtctgctgtgtcacggtgttgccacggtcaacctcactctgatttgcctccagaagatgtctggacgtctcagccgcctgcgcactgttctccgcaagcatacggatctgttctgcaacaaccgcaaatcctcttcctgcctctccggctctcgccgcctcgatggatgcgtttaaggaaagcaggttcgtctgggaagcaatgctctcgatctggccgatcacacttacaagctcctgggaggtgccggaaatacgctccatggcctccgtcagttcctgcatcttctgctggctgacattcgcctccatgccgacttcctttgccttgtcatgcaccacatcggtggatttactgttcgcctctacctgctcagatacggttgcgacactctccacaagatcgtcaaccgcacttgcctgctccgttgctcccttcgcaagatcctgagagctgatagctagctgctctgcgccggctgccacctgatcggaagactcgcggatctgcttaaacgtgccgctcacatcggtcaccatgctgatcagatgtgtcatgacattctcaaattcgccgacataagattccttgcaattggatcttaccgcataattgccctgtgcaaactcttccagaatatatccaagatcctcaataatcttgttcaatgtagtgaccgtcactcggaaactgtccgccagctttcccagctcatcatccgagctgtactgcacttctacatccagatttcctttggagatctcttccgctacttttgtcagctccgtcaccggatccaccactgcatccacgatcttctggctgttcctctggatcagtctcgtatcattgactgccgtaataagaaatacaataagaaccagaatcgtgtaagcgagtgaaaactgcttcggcacataagccgccgcaaaaactgcaatcgctgcaatcacaagcgtcacatacattaccacactgactctccggtaacttccttttaccttatcactcagactaccttgtcccctatctctttcgtccatccctgtcctcctgttttatcagatatgcccatatcccgatacataaaaacggcatattgccgatacctacgtaccattatacaccgtttttactatttgtagcaacaaattataaaatatttttttgaattctaaattttataaatatacgcaatcgtgtatttctgtcgagtttttatgcaagctgtgcctcaagtgccgttttcgcctcggcaatggcatccggaatgcctgccggattcttaccgcctgcctgcgccatgttcggacgtccaccaccgcctccgccgactttacccgcaatgctcttgatgagattgccggcatgtgcgccgtgcgccatcgcatcgtctgtcgccatggcaaccagattgacttttccgtctgatgcagatgcaagaactatcacgccttctcccagctttccctttaactggtcgcccagatctctcagaccgttcatatcgacgccgtccacgctgacagcgaggagcttcacacccttcacttccacaacctgatccatgacatctccaagtgcttccttggctgccttgctctttaaggattcgttctcactctgaagtgcctttaactccgccatcagatgaccgatcttctcgacgagagttgctggtgttgcctttgcagccttggctgcagcctcgagttcttcctcttccttcttataatatgcaaatacattgtctccggtcagagcctcgatacggcgcacgcccgcagccacaccgctctcagagataatcttaaatacaacaatatcgccggtgttcgccacatgagtaccaccacagaactcctttgaaaaatctcccatggacacgactcttaccgtctcaccgtacttttcaccgaagagtgccatcgcgcctgtcttcttcgcttcctcgaccgtcatgacgtcggttctgacatcaatcttctcagcgatcttctcgttgacgattgcttccaccttcttaagttcttccggtgtcatcgctgcaaaatggctgaagtcaaatctggtgcgctcaccgtcctgataggaacctgcctgctctacatgtgtgccgagcacttcgcgcagcgctttctgtaacaggtgggttgcagagtggttcctgcaggtatccctgcgcagctttgcatccacactgagatctgctacatctcccgccttaatcataccgtttgtcatcttgccgatatggccgaccttaccaccacgcagcttgatggtctcttccacctgaaagataccggaggcggtgcggatctcgcccttatctccctgctgaccacccatcgtcgcatagaacggcgtcttctccacgatgatcgtgccgacctctccgtcggaaagcgcctccaccagctctgtctcggtggtgagcactgtgatctttgaagatgctgtaaggctgtcgtagcctgtgaactccgtcgtgatcgaaggatcaatctcatcgtataccgtagcatctgcgcccatgtaattcgttgctttgtgtgcatcatgtgcttttttcttctggatctccatggctttcttaaatccgtcctcgtcaatggaaaatcccttctcctccaggatctcctgcgtcagatcgagcgggaagccatacgtatcatagagcttgaatgcgttctctccggacagcgtcttctctccagctgtctgcatttccttctccatcttctctaagatggcaagaccctgatcgatggtcttggcaaacttctcctcttcctgcgtaagcactttgaaaataaagtccttcttctcctcgagttccggataaccatccttgctctcatcgattaccgtcgctgcaagcttcgccatgaaagtaccaccgatgccaagcattcttccgtgtctcgctgcacggcgtatgatacggcggagcacatagccgcgaccctcatttgacggcatgataccatcggaaatcatgaatgttgcggaacggatgtgatcggtaatcagacggatggacacatcatcgagcgcatccttctggtaagactttccggacagttcacagaccttgtcgcggattgctttcatcgtatcaatgtcgaatacggaatccacatcctgcatgacaaccgcaagacgctcaagtcccataccggtatcgatattcttctgggaaagttcagtataaccacccttgccatcaccctcaaactgggtaaatacgttgttccatacttccataaagcggtcacagtcacagccgaccttgcagtccggcttaccgcagccgtatttttctccgcggtcataatagatctcggagcacggaccgcatggacctgcgccatgctcccagaaattgtcacactctccggtcttggggtcacggtagaatcttgtgatacgctctgccggcacaccgacttccttcgtccagatgtcgaacgcctcgtcatcctccccgtagatcgacggataaagtctgtcctcctccagtccgagcacctttgtcaaaaactcccaggaccatgcgatcgcttcatgcttaaaataatcaccaaaggaaaagttgccgagcatctcaaaaaaggtcagatgtcttgcagtctttcctacattctcaatatcaccggtacggatacacttctggcaggtcgtcactcttcttctcggcgggatctcctgtcctgtaaaatacggctttaacggtgccatacctgcattgattaagagcagactgttgtcattgtgcggcaccagtgaaaaactgttcattttcagatgtcccttactctcgaaaaattccaggtacatcctgcgcaattcgttttctccgtaaaacttcttcacgacttcttcctccaacatgtttctttctattttaaatctattttgtctcttcgacgtttccggtctcaccggcattcttagcatccttgcggtcgctcaacttctttcccgcaaaaattccaagtcccgccaccacgaccaaaaccacgaaaatcagtacataatgtacaaaccatcccaaaaatgccatagtcaagtcctgcctttccccaattcttcacaccccgtgtgaaatcttctataactaaatcagtatagcgcaaccgttttatgatcgtcaagtaccgcttttttgaaattcctctcattcctcaaggatctcaaaaatctggttttcatgatttatttccacaactcgctccgccatcgcagcgttcgagattctcttccgataatccggaagcgcgctgtaatcctgccacatatgcatcggaaatacgtaatccgcatccgtgtgctccaggaaataattcatgccgtcaaactggtgctccatcagcctcggatctgccggcacaaacgccagatgaatcttcctgccagaaagtctgcggatctggctgcggtaatttgtacgcatggatccgttgatcagatcgccggctccgtcccagtgccagtcattcagatcgccggcatggtaaaatgccgcgccgttcgtctccacgtaaaacgccacaccggcatccgtcgagcgcagagtctcaatattcaagtcatcgaccctgcatttttcatccgcccccacatagtgaatccgcttcgccacctccggcgcaaatccatgttttaccagaaagtgcgggctcatcttacagtcttttgaaaaaataaaccggatcttcggatatttttctgcgagatgcaacacatccatatcaaaatgatcccgatgcttgtggcttgcgaacacgtagacgggcgtatccggctcatactccggcaacacaccgccaaagtgatacccctccacccggtctccatcaaaccagtcaaaaatcagcaccttctcatccacctcgaccagaaaacaactgtgatgaataaaaataacctgcataattctcctcgtttctccgcaatgtcagaagttctgccctgcaaatctaatgatttctatttcatgcggccgatgatcgcattcgcacgctgatagatctctttcggatcaaacccgatctcgaaatgattgtcttcatagagaactttgccgttaatcatcgtcatcttgacattctgcttgctgccgctgtataccagattcttcacgatattgttttccggctgcatgttcggctggttcaggtcaatcatgacaatatccgcctttttgcccaccgccagacggtcacagtcctccagctgcattgcatgcgcaccgccggctgttgccatgtaaaggatctcatctgcacccacgcactcggcatccatctcccgcacctttgccaatgcggaggtaaggaacatctcgcggaacatatccaggcagttgttgctcgccggtccgtccgtaccgatcgccatggcaatgccctcatccacgaaacgcttcgtcgggcagatgccggaagcgagcttcagattggaagccgggttcgtcactgccgtcaggtgacgctttttaaagatctcaaaatccggctcctcaaaccatacgcaatggtatccgccgccgccgtactcatacatgccaagcgaatccgtaagctgtgtcggtgtcatgccccagcgctctttgcactctgccacctcaagctttgtctcggaattgtgcagccaaaccggagatttcaacttctgtgccagcgcagccacgccttccatcagttcttttgaggtggtgtactccgcatggaatccgacgatgaaagaagtcagatcactcatctcgttgacgatatgatagttttcctccatcagctctaccgtgccgccgaaattgttcagtccgctggtctgcactgtacggaatcccgtatctgcggatgcttttgcatcgaccggcgggaagaaatacatatcaaagttggacgtaatgccgctggtcagatattccatgataccaagaatattcagccagtacacatcatcctccgtaagctgtccctcgcgcgggaacacctgctgattcagccagtcctgcagtggcagatcatccgcataggaacgtaaaaatgtcatggctgtgtgtgtgtgcgcgttcttaaatcccggcattaacagattgccgcatgcatcaatctcgcgatcccacaccagcacttctccctccttgcacacatccgccgtgtccgtcccgtcaccgatgtagcagatcgtattccccttgacccagagttctccctccgtgatctcaaacttgtgatgatctgcaagggttaagatctttgcattataaaaacgtgtattcatgtcactttctccttcttctgtctgctgtttccactctatgaagcctctctcccgtccagaatcttcaccgcgtctcttcggttattatttcccgatactcttgatcgtctccgtcacaagtgccttgaacttcggtgccacgcggtctgccgtctcctgtacttcctcatgacagagcgggaccgccgagataccgcatgccagattggaaatgcaggaaatacccacaacacgcatgcccatatgacgcgctgcgatcgcctcgcatgccgtactcataccaacggcatcagctccgagtgtccggcacatcgccacttccttcggtgtctcaaactgcggaccggaaagctgtaaataagtgccttcctttaaatcaatatccagtctcaacgccgcttttttcaccagaagctgtaattccttatcgtatacctggctcatatccgggaaacgcacaccaagctcgtccacatttgctcctcgcagcggggaaggaacaaagcttgcaatctgatccttgatgagcataaaatcaccggcgttcatgccaagctggatgccacccgccgcattggtaaggaataatacctccgcgcccatcagcttcatcagacgcgccggaagcacaacatccgacatatcatatccttcataataatgaactcttccctgcatgcacaccaccggaacttctccgacatatccgaagataaaacgtcccttatgtcccggaacggtcgataccgggaatccctcgatgtcgtggtaatccagtgtgtctgccacacggatatcatctgcataatcgcccagtcccgatcccagcacaagtgccaccttcggggtaaaattgatctttgccttataactttcatagcatttctgtaacttttcatatactggattcattgtcagttctccttttcctttcgatcacaaaattacttatattatataccatgcgctctgaaattccaatctcattcattaaaaaacggcgccattttctctccgacccacgagatgaccggaccgagtgtgaagcccatcaggatcgtcaccagaccgatcttcgcaccgaacacccacgcaatcacgatcaccgtaaaatcaaataccatgcgcaccacgcggaacggtacctttttctgcgccttcacaatcagaaacgggatagcatcgtagggggcagttcccagttccgtaaccatatacacacctgccgcaaccacgaacaccgccagtgccgggagcagcacgccgaggcgcactgccatggaatcaaacagcccgtccggcaatacttttgaccatacccacgagaaaaagtcaatcgaatagccgacgaggaacatattggcaagcgttccgaatccgatgtactcccgtccccacaatatcacgataataaataaaaggcagttgagcagcgcctgccagttgccgagactcatgccgagtctgcccgaaatagcaagattcatgctcgtgcaggggtctgttccaaaattgaccagcaccagccatgacagagcaaatcccatgacgatcaccgcgagaattaccgagatgagtctccttgcaaaatgtttcttctgatacattccctgaataaagtttttcattattttctctccgttctttccgatatatatcatagtaacacaggaacggcttttccgccagagttccctttttctcctgtgcgcttctctttaaaggcagcattatgattttatggcaattatttcccgctaggaatccgtgacagttttttcggaattcatgacagctttcttggattcacgatatttttcattggacagttatttctcatatcatatttttttcacatgaaaggattttttttatgcagacacttcatctgacagggatcaataaacttcttcatccggagcgcgacaaacgctccgccaccgagcgcatttttgaccatttaagccactcaaacatcggattaaaccgcggcgaagcaacggctgataccggctctacggcatcggcgctcgacagtttttctgtcacgcagaatatctcggagcttctcagtcccgcctgcggcatgagcgaggaagagaaaaaagcctaccttgccaaaatcattgcgaaattaaagagcggcaaaaagcttacctcagaagagatgcgctttctgcaggcggaagatccacagctataccagcaggcggctcgtgtccaggcaatgcgtggctcccttgagtcgggtcttgcgcacagcacttccaaggaggaggcgcaatctgtctatctggacgcgctcaaccatatcagcgaggatgatctcatgaaagaatacatcatcgccgcctatgatgatgccatgaaggaattccagaaatccgaccagtaccagtcgctgccagagacaaaagaggatgccgcaaagcagcacaccggttcccgtcattcccatagctgataatttgagttcatgttgcagcaattatctttgtgtgcctgtcttccaagctgccagaacgcaaccgcactggcagctgcaacatttaaagaatcaacgccgtgcgccattggaatacataccgtatcatcgcatgctgcgatcgtctccggtgccagaccatctccctctgttcccagtacaattgcaagcttgtcctcattcataagcttcggatcatcaatacttaaggaatcctctttcaatgccatcgccaccgtatgaaatcccagttcatgaagctgcttctgccaattcccggaatctgctttctcttccggctccgagtttcgttctatccctgttcccgactctttctcttcttccggctccgagtttcgttctatccctgttcccggctctttctcttcttccgactccggatttctcacagtctccggctttgtctcctctccaagatatgtccacggcacctgaaacaccgtccccatactcacacggattgctctccggtaaagcggattgctgcaccctgtggtcagcagcaccgcatccattccaagcgccgcagcagagcggaaaatagcgcccacgttcgtcggatttaccacattttccaaaactgcaattcgttttgcccccttgcagacactctgcaccgaagggagcggctgccggtacatcgcacagagcattcctctggtcagttgaaaacctgtcagcttcgtgagtacatcaaactccgccgtgtaggccgggatctccccgcaccgtgcaagaatcttctgtccttctccctcaacatgccgtttttccgtcagaattgacaccggcatatagcctgcgtccagcgccctctcgataaccttgggactttccgcaataaacatacccttttccggctcatggcggttaatcaactgattctctgtcagtcttgcatacacatccaattccggtgcatcaaaatctgttatttctatcatctgtgccattttattcctcttccacatctactgatttctgtttgttcgttgtctcacccgatcttgcggtgccattttcgatcgttttatgctttcggctgttttctgatctgtttctctttgcatcctgacttttgaccgagatttggcttcacagtcgatttcctgggacaatttggttttccttgtaatcaattcattttccctttcgttttccgggcttgatctggctttccgtacggattttggtacctgcatcttttccaaacgggtctgtacggcaaaaatatcctctccagacccgtttttccttgttttcgatcatatttaacatgaaaaaccatagggaacgggtctcaggagcactttttcttctctgagacccgaatcacagggaaaaacgggtctcacaggcaacttttcccactatagacccgttggtcatatcaaattcaggatctgagtctcataaacatttaattataataccgatctttatcagaagtgtcaatctatccgtttctacacccggaccggtgtctgtcatgcagatttcccacctctgtttttcctgcccgcattttgaaatgcttttctggcacttttacgttgtatgaaaattattcttccacacccgaaaaatacaaaacaggcgaaaaccctgacgttcatccgcctgcctttcgcctgttctctgccagcttcgctacgctttctgcaacgtccttcgcctgttctctacaggcttcgctgcgctttctgcaacgggttccgcctgtttccctccacctcttgtctctgcttttttccggctttctgtttctctattgcactcttctttttctgcttccttttttccctgccctacaaaataatgcataccatcccgccgttgttgtcgttcacaattttctgcatagtatcctgcagcttcatctgacactcgtcatccatcatcgagatcttgccgcggatgccgttctccatcagctcaccgatggattttccgaaaatattggtctcccaggctccctcctcgctcttttcgccctctctgatgtaggcgatcagatcattcgcctgctcctcgcttccgacgatcggcgcgatctcggtctcaatattggcacggatcatgtggatcgagggggaggttgcgcggatgcggacgccgaatttatttccgtgcttgataagcaccggatcttccattttaatatcggagagtccggggcctaccacgccatagcctttcacctgtaccgccgccatcgcgtccgccaccttttcatatgcctctttccgctgcgtcatctccttcaccagcgcgatcagttcatattcgccggcaatcggcacacccgcaagctcgctcatattttcatagtaatacttctcagcgacctccatgcggattttggcgcagccagatgcgagatccacttcctccaatttcatccgcgagacatagtgctccggcgtaaaatcctgtgcataaatatctttcacttttcgcattccaccgaggatcgttctggcgctctgtatgatttccgccttcatcggatgatcgggcgggagcatttccgtccatttcggaatatagaattccatgcgggcaaccgggaactcatataaaatctgctctaatatatgaaagacatcatctttgcgaagctgctcgcaattcaccggcagcaccgccgtctggtacttttcccgaagttcctccgcaatgcggacggtctcctcgctgtagggtctcgtcgaattgagcaccacaacatagggcttgccaatctcctccagttcctgcacggtctgctcttccgcattcacataattttcccgcggcaaatctccgatacttccgtctgttgtcaccacaatgccgatcgtcgcatgatcccttatgactttttccgtaccgatggacgccgcctccacaaacggaatctcatggtcgaaccacggcgtatgaaccatacggtccgtgcttccctccatgtgtccggcggctccgtccaccataaagccgacacagtcaatcagccggattttgatccgcgtatcatcctccaaagaaatctccgccgcgtctttcggaataaactttggttccgttgtcatgatggtttttccctgtgcagactggggtaattcatcaatcgtgcgctgcctgctatgtacatcttccatatagggaagtaccataaggtccataaaccgtttgataaacgttgactttccggtccggaccggtcctacaattccaagatacacctccccgtctgtacggttttgtatatctttgtataaatcaaactcttttttgctgctgatgtccataaaaataccccttccatacttaataaaatgtatgaagggggatctgtaattattcccgcggaaactaaaatatcatcgcgcgcggatgactctctggcgcagacaaagccggggatctgtacacttcgcttttctacagcatcacccgcagcattcccggcaaacagcggaattgcagcttcgtgacatcaccacagtattctccatccgcatgcagcaccataggatccttcagccgaacctcgcatgtgccgcagtcgtctatgtcaaatccgcggattcccgtatgctttgccgccacgaggaacggcaggcataaaaatgtgcgccacttcggaattccgtgtacactgcagatcgaaagctttccgtccgtggcatccgccttcggcgccatgggaacgccgcctccctctgccttaaagttcatcgctgcgatatagatgatgcggtctaacttccgctccggggtctcgtccaggcgcaccgcagcctccgtcgtctgcatggaaaaaagcgactgcaccgtaatgagcagataggtcagtttgcccagatgcagcttatttaaaaatattttcagcttcgatgtcagggcttttttgcagactaacgcgtcaagtcctacgccggcactgatggcgaactttctcggcttctcgcagtcatcccatgccacctctcccagatcgatcacggtgcatgcctctctcccccgctgcatgcaggagagcatgcgcgccagattctccgacggcgtgccgctaagctttaaccctctcgccaggtcatttcccgagccggtcggtatcagtccgaaccgcactttttccggatgtgtgatgccgttgatgacctcatttgccgttccgtccccgccgaccactgcaaggcagatatcatcatccgtcttcgcgcagatctcgacagcaagacgtgttgcatgcccctcatgctccgtgacataatgccggtaatggattcctctcttcacaagttctctctgtacctctttccagatctgcgcgcccctgccgcttctggacttctcattcacaataaaataaagcatctgtttctcccaccgtaacatacattctgctgtttccggcatgtgccggacatacaccgctctgttccacgtctgtttttcctatataaacacaatcgaaaacgcccacccggcctctgccagatgagcgtttctcttctgcaatgctcttttttatcgtatcacggatacacggcaattacaactgtttactgctcttttctgtctgcatcttcgcccacccagagacgtccgtacatttccatataattataaagccgtttggcaagcttgacggtaatctgatctgatgttgcacgccactgccagttgccccccagtgtggacggcgtgttcatgcgtgcctccgaaccaagaccgatcagatcctgcatcggcaccaccgcaagctccccgaccgaagaccatgcaccacgcatcatgccccagttatagccttcctctttcgtgaggtttaagtattcctttgcaaatttgacgctctccttcggcgcagtcttcatccagccaagcagcgtatcattgtcatgtgttccggtgtacaccacacagtgctccgtgtaggtatgcgggagataattgcttccctctctcgagtcaaacgcaaactgtatgactttcattcccggaaatccggaatccgcaacaagctttaacacggacggtgtcaaaaagcccagatcctccacgataatgtttaatctgccaagcttctgctccagcgtatgaaacagatccatgcccggtcccttgcgccactcaccattctttgccgtcttatcctttgccggaatcgcatagtaggaatcaaatccgcgaaaatggtcaatccggacaatatcgtaaagctttgacattgccgcaatgcgtttcgtccaccaggtgtatccgtttttcttcattacatcccaacggaacaacggattgccccagagctgtccgtcctcggaaaatgcatccggcggacaccctgccacatcaatcggatttaaatcctcatccagatagaactcttccggattcgcccatacgtcagcagaatcccctgcgacgtagatcggaacatccccgatgatctcaatacctttttcattcacataggcttttagctcccaccactgcttgaaaaacagatactgtaacatctgataaaagcggatatccttcgcataggtgcttctcgcctcggcaagtgcctccggttttctcatctttaaatctttttcccaggaaaaccatgcgtttccgtcgttggcatcctttaacgccataaacagcgcataatcagaaagccagtctgcctctttttcacagaacgcctcaaaatcgtccggctctgcgcgaaggaaccgctcaaacgcgatctttaacagcttatagcgcgactcgtacatcacgccgtaatccaccttgtctgctttctttccccacgggaaagactcacactccgcctttttcaacagtttttccttacacaggtattccagatctataaaatacggattccctgcaaagctggaaaatgactgatacggcgaatcaccgtaacttgtggggcagatcggaagaatctgccagtatttctgtcctgatttttcaagaaagtctgcaaactttctggcttcttttcccatcgtaccaattccatacggagatggcagggatgatatatgcatcaatactccactacttctcataacctcgtccttacctttcatctatcactcgaatactctccccatttacaaactcaaacggaacaatctcgtgaatcggctctttcttcaactcgatctggccgaataaaatctcgatgctgcggtttgcaagcgtctgatgctgctgcttgatcgtcgccagcttcggattgtaatactctgcaagcgatgtaccgtcaaaaccgatcacggaaacatcctccggcacgcggtaccccagatcacgcagtgcgcggatggccccgatcgccatcacatccgacattgcaaacactgcagtcacatccggaaacttcccgatcaggcgcttcatcgcccggcaggcgcttccaaaagagaatcttgccttctcatagcagtgctccacatcaagaaccgccccatgctccgaaaagctctgctcacatcccaggaaacgctgatgacttgtataagacttgtcaaaatcaccgccgagaatgccgattctgcggtgtccagccacaaacagctgatccaccgcacagcgtgccgctgcaatatcgtccgtggcaacgctggaaagattctcaaaatgcatctcattggcacggttcgtcaccaacacacacggcacatccacaccggagaactcccggtgaaaatattccggattaccgccgaggaacaaaagcccaagcggctttctctccctgcaaagaagaattgcctgctctacctcatctgcatcctcgtccagataagacacgaccagcgtatattccgttttctcgatcatgcgctggatttcctccacgacactggcaaaaagcatatttgagatacctttgaccagtacgccgattgccttggaattgttctgttttaaatgcttcgcattgttgttcggcacaaaattaaactttgcgacaacttcctcgatcttttttcttgcatccgggctgacatcatttctattattaagcactctggaaaccgtgctgacggaatagcctgactctctggcaatatcttttattgtaaccataacttttcctgcctgtttttgtcttcttgatttcactggcaattattatatcagcctttgacagctcctgcaacaacaccttctataatatacttctggcaggctgcataaaaaataatgatcggaacaatggcaagcaccagcatcgccatcatggtaccccagtcaaccgctccgtagccgccctttaaatactggatgacaatcgggatggtcttgtattttttcagatccagcaccagataaggcagcagatagtcgttccagatccacattgcctgcagaattgccaccgtgatcgtagtcggcttcataatcgggaataccacctggaaaaaggtctggagcggcgtacacccgtcaatcattgccgcctcctcaatctcaagcggaatgctcttcacaaaaccgcagaacataaacaccgccagtccggctccgaatccgaggtataccagaataataccgatgggattgcttaaatgcatcatgttcgccagctttgacagggagaacataaccatctggaacggcacgatcatggaaaacaggcataacatgtagatcgtggagttcactttgttatgtactctcgtaatgtaccatgcgcacatggaggtacagagaatgattaccgccacagaacctaccgtgatgataacggagttccccatcgccgcaaaatagttcgtcttctgcacgcccttgataaaattctcaattccgaagaaggaacggtgatccggcagtgcaaacggatatctcgtgatgaatccttttttctttaaggagttcatcgccacgaggaaaatcgggtacagccacagtaccgcaaggattgagaaaaatacggtcaaaatccatccgtgtttggcacgtcttaccgcgctcacctgattgtctgcttttttgttctttgccattattgctgcacctccttacttctggtaagtctgttctgtagcattgcaatgactgccacaatgataaagaataccaccgctttcgcctgaccggcgccctcccatccggttctggtgtagaatgtctcataaatatttagtgccagcatctgggaactgttcgaaggctcgcccgcagtcagcgccaggttctggtcaaacagcttaaaggagttcgtcagtgtcaggaatgtacagatcgtaatcgacggcattaccatcgggatcgtcacatggcgcagcagctgacggttcgtcgccccgtcaatctttgccgcctcgatcagctcacccgggatgttctggatgccggcgatatagataatcatcatataaccgatctgctgccagttcatcaaaattacgagtccccagaatccgtaggttccggaataggtaagcgtctttccgaagtttgccagaataccgtttaacaggatctgccagatataaccaagcacgatacctccgatgaggttcggcataaagaacacggtacgaaacaggttcgttcccctaattccctttgttaaaagcatcgcgatcgcaaatgcaaacacattgatcgtaagaacggacacgaccgtaaacagtgccgtaaacaccagcgcatgtgtgaatgttgcatccgaaaaaatccggatataatttttcagtcccacgaactttgcatcagtcaccgtcgtaaattcacaaaacgataaatagatacccataataaaaggaattataaaaccgattgtaaatgccactaaagtcgggagtgcaaaaacaggaaaatatttcttaattgatttctccatactctttcatcctctcatattcaataaaaccgatatcgggcagatgctttgcagtacccgcatccttctaaaaaagggtgggcagttctcatgcccaccccctgcattttacagatttttattcgtgtgttgcgtcgtactcggtcttccatccgtctacgaatgctgtcacaacgccatcccagtcgccggtaccctgtgcatactcaagtaatgcggaaccaacgccatctttccatgtctcggaaggaatggtggagaagttccatgttacagaatacttgccagccttggtgtaagctgcatctgcctggatgaatacgttgtctgcggtgtaaccgtcagcgaatgtatcaaacggtgttgtgaatcccattacgtttgccatggaatcacgtccctcgtcagatgtgattacccactcaaggaaatcaagtgttgcctgctgatcctctgcggatgcctgattattaacgcaccagtaattctcagaacctgtgcagagtccctgattttcctcaccgtccacaccaatgtagatcggcatcatgctcatgtcctcagctgttacgagataaccgttatcctcattggtcaggttgctgtactcccatgtaccgttctggtagaaaacagcctcttccataccgaactcggactcagcctcgtcaccggtcttgctggaaagaagacccggctcacaggtggaatctgtaatgtagagatcccagatctgcttgtagttgtcaaggtatgtaccctcgattgcatcggtggaatcaatgcccttgtccttgtactcatagtagatcggaaggtttgcaaggtgtgtcttaaatctccagtcggaagatccatccatacctgcggaagtaaatgctccctttaagtcatatccgaactgatcgttgatctcgtctaatcttgcctgaatgtcgtctgccactgcctttaatgtctcaaagttgttgatgtcttccggagaagagatcactgcgttgtccattgtgcagtagtcgtttaagatcgtcttgttgtaaatgatgccataagtctcgattacatatgcgataccggaaacctcgccggcgtcattcttcagtgcatagtcatcgctggtcagatgggagtagatctcgctgtttgaaagatccagacagtaatccttccagtttgcaagtcctaccggtccgtttacctggaataaggtaggagcttcggtcttggcgatctctgactttaacgtctgctcgtaagtaccgtctgctgctgtgataaccgttactggaacacctgtctgctctgtgtaggttgctgccagatcctgccatgcctgatcctgctccggcttgaagttcagataataaactgaaccgcccgctgcatccgtcttcgctgcatctgtatctgccgcctctgtggttgttgcagctgcatcgtttcctgtggtagctgctgcgttactgtctgttgtgctgctgtccccacatccagtaaacatcgttgcgagcattgcacttgcaagcattacggataacacttttcttttcataaatttaccctcctgatatgatttgttcaacttcttatgtaacgtttccggtattgttatcggtaatgtttccggtaacgttttcagttgatggttagattatatttccatgtgtcaggaaatgcaatacccaatcgttattttccacattattgccaagtttcaagaatacattttgtgatatttgtacaaaagaaaggctgccgcaataagcatagacctctttggggtgataagtgatattattagaaacacacttggggatttcatgtggaaatgcaggtggaaattcggttgagaaaaatgtgagcatttcttccagctgaatgtttgcatcgaattccgtgtctcttccacgtttggacaatccgacgggtgcatgtccgtcacaccggagacaatgggcggactttctggtgcccctaatggcacctcttcacagacaatataaaaccgcgcgaaccgaaactcgccagcatctgctattgaaaataaggcagatgccgactcagacatcggcttcgcgcggttatgttttgttcagaggtgccaataaggggcacacacaaaagtcctacaaattgtcttccgggatgcggacatgacccgcggagtgctccaaacttggaaagacacggatcatcgaagatgcaaacattcggctggttagaaataccacatttttggaaccgaatttccatctgcatttccatctgaaatcccacggtgtggtcttctgataatatcacttatcaaagcaagatatgcttattgcggcaacctttcatcctgcacattctgtctgatcaaagatcttatcgtcctcccgtcatgcgaaggctctctaccccatagacgatcacgcctgtcagccagacaaaaagcaccatcgtaagcggaagcagtccgaaattccaggacagcatcccgataaagcagaccagaaacattccgagcgccgcataattcattgcggtgtaggcacggaacgccgcgcggtatatctgcagttgttccgcctcatcgcagcttgcgatccacgttttctggaacttcagatcataaacgcttcccttcttttccggattgatctccttcgtaaaattcacaatccggttctgggcggttaccgttacgaccataaccgcaatcagcccgagaaatgtggctgctattttcacccacggaatctcttcctcccagccgctgtctatgccggtggacttcatgccggctgcaaaaaagaaaaatccggcaatgagcgccacattcgtgacaatcacaccaatgcccagtttccgctcgatcttttcgatcaactgctcttcctcgccgtcccagcgcctgtactctgctctggcgccgcgaagcattcccgtcatccacacagccagagctgccgcgatcacaagattcgcataaggtgcgatcttttgaagtcccgctgtgattcctgcgccgatatccgcctgccccttggctgccatagtcgaaaacgcgcctgttatcccgcccacaaccatggctgccaaaaggagcacgataaacttgcggaatgctctcctatcctctctctgattctcctcaatcttcgggttgcatttctctgtcccatctgtcatactcttctcctccctgcctgctatttctcttcctccggttcttcctcataggtaaaaatggcttccaccggaacctcaaacacttttgcaatcttgagcgccaacgtcaccgacggcgagtaatccccgcgctcgatctgactgatggtctgcctggatactccgaccagctgtcccatctcatgctgattaacgttgatttttgcccgatattcttttaaatgattgtataatggcataaatcctccatatcccgatgtgcttttcacacaacgcaccgctttctttgcggcacattttctcacaccgttattatagatatgacaaggaaagttgtcaatactttttgacaactttccttgtcacatcagtgcatccgccagcgcatgactgacggaacaaccatagcggcatactattgtaaatctgtttggaaaatgctaaaattcagatataagagtatgttatggaaagggaatcacatccaattatgaaagagatcatcaaacataagataacccacaatgtcaaccgcttaaagacttccctgaaatgggtggtattcgccatcctctccggtgtgctggtcggatctgtgggcacacttttttatctgtgcatggctcttgtcacgctcgtccgcacaaaaaatccgtggcttattttcctgcttccggtcggaggtattctcattgtaggtgcctaccgcctgcttcacgatgagcgcgataccggcacaaaccttgtactctccgccatccattccggcgatgaactgccgctgcgcatggcgccgctcatttttatctcgacgctgatcacccacctgttcggcggttctgccggccgtgagggtgctgccctgcagctcggcggcagtattggaaacggtctgggacgtctgtttcattttgatgagaaggacaagcacatcatgatcatgtgcggtatgagcgctgcgttttccgcgctgttcggcactccgatggcagccgccatcttctccatggaggtggtgagtgtcggcatcatgtactatgccgccctcgtgccatgtgtgatctcctcgctgatcgcccacgcgattgccacctcgttcggcgtgagcccggacggcttcccgctcggaaaaattccggattttacgatcggctccgccgttgaaatttccatcctcgccatcttatgtgcgctggtgagcattctcttctgcgtgatgctgcacggttcagatcatctgtataagaagtttttcaaaaatccctatctgcgcgtcttcgccggtggatgcattgtcgtcgtgctgacactgctcgtcggggatcagacctacaacggtacgggcatcaacatcatcgaccgctgcatggacggtaccgtccgcccggaggcgttcttcttgaaaatgctttttaccgccgccacactcggcgcaggatacaaaggcggcgagatcgtcccgtctctctttaccggagcggcattcggctgtctgttcggaaatgttctcggattttcgccgaccctgtgcacagcggttggcatgtccgctgtcttctgcggcgtgacaaactgcccgatcacctcgctgctcatcagctttgagctgttcggatatgacggtatgccgtatttccttctcgccatcgcgttcagctatatgctgtctggctactttggtctctaccagagccagaagatcgtctactccaagtacaagactaactatatcaacaaaaagacgcactagacaggaatagaaaagcgccgtcacacggcggtgcttgtcatgagtaacaggataggagattagagggcacaaagttccgaatgtatctgccaaggcagatctttgaagtaaaatctgagtatttcttccatgccgcgtctgacatcctattctgtgtctttgccgcgtctgggcaatccacagagtgtgtccgacaagccgcagacaatgggcgggcgttctagcgcccctaatcgaattgcttcacagacaatataaaaccgcgcgaaccgaaactcgctgccatctgctattaaaaataaggcagatggcaactcaaacatcggcttcgcgcggttatgttttgttcagcaattcgataaggggcacacgaacaccctaaaattgtctgccggcctgcggacacagtccgtggagtgctccagacttggaaagacacggatcatcaaagatgccggacgcggcatggttagaaataccggattttacggtcagatctgccttggacagatatcatccggaacgtttggctcctatttttcctggtatcactcataataatcagcgcctcgtgtggcagcgcttttctatctcctattctttctcgatacaacggtcgagctgtgcgagcagatcttcgtacttgcagagcccctgcttgcgccagtcgcattttccacagttctccataaagaaatccatgttcatcgccgcgcgtgcgtgtctgcacatctcgcggtatgtatagaccctgttctcctcgagtccgaagaattcgatgacccggcggtctttgttcacgacacggttgtggttgtggacgcactcgttcgtctccgtccggttcggacagttcgcacagatcatatccggttccgccaccagaaaaagttcctcgtccggatcttttcgcaggcgttccaccaccgccgtcatattttcacaaaacgcaccgctgtagccttttccctcatagagcgaagtacagacgatgtgatgtcctctgaatttgtctgccatagcaactgtacactcctaaactgccgcttttgtcttctcttccagaatatttcctgctgcaagcgccttgcggatcggaattgccaccagatacgcgcccacaacggagatcacgtccttcacaatgtaaggaacagataccgctacgaaagcagccggaaacggtgtggcagccacgatggcgaactgaatgacaccgagcagatgacacacagcaagaccggcaagtcctaacagcacgcggagccagatctgcttctgtgccatgcccacgccgcagagcattgtcaggaaaatgaatccccagataaatccgccgctgtagccggcaagccaggacggtccgcctgtcattcccgcaaacaccggaacgcctactgtaccgagcaggatatagatcaatgtggatgatgttccctttttccagccgagcacatagccgcacagcgccattgcaaaagtctgaagtgtcaccggaacgccggtcggcatcgggatcgtcaagatggacaacacgctaagcactgccgtaaacatacccactgttacaattgtctttgttgaaatcttcatgattctcctcgtttccgcaggaatcgcatattttaccgctctttcctgctgtttttcgcgcagaaatcccctatgggtctctctgtctgcaaaaacaatcataacacttttttgtcgattgtcaacctgttttgtctcgcagttgacaatcctctaattgcatttccggttctttccaaaaatcaggtcgtaattgatactgtgatagaaaacctcctcgatatcacaggacgatatatcatagttgccaagcatccacatcaccttcgcaatcacggactctaacgtcatatcgtaggactctaagaagcggcaatattctttcatgttgtggccgacctcgtagaccgtcatatcgcttccctcgtgcgccacctgcgtcgccatgaccaccagcttgtccggatgctcctggcacagccggtaaaactcctctgcgatagactgcggtataccgcccacgccaaagctctccacaatgatacagtcataattttcaaaaatactctttaacaccttgggacggattcccgggatcagcttcatcaggaaaacattttcatccagcttctcatagaaccggacttcctcctcgtacggaagcatggggatatagcgcataatattcatgtcctgtatcacggcgagcgacggatagtcaatactggaaaatgcattgtagctcttggaccgcaccttcttggcgcgggttccggcgatgacttttccatcaaacacaatctgtaccccctgtgagcggtcatcggcagcatataaaaagctgtcgatcaggttcgacttcgcgtccgtgatctccaggtcgatcggcttctgcgcaccggtaatcacaatcggttttttcgtgttctgcaccatataggaaagcgccgctgccgtgtacgccatcgtatctgtcccatgggcaatcacgaatccgtcaaaatcgtcgtagtgctcccaaatcgcatgaaccatgagtttccagtgcgacggctccatgttggtgctgtccagatttaaaagctgaaccgcctcgacatcgcagatctcttttacctgcggaatatactcgatcagctcctccggtgtaatctgcggttttaagccgttatccgactttctggacgcaatcgttcctccggttgccagtaataaaatacgtttcttctgctgcatactctctctccgttctatcgtaataatcccctcagtgcagcaagaagcgcctccacgttttcctctttggttgcccagcaggtacagatgcggacagcgctatgcgtatcgtccacacgcgcctgatattcaaatgcaaaatcgtcttttaacttttcaagcaccgcatccggaagaatcacaaactgctggttcgacggcgagtccacataaaattttacgcccatgtcctttagctcatcatggatcttttccgcaagccttgatgcatgcgccgagatctcaaaataccttttctcctcgaatagcgtgaggaactgaatgccgagcagtctgccttttgccagcatgccgccccgctgcttcatattgtaacggaaatcgcgcttcaattcctcgtttgtgatcacaaccgcctcgccaaagagcgctccgaccttggttcctccgatgtagaagacatccgtgagcgccgccacatcggcaagtgtcagatcattttcccggcatgtaagaccgtagcccagtcttgcaccgtctaaaaacagataaagccctctctctttgcagacatcatagatcgcctccagctccgcttttttatagatcgtgccaatctccgtcggattggaaatatagaccatcttcggctgaaccgtgtgttcaaaacttgcgtctgcataatgcgcgtccgtatatgcagcaatctgctctgctgtcagtttgccgtccgccgtctcgatcgtaaggcacttgtgtccgcaggactccagtgctcccgtctcatgtacgttgatgtgtccggtcaccgcagtgatcacaccctgatagtgtcttaatgcagccgaaatcactgtcacattcgtctgtgttcctcccaccagaaaatgcaccgctgcctccggtgcggcgcacgcctcttttatctgctccgcagctgccgcacaatatacatcctccccgtatcccggggtctgttccatgttggttgccgcaagtctctctaagatcgccggatggcatccctctgtgtaatcactgttaaaccgtatcatctttctgattccttttctctatgtatttgagacgcgaaccagctccttcagcttccgtgctgccgcgccgctgtcgatcgcctctgccgctaattttacacccgcttccatagattccgcaacccctccgacataaagagttgcacctgcgttcaaaagaacgatgtcacgcttggcgccgcgctccgttccgtccagaatggctctcgtaatctttgcgttttccccgccgcttccgccacgcagctcctccagcgatacgcgcttcataccgaactgctccggtgtgatggtaaatgttgtcaccgctccatcccggatctcggataccgtggtcgctcctgtaagcgtaatctcatccatgttgtcctcaccgctgactacatacgcgcgctccaccccaagtctgctcatcgccgtcgctaccttttccgtgagtgacggactgtagacaccgaccaccatattttttgcgcgggacggattagcgagcggtcctaagatattaaagacggtacggattcccatctcgctgcgcgcctgcccgacatagcgcatggacttgttaaaaagctgcgcaaacatgaaaccgattccggtcttctccacacactcctccactttcttcggatctgccatgatattgacgccgagcgcctctaacacatccccggcgcccgatttcgacgagatggagcggtttccgtgttttgccaccggaagtcccgccgcagccaccacgaacgccgacgtagtggacacgttaaaggtaaatgtgcggtctccgccggttcccaccagatcgatataattgtcaactttcggggaaatcgtctcagccttgtcgcggagcaccaccgcaaatcctgccagttcatccagcgtctcgcccttcacgcgctccagcgccagaaacgccgcgatctgcgcctgcgtcgcatcaccgcttaacatgatgtccatcgccccttttgcttcttcctcagtcagattctctccctcagcaacctttgcaatatattctttcatccctttttccccctctatgcgttcagttcctttttaaaggtccggcagtatgtctccgccgcctccggcgcaaagccctgctcctccagcagcctgataaaataacttccgacgatcgctccgtcgatcagatccgcaagcggcaggacatccgccgccgtccggatgccaaagcccatcatcaccggcagatccgtcgcttcccgtaccgaggtaagatagcttcttacctccttatggaactctgctccctgccccgtgacacccatggacgatacacagtagacgaacccccgcgctccggcgagaatctttggaatccgcgccccggacactggcgacacgagctggattaagatcgtatcctccgatgcatctagcgctgtcataagttcctcctgctcctcaaacggcagatccggaacgatcagtccgtccacccccgcctcattgcatctttttacaaacgcttccacgccgtagtgcaggatcgtgttgtaatacatcatgaagatgatcgggaccgtcacaccctccgtgcgcagttcctgcatcattgcaaaaatcttcttcacattcaccccgccgcagattgcacggtacgatgcgtcctggatgaccggtccgtccgccaccggatcggaaaacggcacgccaagctcaatcacgtcgcagccgccgcgctcctgcgcccggatgatttcttttgtggctgccagatccggcagtcccgcggtaatataagtaataaatgctttctcctgctttttgctgcaggagttcatacgcgcttctattcgattcatatctgtcatatcctccctcgccggacaacttcccggcttaatttaaatatccttttcctgcaagataatctgcgatcgtattgacatccttgtcgccgcggcccgacagacagatgaccatggtctcctttgcagcctgcttctcaccgaccgcctctttgcgctccctcgcgtacttcatcgcataggcgactgcatgggcgctctcgatcgcaggaatgattccctccagtctgcacagctccatcagcgcatccatcgcctcatcatcccggattgccacatatcgtgcgcgtccgcactcctttaaatacgcgtgctccggaccgacgcccggataatccagccctgctgagatggaatgcgcaagctggacattgccgtccgcatcctgtagcagataggaacgcatgccgtgcagaactcccggctcgccgagcgccatcgccgacgcgtgttccccggtctcgattccctttccggctgcctccacgccgatcagctttacccccttctcctcaataaaatccgcaaacatgccgatggagttcgatccgccgcccacgcatgccatcacgacatccggaagctttccctccgccgcaaggatctgttttttcgcctcgcggctgatgacgctctgaaactccttcaccatcttcgggtacggatacggtcccacagcagaaccgatgatgtaaaaggtatcctccgccgtttttgcccaggtacggatcgcctcgttggtcgcatcctttagtgtattgcttcccgatgtgacactgacaaccttcgcgccgagcatctccatgcgcatcacatttaacgcctgtcttttgatatcctcggctcccatatagaccgtgcactccatatcaaaaagtgccgcaccggtcgccgtcgccacaccgtgctgccccgctccggtctctgcgatcacctttttcttacccatgcgcttcgccagcagaatctgtccgatcacattgttaatcttgtgtgcgccggtgtgatttaaatcctcgcgctttaagtatattttcatgccgtacttttcactgagacgctccgcgtaatacagcggtgtctctctcccgacatactgttccagatagtagtggtattgtttgagaaattccggatcgcggattgcttcctcaaatgccgcatccagctcctccagggtattcatcagcgactctgccacatactgtccgccaaatgctccgtaatatgctttcctgttcatattttgtctttcctttcctacttacattccgccgcaccgccatcttccggctcacactccatctgttttttgcacggcttttttaaattctataatcttgattttatttttcattctttttccgtcgcacagcacttccacgccgctgctgacatctgcgacatcgggagcaaagattctgattccctccgccacattctctgcgttaagtccgcctgccagcacaaaggtaagcccttctgccagcagtttctcccggaatgcacgcacggcgcagcacatctcatcctgcccgtcctgttcccagccgaacgtctttccgctgccgtatgccccggcatcgagcacaatcccggcaatccggtgatattcttctctgcgccatcggcgaacctcggcaggatcacggaggttgactgccagccacaccggcagcttcgtctgcgctgcgatccgctccgcctctgcggcatccacgccatgcacctgcagcagatcaaatcctgcccgcccgatctcctcgatcaattctctctccggtgcaaccgtcacggctgcttttcttatatccttatgtaatttttcaaataattggcttgctttctgcactgtgacataacgtttgcttttctcgtacagcacgaacccggcgtaatccacaccggtctcgttgagcgctgctatctcatcctctcctgtgatgccgcagatcttgatcttcgtcaatgtctatcctccttaccgctgcttccagcgcactgccacctctcccgggtgctccgcctccataaaggctctcccgatcagaaatgcgtccacgccgcatgcttttaagaattccacatcctcgtccgatacgatgccgctttccgccaccagaagcttcccctgcggcaccatgcggcttaagcgctctgtcgtgtgcagatcaatggaaaaatccttgaggttgcggttattgacgccgatgatctttgcatcaagctttagcgccctctccatctccgcctcgtcgtgtacctcgactagcgcatccagccccagttcccccgcaagctggtagaagtcatatatctgcacgtcgtctaagattgccgcaatgagaagcaccgcatccgcgccgattgcacgtgcctcatagaactggtacgggtcaatcatgaaatccttgcgcaggatcggaagatctgtcatctgccggatctgttttagatacgccgtgctgccgtcaaagtgatccccctccgtcaggcaggagattgcatccacagaagcattgtattcctcaactctatctaataagttaatcttgcttttaattttaccaagacttggggacgcctttttgaactctccgatgatggaaatgacatctccctcaagcgctcccttaaaatcatgatggctgccctcatatgcctccgccagctttcgcatctcctgctccggtatccgtctcttatgttccggcagtcttctttttttatcgctcacaatctgatccagtatcatacgctgctcctcccttaaatgacacccgacaggaaattctcgatcatccgctttccgtgttccgtgtagatggactcggggtggaactggagaccgaccaccggatactctttgtgccgcatcgccataatctcgccgtccgcggtctgcgcggtgactttcaggcactccggcagatcgtctcttagcaccgccagggaatgataccttgccaccttaaccggcgtgtcgatcccggtaaaaacaccgtccaggcagtgtgtgacttcggactgttttccatggaataacgtcttcgcataactcacggttcctccgaacgcctcaccgatgcactgatgtccgagacagatgccaagaatcggtattttattgtagaaatgttttacgacatccatgcagattcccgcctcttttgggcttttaggtcccggtgaaagcacaatgcgctccggctgcatatcttctatctccccgatcgtaatggcatcgttgcgtaccacccggatgtccggcgtgaaggttccgatatattgatagaggttataggtaaaggaatcatagttgtcaatcaaaagaatcataagttttcctcctccagaagtgttcttgcaagcgccatcactttgttgcagcattcctgatattctttttccggcacggagtccgcgacgattcccgcgcccgcctgcagatagacctctctgcccttcttgatcatcgtgcggatcgtgatgcagaaatccatatcgccggaaaaatcgacatagccggtcgcaccgccgtagagcccgcgccgtacctcctccaattcctcaatgatctccattgcccggatctttggtgcaccgcttaacgttcctgccggcaggaaggatgccagcagatcaaacggatgatagctgccctttttccttccctccaccatggatacgatgtgcatgacatgggaataattccgcacattcataaaatccgtgaccttgactgttccgaattccgagatgcgccccatatcgtttcgcgccagatccaccagcatcacatgctcggcacgctctttctcatctgccagaagttctctgtggagtgcttcatcctcctccactgtctttcctctcggtctggttcctgcgatcgggcaggtaaacacacgcttgccctgctgttttactaacatctccggcgaacttccgatcacctcaaaattaccgaactggaagtaataaagatacggcgacggattcaactcgcgaagctccttataaagagaaaatccgtcacgtccggtctccaccgtccatcgctgggagagcaccgtctgaaagatatgtccctctctgatatagtttctgatcttctccaccttcgcgctgtacgtctctggcgtatccgactttttgcggatgacgccgtccctttttccgccctccggctgcgccgcctctttcatcccgtgcccggtgttctcttcacacctgctgtcacatcctccctctatctgctccggatgcatggcgcgacggatcagctcttccgccgtcacgccggcacgctttcttccttcctccgtctcctcctctaagacaaccgcggtcagcgtctccgccacatagtccatcacgataaacgctttcatcaacatcagctgaatcgtctcaatcccgatctcatccggattcttctccggcagtttttccgagtagcggataaaatcgtagccgacattgcccaccagtccgccggaaaaattcagttcgtcattctccttatgaatctcaaattcgtcataatattcttttaacagcgctaacggattgcccctgcgcacctcgcgctccccgctcttttttgtgatgacaagcgactccccctccgaggagatcagttcctccggttcccccaaaaacgtataccggtcatagttcttgtcatagctctcgagcagaaatccctttctgcttccgaccagattctcgtacatcgccgtcggcgtctcgttcacaatgctgactgttttcttgtagaccttatagatgcgcttcataaatcctcctctttcttcttttaattcatagaaaatgcgtcccatcaagaaagaatcctgctttgcaggattctccgcctgcggcgggttgctctagcgacataattccgctctgacgcagtgcgatcctgcccggagggctttttaattcattggacgtaatttcccatgaattaaaaaaaatccctgacccggtaaaccggatcagggacgaatatctcgtggtgccacccttcttctcttatcatgcttagcttctctctttttatcagccgtcctcaccggactcatctgacagaagatacaaaaagcggatacctccaaactggaaatatccgccaccaatcatgtatagactctcagatacagatgttctctatatcgtacccctgtaacgtgaggacacggcttccgctactcggctgctgttatccacctttcactttgctctcgcaaatccattccatccatactatcctgcctgctcccaccgccccaggctctctgtgaagaatcgtacagtgtactccttttgctcaacgatttctcatttatttgtcagtagtttactgcactaatgtggcaatgtcaagaagctttttattttcccgtcaccttttttctatcaatatgatatactttaagcattgatcctgttacaggaaatggaggaactctcagatgaacaatgatgtatttgaaacaatgcccataccgaaagcctatttcaagatggctctgcctgtggtgttcggcatggtcatcagccttgtatacaatatggtcgacacatggtttattgcaaagacccagaacaccagcctcgtcgccggcgtctctctctgcgccccggtgttcagtctcatgattgcattcggtgatattttcgggcttggcggaagttccgccatctcaagacttttcggaaaaaaagattatgacaccgcgcggcggatcagtgctttctgccttctcggctccatcttcttcggcattgctgttgccgttctgatgctgctttttcagacacccattctgcatcttctgggtgccagggacgataccatcgcttatgccggcgcctattaccgctttctggttctcggctgccctgccattatctttaatattgtcccggggaatctgctccgcacagaaggtctggcaaatgatgccatgattggttccgtcatcggcgctgtgtttaatatttttttagatcccattttcatcttctctctgcatatgggtgccggcggcgccgcacttgccaccatcctgagcaatctgcttgccgactgctatctcgtgtgggttgtattcaaaaaggcagggcatctgtcgatgtcctgccgcgaaatgcatatttcatcaggtcatgtccgtgacattctgctgatcggaattccggcttccatcacgaacctgatgcagagctttgcggtactcctcaccaaccgttttctgttaccttacggttctgataaagttgccgctcttggcattgccttaaaagtcaacatgatcaccatgctgattctggtcgggttcgccttcggcgcgcagccgctccttggctactgctacggtgcagacaaccgcgaacgcctgaaacaatttctgcattttgatctgctcgtgcagcttctcattgcgctcgttttcacagccgccgcctgtatttttgctccgcccatcatccgcatcttcatgcaggatgacgtcatcgtggcctccggtgccctgatgctccgctgtctcatgattaccgcccctgtgatcggcatgatcttagtcttcaccacactgttccaggcagccggcatggcgcttcccgcttttctgatgtccatcagccgccagggcgtgctgctcgtgttgtgtatgctgctcttttcttccctgttcggctacatgggaattctgctcgcgcaggcagtctccgatgttctcaccggaattctgggcttccttctgctgcgcagatcaaaaatactgctctgatgcgccgtgcgtcacaccgtctctgcgctgcggtaaacctgctcaaacgtatctcttgcggtattatgcttcccgatgtcaacaaccaccgcaccgatggacatggaagactttacgtgatccgggagcagggcaatcttctccttgtacagcgccgcaactttctttgcgtacttctgaatctctgcttccttgatcggcacccgttgcccgtgtccgcgcagaatctcatcgaattccatatagcgcgcacagcatccagctcttccgtggtaaacaacagatacatggagaacaccgaaaatgccgactcaaaccagtaaatgatttttggcagcgcaatgcggcagaactccgcaaaaaaccaagcacataaatcaccgacgccagcgcaaataaaatacttccgacctgcgctctggaaggtctcgcctgtgttattttacatattgcaatcctctgcgcaccggattgcgcaattttacgtctccatatgccgcattgcctgcaccatcgccataaaatcctgctcctttaacagcgcaattccctgttcttcatctcccagaaccatcaatacatctcccggctttatgtcaaaaatttttctcgcctttgcaggaatcacaatctgccctttttcaccgaccttcaccattccaaacgcatgctttcccttcggcggaaacggcaggcgtgtctccccgccctcataattgaccagttcatccagcgtcacatcaaacacctccgcgatcagccggctcttctccacatccgggagggactctcccgtctcgtatttggacagcgtctgcctggacacatcaatccgctccgccagttcctcctgcgtcattccacgcgtcttccgcagcatcatcagattatctttgaacatgtttcctctcctttttttctccaatcacacaccatcttatgaccggaattctttttatcagctcatagagaagatagccgcccgcataggctgcaattcccgacaaaaggtaggctgcaacccccgtaactttggtgtaccggtccagaaaatatgccgccgccgagagtgccagatagtggaatagatacagtccgtagctctttttagaaagccacgctgtctttcgcgacgtacggttgccccagcgcttcattcctcccaggactgccagacacaccgtccagccatacaaaatggaaaacggactgtttaccaccggctcctctgcataattttccccaaaataataccgcacataaaaaactgccagcaccacagccgcggttgcaagcgggacgctcacgcacgccagccggtcggtcactttttcatgggaaaagacatagtagcccagaaggaagcagatgccgtatattccgaaacgatacacacagatcaccggcgtattcaagatctgggcagctccccagacgggaatcacaagcagaaaaagaacgggcagcgcagctttttcaccaaacgcatacaaccggtctttttctattttgcgaagcagcaccagcaataccgacaatacccagagcacctggatgtaccacaagatcccgactccggataagatcatgatcagatactcgaccgccttcggcactttctcccacgactggtcaaacacatggctgaatgccatgttgaaatacccctgtatccaccagaacacgaacaggccgatcgtcgagggcaccagaagctttctcgttcttcccgcaagaaattcccggtcggtatgtccttccagataatatctggcacacattccagacaccagaaacagcagcaccataaaccacggatacagcaggtactgcacggcatcctgatactgtacctcccaaaacggcccgatcactcccgccgtcaccacgccgttatacataaaaatcacatggtataagaccacgagccccaccgtgatccagcggatgttatcaagatagtgtcttctcatatttttcccacctttgctctatattttaactcaagtataacaaaaatggaatggctgctccaccgcgcttccattccattttttatgctttctgttaaaaatcattgcatttctcttatcatctgttgtacagacagaattccgtcagggattacatctcttgcacggatcatatccggctgcaatcagttcctccctgcttccggagaatgccgccttgttttccggcgacatctgcgcgacactcgagcaggatgaccggtgaaacttctttgtgttcgtattgagcacgtattctcctgtcacgtccgctgtgccgcccgcggcagtctctcccccggatgatgcctgtgccgcgcttcctgcggtatctgccgccccggatgttcccgtggtgtccgcagcacctgccgcgacctcatccccgtcccggtaatcctgcgtcgcgtccacgctccagctaagggaggttccgtcacttgtgaccgtgatggttccctgcagatccgtccggtagagcgctgccccgcatgccttcacccggtcgagtaccgtgcgcgtcggatggccgtaggagttccccgcacccgcactgatcactaccgccgacggcgacacggcgcgcataaaagcttcggaggaagaaccctcactcccgtgatggctcgccagatacacgtccgactccagtgtcacgccggagtcaagcatcgcctgctcttcggcttttccggcgtcaccgcagattaaaaagctggtgtcgccgtacacaaggcggattccgacggaattatcgttatcctccttcggatcataggcttttgggcagaccaccgtaaaagaagcgtcgccaagcgtgtaagtgtctcccactgccgggtaggcaagtgcaatatcctgctcctttatcacgcgctcaaacgactcatagactctggtatccgtcacgtaatcgggagcaagcacctgtccgcaggaaaatgcgtgcagggcgccgaccacaccgtttaagtgatccgcatcatagtgggaagcgatcacataggcgagttcttccacgccctgttccttcagatagcttaccacaaacgaggaatagtctctgttgccgccgtcgatcagcatatacgctccgccctgctccactaaaacggcattgccctgaccgacatccaaaaacgtcaccgacagcgttccgtccggcatctgctcttctctctgtccttccgtccctgccgtcgatgcttctccgttctcctgctgctctgtcatctgctgctccgacatctgcccgtcctgcaaggctcccccggacagtgctgcctgctgccttaccgcctgcccgtccgatgctgctccgcatcccgacagcaaaagaaacagggccgcacaaagtgccactgccccgcttctgattctattcacgttgtatttcttatttttctgcttccccgctgtctgcatgtcctttttcctcttccataaaatacatgcgcgcagcgaaatcctgaaaataccgcacctcactgttgtatccggttccgccgaacgcctgtttaagcttcactccatgatacattaacatatctccggctgcatggcaatcctcgatctccccgtccatcttcttaaatctggcgatcagatccagcgccagcgaatcctgcctgatgtgtaccggtgagacggtattgaccagatccccgaaatccttgatattgtattttaagctgcggttatagaaatgataccgcgcatcgggttttaatcccttcgcctgatagctgtgatactgggtattcggtacgaccagcttctgcatcagcatccccaccgcgcgggtctggtcttccgacacgcaggtccactccatctggtttcccacgctctgggagagtgcactttcatgcgccccctctccgaatgtgcgtccgcggtaaaaacgtcccttctgtaacacctcccgccactgtttgtacagtgcgatctgcgcctttaccgccgcaaaatcctcgctggacagatcgcagaaattgcactcatagccgcagataccgaacgccgccacagcgaaccgtgtctcaagcggcgtcacgcggagcgtctggtggttcgggcacgccgacacatgggcgctcacaacggacatcggatagccgtaggaatagccggtctggatctctgcccggcagagcgcatccgtatcatcggacgcccagatctgtggaaaataggacaaaattccgagatcgaaccggttgccgcccgccgagcatccctcaaagagaatatctggaaaacgcgcggtaagttctctcatgcagcggtacagtcccagcacatagcggtgtgccacctctccctgccgctccggcggaagcgctctggaatagtaatccgtaaacgtccggttcatatcccatttgacataggagatctccgccgaggaaaatacctttgtcatcgtctcaataatatagtcctgcacttctgttctcgtaagatccagaatgcgctgattgcgtccctccgcgtgcggttttcccggaatctcgatcgtccagtccggatgtgcctggtagagatgactgttcacattcaccatctccggctccacccagataccgaaatccagcccgagcgccttgatctttcttccgagtcccgcgagacctcccggaagcttcttctcgttgacttcccagtctcccagggaatgtgcgtcatcattgcgctcgccgaaccagccgtcgtccatcacaaaaagctccacgccggcttcctttgccttcttcgccagagcaagcagctttctctcattgatgtcaaaataggctacctcccaactgtttaacagcaccggacgcaccttgtgcttaaacgctccacgcacgatgtgctcccgcacaaatgcatgcatgcactggctcatgccattgtagccctcacaggaatacgccatgaccgcctccggcgccgcaaagttctcccccggagccagcagccaggaaaatgactgcggattgatgccggcagtcaggcgcatcttgccgtagccgctcacttccgccgcctcatagtggttgccgctgtagatgaggttgcatccgtaacattccccagtatcctccgtcgtatccgtctttgcaatcatgacgaacgggttggcacggctggaggaggttcccgtgtaggacgcattgacatgttttcccgcctccatgcgcgtatcggaacggtgcatctccctcgcccacgcaccagtaaaggttgtgaacacatactctgccggatcaaagtctatctggatactcatcaggcgattcagacgaatcatctccccgctctcattaaagagaacggcgcttcgcacaatcgcatcgcactctgcgtagacgtcataatgaagttctaaaacaagatcataggagtggtcgcgcagccttatgctaagacgctgcgcctcccctttctcatcgtaagctcccgggagatctccgttttctgtctccgccgtcttttccgtgatctcataactttcatagcggaagtccgaagtggtactgccgtccgcgtgcacgatctccacaaacggttcgcggatgtccccttttccgtaggaggacatctcaagccgcatatcctccagggagaacgccggatgctccccgtcgcagaggtttgtatttcccggcgcaaatgtatgcttctccaccagcggagcaacatcacactccgccggatgctccggcagagtcaggcgtcttccgtaatacagatgttccaaatgtcctgtctccattctccggaaacagtatgtcgtgtgtgccgtctccagcacaaaaatatgtccgtccgcttttatcatttagtatgcccctttcttgacctgctctgcgatctcggcaaccttctcctccgtcagaatatactttttgtggaaaatgaaaatgccgcacagaaggcagatcatcgggagaatcgtcatcgtcatgcgcagtccgaccaccgaagatacggcagccgtcgcaactgctgcggtatctgtcgtatcgttgctcagattgcagatctgtaagcagatggatgcaatcagtgccgccacgccactcgccagtttgaccacgaaggtctgcatggaaaagatcacgctctcgtcacgtctgtgatttttcagctgtccatagtccacggtattggcgagaaacaccgtcgtcaacaccgtcagcacaccgtttgccccaaagatgaagaagcccgggataaacagcagtaccacattggacatattggtgaatgccagtaccaaaagcaccacataaccgatgatcgccatggcaaatcccgtgtagaacacctggatggttcccatgaatttgcgcagcagcgggaataagatcatcatggacagaatctgtaccgctccgccgaacgtattaaacagggtgtagctgttgtaccagccctcgccgccgaaatcatatttaaagaaatagatgacaaggtttgaggttgtatagaccgcacagttgatgagaacgatggtgatcacgaccgtcatcgcctgatcgttctgaatcagtgcgcggaacatctgtcctacggacggggaatccacattgacggtggatttttccttgacattgacgcaggtgatcgtcgtaaagagcacaaataaaatcgcaataatcattgcaaaccacttgaatcccacgcgctcatccccgccgccgagacggtatacacatagcatcgtgatgattgtgatgatggcagagccgacgcccgcacaggagcgcgccatcgtggaaagtccttcacgctctttgccgccctcggtaaacgccggaatcattgaccagtaagggatatccatcatcgtgtacgtcacaccccagagtacataggtgactgctgcataggccaccagaccgcctccgtcgagtgccggcggtgcagaaaacatcaggtagagcatgatggcatttaaaatcgttccgatgaaaagccacgggcggaattttccccatcttgttcttgtcttggcgacaaccacgcccataatcggatcgttgaacgcgtcaaacacacgcgctgcaagtaagatcacacccattgcaaacgcgctcaccccgagaatatcctgataataatacagtatgtaacttgcggaaagcatgtacaccatgtcctttccgactgctccaagtccgtaggagactttttcttttcctgtcagtttcatgtgatcctccaattctgcgccttcgcgctccccttatctcttctccatcgcaagctctaccacacggtaggctccgtcgtaaattcctgctgccttgttcttctcgatgcagtcgcacatatcgttaagcagcgtgtcctcgtttaagaacagatccagcatctgtaccgtgtgcggaatatctctgcactctaacgtaccgtccccgatctctgcggagtggatggcgccccactgctcatgcccgccgacacgcttgataaacagcttcggcaccgggtagaatgccagctcgctcggctttgtcacaagcacatcgcagcttctcatcagaaggttcgtgcagtagactgcctcaaaaatattctcatgccagaagccgtggatgccacttacctcaccggtaagtacctgtgcggcaaactctgtcgtatccttccaattattaaaatgctccgttgcgaaattcttcattcccgggatctcgccgagcaattcctcccagacattgcggtaatcgccgacattcacatacagtgcggctctgccgtcccgaatcgcagggagcagatgtttgatgatggaagcaaaaatctctctctgtgctcccgcgcctccgatcgtgagaaggaaacgcaccggctttttctctctcttgcgcgcccgtctcgcctcacagtccgcctcgatgttgctcaccagctcatggtcgatgtaatgtcccgtatagatcagatcctccttcggcatcgggcgaagaacgtcggctccctgcatgccgtttaaaatgcggtaaccctggtaggcgtaatgtgtctgcacggtgtgaatgcttccctccgataaatgcagcgccatcggccagttgtccgggatcgcgttgaccacatgcttcattcccgcatggattgcagcctgcgcaggccacacatgtgtcgccaccaccggaatctccttcggcacattcgcatagaccggagccatcagttccgcatttttctggtccgcggcattgtaggaaagcttccggaagccttcatagttcatcggctcccagaccagacggttgaacagtctgctcttctgggaaagtcttgatcccagggaatacagatcattctgcgcaccaatgacctttgtgcaggtcgtctgcgggtaggaattcaagtccatccagtatggtacatagcccatggaatgtgccgcagatgcgatcgccatggaaatgcggtaatgtccgaatcccatgcggatattgccgacgatgattcccttttccgtgtcaaatcccacgttttctcccgtctctcccacacggatgtcatgtacgcccagcatatcgccgatgtattcattcttcttcacaattgcaggataatctgcccccgcatcgttcccgaatttttttgcatatttctttttcgactttaccgttttccggtataccttatccggcatcggattgccaaaaataacttttgatttttcttccattgcctgtgttccctttcttttcttacaatctctgtcgctctgccgctgccgcaaagtgcagttccacaggttcggtctgtgcattccggatgacaagccgcgcctcgccgcactcacccgttgtctttatgtaggtgccgcccattcctccctccagcgagatgacagacggtccgatcagctccactggcccgctcacctcaaagcttaccggctcattaaagaagcttagcagattgccgtattcgtcccgcgcctcaatccggatggccgccacatcgtaggtgcttttctcctgaagtcccgtatgatccgcccgcgcaaaaagtacaacctttgtcatcggctttttgatgagttccgcagtcacgccgccgtccgacaccgcctcaaaccggtatgtcgtggaagtgcctccccagtctccgatatagcggttatagagcaccaccgcatcggtcggcttcatgtgataaaggagcagcatcttaagcgccgtcacatacacggatttcggaagatgtgacagtccgtagcgtgcggtcgcatttaacgcatccttgattccctttccctgcgccggtgtaaaatgttcgcccttctcgatcgcatctccgatataatcgtcgatcacgagcggtccgtgcggcagatgtttccacggggaatcctctctcttgtattccttgataaaacggtcgtttttgtacatccgcacactgtccgcgttggtaaaaatgtaggtctcgccgcggttgcagcccgggtgttccccaatgtccatcgaggaactcagttccagaaccgtatgttcctcctgctggcactcatagaccttcgccgccagcttcggattgcggaacatatccatcacgccgtggtaacagatgcggtccccgctgccaaaatccttgtgtgtgttgtagtcgaacatgcaccagccgaagcttcctgcaatgtcaccctccgctgccgccgcgtcgagcacccgcacatggcgcagcgcgtgttccgcgcggtgttcctcccagtcgaacgccttggtcggatacatgtggccattgtactcgctgatcagatacggctttttcggatcggatgtcaccgccgcctttttctcacatccctggttcgtgccgtcatgcacaaaatcattgtaagtgtagacgtcttccagaagactgctctttttgtgcgcccgcacaccgcccgtcggtctggatggatcgagttcgcgcgccgccgcgttcgtcctgcggtaaaaatcatcatcgtcctgcgactcgttgatgcgcacaccccagagaatgatggacgtgtgattgcggtactgcatcaccatatcgcgcacatttattaccgcctgatccttccacgcctcatcgccgatgtgctgccatcccggaatctccataaataccagaagtccgattctgtcacactggtcgataaagtaatgggactgcggatagtgggatgtccgcacggcgttgacgccaagctcatactttaaaatatccgcgtccatccgctgcatggattccggcatggcatatcccacatacggatagctctgatgtcggttgagtccgcggagctttacttttttaccgttcagataaaaaccgtccgccttaaactcggcatgtcgaaagcctgtgaccgtcacattttcatccagcaccttttcatcccggatgagctgtgtgcacacctcatagcagaccggatgaacggtgtcccacggcagaacggattccaccgtatagtcgagcacaagctttgttccggtcagttcacattcgcccagaagacggtagccgctctcgccgcatcttctgatcttctgtctgacgctaagattctccccgccgccgtccgccgtaatctcggagatgagtctgccggtgtcaccggaaagatctccccgcacaaacacatctttcagataggtcttctccttgatgtcgagccacacctcacggtagagtccgccgtacgtcatataatcaatcacaaatccaaacggcggtatattcacgctctccctgctgtccaccttgaccaccagcgtgttgcggatgccgtagatggcatcgtcactgacatccatcgtgaatgccgtgtagccgcagtgatgttccccgatcttcttcccgttccagtagacttcgctctcatgcgccgccccgtcaatcgtgagcagcagacgttttccgctccattcttctgaaatgaaaacatctctacggtatccgctgaccatctggtaaacagattcatcaaaatagtgaagcggtgtctcctttaccgtatgcggaagccgtaccggagtcatatttcccacgtcgaagccatcgcccagcatttcttccgtaaattgttccgaaaacttccagtcgtcatttaaatatactctgttctccatgttctaccttcgcctgccaccttcctgcattgccacgcgtttatccctccgcctccggcaccacgattccgtttaccagaatcgaaaccacctcatcgagcgcttccagataggaaagcctgctctgaatcaggatatctctctggaaaaactgttctaccgtggcctccagcatcatctttacgatcggaatgctgaccttgcggaccacgccttccgccattccctgctccagaagctggatcgttgtctcccagccggtctccagtcttttttccacctgcttgtagatcaccggatacttgtcctttaacagatagagctgtctgaaatccacatcccggtaactctccggaatcactccgagaatccgtcttatcttctccaccgtagagagcgcgtcatcctccacaatctgctgttcactctccttgatggaatcgaacatgtaatccaccatcgcaagaaacatcgactccttgtcgcggaatacggtatatatggtctttttgctcattccgaggattttcgccacatcgtccatagtgaacttcaggcctttctcattaaacgctttgatcgttccctccaggatcacttctttctgctgcatctttagccacctccctcttttggaaactatttttatctttctggtttcctttattctatcacgatttccatattctcacaagaaaccgaattcacaaaatcagtttccattttttgtataaatgtactaaattccggtttttctgccgcctgcgcgttcttgcaatcccgccgtacaatgggtataatatggttaattacagacatggaggacatcatggaaaacgatcatatcagaacgattcttaacaatattgaaaacggaacactcaccgcgagtgaagcctacgcgcagttaaaactggctccttttgaggatctcgggtacgccaaggtcgatcatcaccgcgaagtgcgccagggagcgccggaagtgatctacggagcctccaagacaaaagaacagatcgcaggcatcacgaacagtctgctcgcccactgtccggagaatatcttaatcacgaggctctccccggaatccgcggcttacctctctgagcgtttttcgctgttctacgatgaggcttcccgcatcggcattgtaaaccgcacgccacatatcacagcggagggaaccatcgtcatagccacgggaggcaccagtgacattcccgttgcagaggaggcagccttaacggcagaagtgctcggcaacaaggtcgtacgcgtctatgacgtcggcgtcgcgggactgcaccgcctgctctccaacatggagctgctctcatccgccaatgccatcgtcgccgtcgcaggcatggagggcgctctcgccagcgtcatcggcggtctcgtggactgccctgtcatcggcgttcccacaagcgttgggtacggcgccagctttcacggcatttccgcgctattgtccatgctcaattcctgcgccagcggcgtatctgtcgtcaacatcgacaacggcttcggcgccggctaccttgcaagcatgatcaaccacatcggcggctgatcacaccatccatcactctaacaggaggtttcttctcactatgaaaacaatttatctggaatgtaatatgggtgctgccggagatatgctgatgagtgccctttatgagatctgcgatcagaaagaatggtttttgcacaagatgaacaccgtctttgccccttatcatatcgcgctttccccggaatccgccgtaagctgcggtatcaacggaacccacatgaaagtcacggtagacggtaccgaggaggtctctctcgatgtcaaggcgggacatgcccatcacacgcatgcagagagtccggatgcatccggcgcccacgaggcgtccgattctgcggaggacggacactcccacacgcacaccacctacgccgccgtctgcgaggagatcgcatcccttgatcttcccgcagaggtaaaggacgatgcgctcgccatctaccgcctgctcggagaggcagaggcaaaagtacacgacaccacgttagagcagatccattttcacgaggtgggaacactcgacgcactcgcggatgtggtcggctgcgcgcttttaatccgcacgatcgcaccggagcagattctcgcgtcgccccttcacgtcggaaacggctttgtaaaatgtgcacacggcgtgctgccggttcctgccccggcgaccgcagagcttctgcgcggcattccgttctacaccggctccgtgaccggcgagcttttaaccccgacaggcgctgccatcctgcactactatgtgctgcgctatctcccgatgcctaccatgaccgcgtcggagatcggctacggcatcggctcgaaagatttcggcattgcgaactgtgtccgtgcttttctcggcgacaccgcctcctatctcgctgccgaggaggaggagccatactcctgcgacgataccattttatcgatctcctgcaacatcgacgatatgaccggcgaagcgctgggacttgcaacggagatctttatggcagccggggcactggacgtctttacaatcccgatccagatgaagaaaaaccgtcccggcattctcttaacctgtctgtgtgagatggaggaacgtgaaaaattcacagggcttttcttcctccatacttcgaccagaggcgtgcgctaccaggtgttcgaacgcgcaaagctggaatctacttttgagacgcgcaagacctcgtacggcaatatccgcatcaaaaaaagttccggctacggcatccagaaggagaaagcggaatttgaggatttaaaatccgtggtcttaaagaaccactgcgccctctctttgaatgaaatcgagaaatccctgcactaaaaaacgtgcgggagactgcacataccgcagtctcccgcacgttttttgtgtactgtaatgaatcccagtctacagattttcctcttcgatcgtaagcatcccggatcttaccgcaagttccacaccggggcacttttccttgtactgctccatcaaaagcagccagagctggtgaatgtgatccgcaagcaccgccgacatctccacactgtacggcagtaaggtgtgaaggtcgaaaaagcggattccctccggcggcagaaagaccagattgcttgagcgctccttatccccggatttcttgagcagctcataggtaatcatgcagaattcttttccgcggtagttacagctgtaagacgcataacactcatcaatcgtccactttgttccgtgctcctcctcgatcggcttctcggaagcatcatttccctctgtggtctgtacttccagtctccaggaaagcttctgtgcttttgtctccgcaatcatctccgtcagtttacggcataattcttcctgtttcatttctctacctccgtattctcccagcggactgccttcgccttctgcaatgcttccggccgttctgccgctaccgccgcttcatccgacgcatgccgatccagccagtctgcataaaacccgacagcctcttttatgctgtcaaactgatacagcaggggcttcctgccccagtccgccacatagacccggttatagtccagatacgccgccaccgccgtctcaccggtgtcacggtgcctgtaacactgttccatcaccggttcgccctgcacttctttcagtccggcgcctttgatcttctgctcgagttcttccaccgaatcaaacagtgaaaataactcaagctgtccctcaacattcttccctgccatagccttcctcccgcacaagcccggatcagccccagattacgctctcacatagatctcggacaaattgtccagaatctcgcccgcgacatctggcttattcatagtatagatatgtacgtgattcacgccgttggcaatcagatcgataatctgatccgtcgcgtaagcaattccggcctggcgcatcgccgccggattatccccgaaacgatccacgatcgccaggaaacgcggcggaaccatattgccggaaagcgacacgatcctcttgatctgcgccttgttcgtcaccggcatgattcccgcaaccaccggcacatcaatgcctcttgagagcgccttgtacaggaaattatacagaatgtggttatcaaaaaacatctgtgtcgttaggaattcacagcccgcatccactttttccttcagatgatccagatcctcaaaaatggtgtccgcttccggatgtccctccggatagcaggcgccgccgatgcagaaatctccctgtgctttgatgtccgcgatcagctcactcgcatgacggtactggttcgggagcgggaaatccgcattctgcggaatgtctccccggagcgccagaatattgctgatctgcttctcttttaactcctcaatcacggatgacaccttttccttcgtggaggaagcacaggttaaatgtgcaagcgccggaatctgatgcttttccacctcgctggcaagttctaccgtatagtcggacgtaccgccggtcgcgccgtaggtcacactcatatatgccggcttcaatgccgccatgtccgcaacgatatttttgtaattggcaagctgcgccccctgcttgggcggaaacagctcacaggaaatcgtaacctgatcggtctttaataattctgtcagtctcatctgctctatcctttcttcttcgtcatgcctaaaattttctcagcttgtctgttccgtcatccacggtattctcaatcttgcggatcgtgacaaaataagaataatcatcgttgacccgcacttccacgcggtctcccacccggtgtccaagcagcgccttaccgagcggcgactcattgctgatcaagttcttgagtgaattgccgcgcacggtggtgacaatcttatagacttcttcctcatcgtcctcctcgaaatacacggtgacggtgttattcattccgacttcgtcctccgcggaatccgtagatatgatcttcgctgtcttgatcatcttctccagatagcggattctgctctcgttctggttcttgtccttttttgccgcatgatattcaaaattctcgctgagatctccctgggctctcgcctccttcacagcttcaagtgcttccttgcgcacaaccagcttgcgatactcgatctcctcttccattttcttgatatcctgctctgtcagttcatcgtacatgatctatcccatcctttttggctgatgaatttattatagtgattttaggaaatgccgtcaaataatttccgcagatcaacgttctccacaggacaccccgtgatgggatgtcccgcgcagaccgacaatacatagccttttaccggcacttctgtatacagataaaactgcccggcatccgcttccctgcccaccgtctctgtgtccggtgcttcccggcctgccacctgatcctccagcacatcaaaagaagaaagcggcaggtgcagtccttcccctaccgctttgcaatagctttccttgcgcgtccagagtcttaaaaacgcatccggtttgctccgcagatacgcattctccgctgccgtaaactgcctttgcataacattcacattcacgcgccgcgcccgttccacgtcgatgccaaccgcgccgtcgtcaaataccgccgccgcatagtctcccgcgtgggacaggttaaaatgcacccccgtcccgccggaaagttccggctttccgtgggcaccgcgcaccagatgcaccgtctctgtccctggcaccagcggaagcagggaacagccaagacttcgcagaccatactccagcaacaaacctgcgccaagacttctcctgcgatcctcctgcttcccgcagcgcgctattttctcctgtctctctgcgggtacataccgcagaagctcttcgtacaatgccgcatcccgcagcggcgaaatattggttatcagaaccctcatgccgtctcctttaacagggtattcagcctgtctctcgccgccagaagttcgtcgcaggcaggtaaaagtcccgccgtctctcccgcacgcagcggttccacaatccgcaccacaatatcatatagcggaatcagccccatattggcaagcattccctttaatgtatgcgcacattcaaatgcacgccccatctcccctgcgcgcagcgcctccggcagaagttcaaaattctgatcccccgccgccgtgtgcaggcagctgcggtacagctccctgtcgccgatgaaccgtgccagtgcgccatccacgtcacagccccagtttttcagggaatcaaacagttcctccattgtccgtctctcctttatcctttcctccggcaacagacatccgtttcaacagtctgccagcgcccagaacattttccactctgcgcatcgcaatctccggcacgaaaggcttcacgatgtagtcctctgctcccagctgcaacatctggatctggtgtccggtcgtgtcgtccgctgtgatgataatcaccgggattcccgcgaggacggcatcctgctgctttcgctttaggaattccattccgtccatcaccggcatcgcaagatccagcaggataatatccaccttgccggactctctgtttaagacctcaaaggcatccgctccgttttccgcttcaaggatccggtactgttgctcaaaaatgcacttaagcagtccacggtttacctcctgatcatccacaaccagcatcgtccgctctgtcttttccgctgccagaagtacctgacggtatttctgcagttcctgatccatcatccgctgttccgtaatatcggtaagcgtaccgacgataatgtgcttttcgcccacgctcgtgatgtatttcagcttcagatgtacccagatcgagcgtccgctctttgaagtgcgcaaaaattcgcaggccgcggtctccttcgactttgcaatgtcctcaaacgtgtcgatgagaatcttcctgctctcgtctgagagctgtttttccatcacaagcccaccagaggaattgatatccccgtatccgaacatgtcatagtaggcgttgttcacgcgcagcgtatcaatccggttctgctctttctcatattcatagatgaccgccggctccatcatgccggagaacacgcttcccatctgtgaagtcgcgttccagagcatatccctgccgatctcgtccttctgatatttctcctgcagttcgtcctttttctcggataccagcttttcataatcggacaccggcatcggtctcgcaaaataaaatccctgtacatactcacatccgacgctgtgcagaaagtccacctgctcccttctctctacgccctctgcaatcaccgggagattcagccattttgccatgcgcacaaccgacgcaagaatattctggctgcgcccctcctgatccgtatccgacagaaatttcatatcgatcttgagcacatccacggcgatatcctttagcacatttaaagaagaatatccgcttccgaaatcgtccatcagaatagaaaatccttccttctgcagacgttccatcgtctccttgatcgccttcgggttcgtcgtgtaggcgctctccgtcagttccagttccaacagttcccggggaatgtggtagcggtccgtcagtccgcagattgcctccaccagtcttggattatagaggctgaccctggaaatgttgaccgacaccggcgacggctttttcccctcggcaatccatcctgcaagcagcttacaggtcttctcccagacgtagtaatccagcttggtaatgaatccattgcgctcaaagatcggaataaattctcccggcgagatcatgccgccttccggctttgcccaccgcaccagcacttccgccccacagatcctgttgtcctgcaggctgtacttcggctgcaggtaaaggacgaattcctcctcgtccaacgcatgccgcatatggttgacaatctgctgttcccgcacgatgtcttcccgcatctcatccacataaaacgcatagttttcgatgtaattgcctttgcactgcttggcagccagattcgcccggtcatacatcgcatcaacggagagatcccgctcccggatcacatagattccgattgccggcaccacatcaaaagcgagctggtactgtccgagacgcatgcgcatgtagcgcacaagctctaacatcgtctcctcgcccctgtacggcatgcagatgccgaaaatatccgcctcgattcttccgtaggcaatctgttccgtatctcccgcaaatttccggatctccttcgcgatatactgtaaaagtccgtcaccgctgctgcttccgaagaaagaattcaccagttggaacttttcgatgtcgagacgtaaaaacgcatacgtctcttcgggatgtctcttaagcagaacacgggttgcttcaaagaaatgcgtcttattataaattccggtgagcatgtcgtaatctgcacggtatctcaattctctcgaaagctgctgttcactgctgcgcaccgcattttccacccggaaccgcacgatctgcggatcatacggttttcctataaaatctcttgcccccagtgccagacatgccttttccgtcttgacgtcacgctccacagacgccacaatgaccggtatccggcggtaagaatccactttgcggtattctcttaaaaattcaaacccatccatctgcggcatgaccagatccagaatgatcgcagatatcgcgtcaaactccttctgcgattccagaatccgaagtgcacctgcaccgtctactgcctctacaatctcataagcatcctttagcatctttttcaatgcgatccgatccagctctgaatcgtccactatgagtaccttatctctgctgcccatactcttaccccggtttcttttattctcctggttcctatccgattcgtcctatattcctaatctgcattcgtcatcaaacgcatcataacctcacttcatcatagcaaagttaccgccgcatttcaatacttcgggcaaaagaagtaggaaaaaagccctacccgctattgcggcttctctatgacagcaatcgcctttttgaactggaagaaaaacagaacaagcgtaaagcttaccgcgatcacatccgctgccggctctgccagatacacgcccatggtctgatttttcaccagatgcggcagcagataaataagcggcagcaacagcacaaatttacgcataatcgccacaatgatcgaagcccccgcattgccaatcgagataaatgtcatctggcatgcaatctgcgccccgaaaatacccatggcggcacagtagatgcggagcgcccacttcgtgtatgcgatcagctctgcgttggaggaaaaaatcattgcaaacatctgcggaaacagcatgattaaaagccataccgccatcgaatagcacaggcttgtggtcaacagcagacggaatgtccttttaacgcgctctgcatttctggcgccgtaattgtagcttgtgatcggctgggcgccctgtccgagtccctgcatcggaagcatggaaaactgcatcgcactggatagaatcgtcatggctcccaccgccacgtctcccccgtatttgagcagcgaggcattaaagcagaccgtaatcacgctctcgcttgcctgcatgataaacggggcaagtccaagcgccagccccggaagtaccacgcccgcttccatgcgcagatactttttgcggatttttaatacagtcttttttcccgtcaggaatgagagaacccagacggtcgataccgcctgcgagatcaccgtcgcggtcgccgctccgcggactcccataccgaatccatagatcagaaccgggtcgagcacaatattgcagcccgcgccgatcataacgctgagcattcctgtcctggcaaagccctgcgccgtgataaacgcattcatgccgagcgtcagctgcacaaagaccgttccggccgcatagattttcatataatccgaagcaaagccgatagtattctcacttgctccgaacgtcagcaacagcggtctgtaaaacagtaacagcagaaccgtgagcactgcggagatgacaatctgcagtgcaacgctgttgccgagaattttttccgcctcgtcatagtcgccctttcccatcgccatggaagccctcggtgccccgccgttgctcacaagtgcggcaaatgccgacacaatcatgataatgggcaggcagacgcccacccctgtaagtgccaacgccccatcttccggcatatgtccgatatagacccggtctaccaggttatataacaggttgatcagctgtgcaacgatcgctggaagcgacatgcgccacagcagtctcccaatcggatctctcccgagaaaatcatttttttgttccatatcaacggttcctcccatcatctgtctgtatcaaaaaacatctcgtccaaatataattcgttgaatttcgggtgcatggcaagcgaaagttcctgtgcgtgccctgtgatagacgcaagcctctgttttgccgccgtcctgtcgtcgagcagataccgctgtgctcccgcaagcgcactgttgccaatcatcgtgatatgtccccggaattgttccgggaacagtccgatccggatagtctgctcctcgtccatcctgcagccaaaacctcctgcgatcaggatttcttcggggtctcctccgccgtattccgcgagcagcgtctcgatccctgcgcggatcgccgccttgcccatctgcacctgtctcacatcctcctgccggaaccggaatctgccctccgcgaccggcatgccgtccgtaaaccagggttcctcaaacgtcccgttctcatcgatgagtccgagccgcacggcttctcccacagcgtcaataatcccggttccgcataagccgatcggtgtctcaccggcgatggtgcttaactccacggttcttattcctcctgtggcggcaggatctctctccagaaccaggcttgtcacggctcccggaacgcccgcaacaccgcaggatatattcccgccctcaaagaccggtcccgccgctgcggaagtcacaagaaatccatccgctcccccggctgccatctccccgttggtgccgatgtccagcagcaacgcatttttcttccggtccatttccaaggcatagattcccgccacgatatccgctccgacgaaagcagagattccgggcaaaatggtcactgacacactccaccggtcagacagtgcaagctctgcaccgctcccctcccagagagagagatcctccggtgtaaaaggcgccgccccaagtcccgcacaggataatcctcgcaggagatgacacatggtcgtatttccgacaattacaagttcctccacagcatcatccggtatcccggcatccgccacgagtcccgcaagcaacgcatcgatatcccggcagatgctaaggcgcagttcctctgccgccccctcgtttgccgcctggattctggacagaacatctgcgccgtatgcccgctggtgatttaccgaggatgcggcggcaatcctttttctatctgtaaggtcataaagcgttgcggcaagcgtggtggtaccgatatccacggctgcgccgcagcgctttttcccggaatgcccccatatcttggctgcgtcctctctgctgtgcatcgccacgcaatctctctgaccgtggatggtccctgccgtctgaccggggataccttcatctaccgtccgactggggatggctccgtctgccgcatccgccatgactaacacatcgatctcctgctcccggcttacgggaagctgcaggctacatgcctctgccacgcgcacttcacacgccaggcgcacgccactgcttcgttcttcctctgtgagcagcctccgctcatttgccgtcggctgtggtgcatccgacacaaagcgcacgcggcaccttccacaggttccctttccgccgcagggtgcatccacataatatcccgctcttatcagacgcatcagcagcgtctctgctttcccgcccgatcccgccggaagttctgtcacttcttttgcatattgaacgttcatcctgtcattcctcccctgcgttatggcgtgtagtccacgcctgcccgcctcgcctgctcttcctgttcctcctcagcgatccggtatatccggttccctttccggaaaaaagtgccggtccgcaaaaagcggaatgtaaccccgcagttcacgcactggttcatcagttccagcacccaggcaaaatcgcatacacgcgcgtctgctccctgttcgccgccgcagagaacctgcgcaatctccccggtctttagatacgcatccagcaccagtttttcaaggagcggttcgcagagaattcccttatggcgcaccggcagttttaaaaatgcaggaatccggtcatccgcgcgtctctgaatctccaccgaacagagaatcgtcacgttttcatagccgtctccccagtcgccgggcagtgctttaaaaaagcggtgctccctctttgtctcaatcacaaaggaaagatcctgccgctccttgatcatcgcccacgcctcgctccgccattcatccgcctccggcaggaaaaaatccgacgtcatgcacacatagaccggttcctcctgtggcagcaacttgtattctcctctccggttcttctttaccggcagatcaaaattggctgtccttcggatcacggacgcatttttgccgtacatcgcatctttttcatatacataacagttgtcgcaccctgcactgattttcttgcagccatgccagggattccagaccgccatacgaaacgcgcctccttcttctttcctttttgtccgccggatggtatacttatcacaaatctggaaaaagtaaaaccgctgccacatccgggcagccacagaaaggaattgtctatgaaactgatctcatggaatgtcaacggtctgcgcgcctgcatgcagaaaggcttcgcagaattttttacagcaagtgatgctgatattttctgtatccaggaatccaaactgcaggaggggcagattgattttgcaccggagggctattacgcttactggaattatgcgcagaaaaagggctactccggcaccgccatttttaccagaaaggaacctctgtcggtgcattacggcatcggcattccacagcacgataccgagggacgtgtgattacgctggaattcccggatttttatatggtcacctgctacacgccaaattcccagaatgaactggcaaggctctcctaccgcatggagtgggaagatgcatttctctcatatctaaaaggtcttgaccggaacaagcctctgattctctgcggcgatctcaatgtcgcccacgaagagatcgaccttaagaatccgaaaaccaaccggaaaaacgccggttttaccgacgaggagcgcacaaaaatgacggctcttttatccgccggcttcaccgatacgttccgccatttttatccggataccgagggcatctactcctggtggtcctaccgctttcacgccagagagaagaacgccggatggcgtatcgactacttcatcacctcatccgcactcgatgaccgccttgtggatgcaggaattctcaccgatgtcaccggctccgaccactgtccggtaacacttaccgtcgatctgccattctgtccatagcactatttctgccgatagacatgacagtaaagcacgtcccgcatggtctcaaattcatccgccaaaagccgcttcggataagacatgatccgaagcgggatggcatgtctgtcctctcccatcgccggctgcatatactcaaacggattcatcacgaatccgtttctctcataaaatgcaatccgtctggcttccagttcaccggtcggcagttccacctccagtataaccggctttctgctctgcgccgtcagctgtgtcagaagtaccgctccaagtccgccgtttcggcatgattttctcacggcaaagtgctccacaaacaggaatgtatcaaactcccacactgccagaaacgccatcagttccccatgtgcacggtacccgtacaggtgataccaggagacatccagtatctttctctgcgcctccctggatcgtctctcgtcccgcggaaaactctcctccataatctcccatacgctgtcaaaatcccgttctgtcagtgtctctaaactctgcatgttctctctcccggctgattctttcttacttacttttataccataaaacaagattatagcacaaatttcctatggaatcaaaccgcgctgttctttgcctgcgtctcaccctctccgatcctgatggtgcggaagccctctccgtgcacttcattggactccaatataatcataaacgatgccgggtctgcctccttaacagcatgctgaagcagatacatctctttgttgttgcacacgcacatcacgacctgtttgttgtcacagcggtaaccgccctgtccctgtaatatcgtagagccgcggccgcagcaggaatcgatcacatcgcagatctcctttccatgctctgtcacgacaagtgtcattttcccggaattgatgccgtacatcagcttgtcgaccacgattgccagcagaaaactcacaatcattccgtagataattccatccacatcccgaagcagaaatccgcccagaagaatgatgatcacatccgtcacgaacgaaattttcccgacagaccagtatggtttcagattcttgactgccataataataaagtcggaaccaccggtcgaggaattctgcatgtaaatcaccgcatatcccagtccggcaaacacaccggtacagagtgccgcaagcagacggtctcccgagtaaaccgggaacagtggcgcgacatagtcaatcatcagggaagaaatcagcatacagcgcagtgagctgaagaaaaagtgtcttcccagcagacgatagcacaatattgccaccggtatattcagcagtatcgtggaaaatccgatcggcacgccgaacagctggtataaaatgatcgagataccggaaaatccggtcatcgggaatcccgcctgcaccgcaaaattataaatgccggcagcaataaacgcacttcccacaacctcccagaatatctgttttaaaaatacttctctatctttttttttcattttcatccatccttcctttgcatgcgggtgtctccacaacacaaaaaaagagcaccagcagattatacgaatataatatgctaacgctcttttccgtatcctattgtagcaccggaatccggaatttgtcaaatatgtttctctttacaatccggatgtgtcgtgttaatatgcttcatatatgaactattcatatgtgaagcattattttatcccattgaaaggagcatttacttatgaataccggtattgaaattaccatgaagctatcggctgcctacagtgctgtatgcagacctttgtgccacgaactgaatctcccgcagaccgcgttcgatattctgatgtttctggcgaacaacccggaatataccaccgcacgcgatattgtggaagtccgcaagatcaaagccaacctcgtatcgatcaacgtagacaagctcgtcggcgaaggttatctgcggcgtgaggtggacacagccgaccgccgaaagacccatctgctctgcacagacaaagccggcgctgtcatcgaacaggggcgcacccttcagaaccgctttatggacagtcttctggcgcatatcgatgatgctgccagaaaacaactcacagaaagcatccatcagatggagcaaaatctggatcacctgttagaggaggaacactgatatgacattactattcacgatactcgtcaccttttttgccggcatgggcgccggactcggcaccggcttcgccggaatgagcgcagccgccgtcatcagcccgatgttaatcacttttctggatgttgacccatatatggcagtcggcatcgccctctcctccgacgtgctcgcaagcgccgtctccgcctacgtctatggtaaaaacaaaaatctggatatccgcaacggagtgattatgatggtgagcgtcttaatcttcaccgtcatcggaagctacatctcaagccttgtcccgtccaccaccatggggaatttttccgtcttcatgacgtttcttctcggcatcaaattcattgtaaagccggtcatgacgacaaaagaatccatggcgcaggtctccgcaaaaaaacgtgccatccagtcggttgtctgcggcgtgatcatcggatttatctgcggtttcatcggtgccggaggcggcatgatgatgctcttaattttaacctccgtgctgggctatgagttaaagaccgcggttggcacgagcgtatttatcatgactttcaccgctctcaccggagccgtatcgcactttgccatcggcggcgctcccgactggacaatctttctcctgtgcgtggtgttcacgttcctctgggcgagaatcgcatccgtattcgccaataaggccacaccaaagacgttaaaccgtgcaaccggtgtcattcttgtagtccttggcatcgtcgtgctggcgttttccttgttgtaaaatctgtaaaatagcagctaaccagaatatgcttacaaatatgccgaccggacgctggcagcttcccaccgccgccagcgcccggttccccgcaaatctcccggtcacagccatacctgcctgacatctttaaattcggtgccgatcatccagtctctcgcaattcttggaattctccatgcataggccggtgtaacaacaaaaagatatcgtcctgcagggcattataaaacctgagacgtacaaatacaagagtgcgcaacgccagcttttgtacaatccataatcattttctcacacatctcataccccagcctggagctgttcatagacagtgtataattgcccgccattccccatttctgctccgtgtaaaaacgataatttgtcatacgcctcttatcaatatccgccatcattttagctgcctcgccttcgttgacatggtacagtctgcagatgcgctgcactttttccggcatatcgccgtgtataaatacattcagcacatcctctctgtccttcaaaataaaatctgcatttcttcctataatgacgcagctctccttttctgcgatccccagaatcacctttctctgcgcttcgtacaccatatcttccacggattttccggtaaggtcgcgtccggcaaaagcatagccaaacaaacctttctttggagagagctccgcattttcctttatgtactccgttgaaaatcctgacttctctgcaatctgaccgatgatatccttatcgtaataggcaattccaagcttctttgccacttcttcgccgataaaacgaccgccgcttccgaattctctgctgattgtaatgattctttttgccatctcaattcctccctaacttaaacgctccactttattttttctgattctctttaaaaatacatagcccaccagacacgctatcatctccgtgatcggaaatgcccaccagatcagtgagatgcccatctgaccgtttcttgcaaaaattgaaaaaattcctgccagcggcaatatgatcacaagctgtctgagcagcgaaatcaccagtgactcgatacctccgtccaaagcctgataaatgccctgatatgccacattgattccggcaaagataaagctgatggagataatccgcatcgctccaataaaatactctctggactgcccggcattaaacagtgtcgcaaatgctcccgggaacacttccgtgataatgataccaaaaatcatcagcgccgctgtatacaggagaccgtattttattccgtccttgattctctttttgcttcccattccataagcaaaagcaataatcggtgtaattgcatctctgagtccgaatgctaagaacaacacaaactgctggactttatagaacagtccgtatgcggtctgtgcagaagggctgaacttcagaatcaggttcatcacataaaccatgatcgacatcagcgcctgcgcaatgattgccggaagtccgatcgcataaatttctcttatgataccggcatccggcttcatgtactccactccatgctcaaattcctgattcaatttcatatggaacacaaacagcaataccgcggataccacctgaccgatcaccgtcgcataggctgcgccttccactcccatttcaggaaccggtccgataccatagatcataaccggatcaagaatgatattgaccacggctcccacaacctgaccgatggtcgaatataaagaacgtccggttgcctgcaataacttttcaaataaagaaaagaagataattccaaaggaaatcacgcagcatattctaagatagcttgttcccatcgaaattacttccggatcaaccgtctgtgaggaaatatatgccttcactccgacaattccaaacaacagacatactgcataaatgattcctccgaggaataaactgttgcctgcaaccttcgctgccttttttgtatttccctgcccgagtgtccttgccagaagtgcatttgttcccacacccgttccgattccaactgccaccataagcatttgaaccgggaacaccagcgtaagtgcatttaatgccgcctcactccccactttcatgtttccgacaaaggcgctgtccacaatattgtagaccgcctgcaatgccatggataagatcatcggtattcccatctgcaccataagcttctttaccggcatttccttcatcttgttactctctgtcatataatcctccttgtttttccgcacaaaaaaaatgtgtacctatctcataagctggacttacgctgataagctacacacttctttatggcatgatatttattttaaaaacagaaaaacgagtagcaaaactggatttacgctagtctgctactcgtttgatccttattatatttctcattttagaaaaagtcaatatagcaaaagcgcaaaaggacagccacacacatacatgtgtgactgtccttttccctatctatacattaccttctcctaaaaataacgcatatgatttatttgtttgcgattgctgcctgtgctgctgcaagacgagcgatcggcacacggaacggtgagcaggatacataatccagaccgatcttgtggcagaactctacggaagaaggatctccaccgtgctctccacagatacctacatgaagcttcggatttaccggcttgccaagcttgattgccatatccatcagcttgccgacacctgtctgatccagttttgcaaacggatcgttctcgaagatcttggtatcatagtaagcatttaaaaacttacctgcatcatcacgggagaaaccgaatgtcatctgtgtcaggtcgtttgtaccgaagcagaagaaatcagcctctgttgcgatctcgtctgcagtcagagctgctctcgggatctcgatcattgttcctacttcatactcaagctttacacctgctgctgcaatctcagcgtcagcagtatcaacaacaaccttcttcacatactttaactcttttacttcgcatacaagcggaatcatgatctccggctttacagtccagtccggatgagccttctgtacgttgattgctgcacggataacagcctttgtctgcatctttgcaatctccggataggtaactgcaagacggcatcctctgtgacccatcatcgggttgaactcatgcagagaagcgatgatgttcttgattgtctcaacagacttgccctgagcttttgcaagcttctcgatgtcagcttcctctgtcggaacgaactcatgaagaggcggatccaggaaacggatggttaccgggcagccttccagtgcttcgtataacttctcaaagtcaccctgctgatacggaagaatcttatcaagggcagcttctctctcctctacggtatcagagcagatcatctcacggaatgcagcaattctgtcttcctcgaagaacatatgctctgtacggcaaagtccgataccctcagcgccaagctcacgagctttcttagcgtctgccggtgtatctgcattggtacgaacctttaatgttctgtacttgtcagcccatgccataacacgtccgaactcgcctgcgatggtagcgtcaacagtcttgatctcgccatcatagatattaccggttgtaccgtcgatggagatccagtctccctcatggaactctttgccggccagtgtaaacttcttattctcctcgtccatagcgatgtcgccgcatccggatacacagcaggtacccataccacgtgcaactacggcagcgtgagatgtcataccgccacgaacggttaagataccctgggaagccttcataccagtgatatcctccggagatgtctcaagacgtactaatacgaccttctctcctcttgcattccaagcctctgcatcctctgcagtgaatacgatcttaccgcaggcagcaccaggagatgctccaagacctttgcccatcggtgtagcagcctttaatgcagcagcatcgaactgcggatgaagcagtgtatcgaggttacgcgggtcgatcatcaatactgcctcttcctctgtcttgtgtccctcatctacgagatcgcaggcgatctttaatgcagccggagctgttctcttaccgttacggcactgtaacatgtagagcttcttgttctctactgtgaactccatatcctgcatatcatggtaatggttctcaagagtctcgcaaacctttaagaactcagcgtatgcctccgggaactcctgctccatctgagcgatcggcataggtgtacggacacctgcaacaacgtcctcgccctgtgcattgattaagaactcacccataagcttgttctcaccggttgccggatcacgggtgaatgcaacacctgtaccagactcgttgtttaagttaccgaataccataggcattacgttaactgcagtaccccaggaatacgggatatcgttgtcacgacggtatacgtttgcacgcgggttgtcccaggaacggaatacagcctcgattgcaagctttaactgctctacaggatctgacgggaaatcagttcccagctgattcttgtactcagccttgaactgctctgccagagtctttaagtcagcagcggtgaggtcgatgtcgtactgaacacccttctcctctttcatcttatcgatgagctgctcaaaatacttcttaccaacttccataacgacgtcagagaacatctgaatgaaacgtctgtaggaatcatatacgaaacgctcgaatgccggatccgggtttcctgcgatcattgctgctactacgtcatcatttaatccaaggtttaagatggtgtccatcatacccggcatggaagctctcgcaccggaacgtaccgataccagtaacggattcttcagatcaccgaatttcttaccgttgatctcctccatcttcttaacgccttccatagcctgcgccatgatctcgtcgttgatcttacgtccatcctcgtagtactgcgtacaagcctctgttgtgattgtgaatccctgtggtacaggaagtccgatgcttgtcatctctgcaaggttggcacccttaccaccgagcagattacgcatggtcatgtcgccttcgctaaacatataaacccatttgttcgccattttgctaattcctcctaaactatacttactatgtaactatgtcagagccaacccctgccataattccgcaaacgaatgtacgtctcccaaaacgcacacatctataatatcatacttttgctaaatagcaacaattattttcgtctctttttgctgttttttgtcacaatttcacaattcaaaaccttgttccatgatgtggaacaattttatgttacgtctgtggaaagtcaaaacgatcgagtaggaggaatttctcttaaataagaaattccgacctctcacaccaccgtgcgtaccgttcggtacacggcggttcaatcaacttaacaagttgtacacctttcggtgtagtaatctaacat

SEQ ID NO: 5 - DNA, 508836 bp, Roseburia hominis
gagtccgttgccgggttttcacgctcccagcccttttgtctgccatattcggaaaacattcttgggttcgggaagtaccgccagccggtaatgcactggttcataatctcgttgatttcccggatttcccattgcttcggctcgtcaaaggtgtggttcaaggcttccttgtaaagctgcttggaacagaccatgctcccggtgtacttatcaagatacgcctgtatcattccggctttggtgtcctccggcataaaatcccgctggtgttctttgagataccgctgcatggtggggctgaaagccagcttgaacctgccgcttcggtaaatctccatagcttctgcccacatctgctcgatataggctctggaagcggcttcgtcctccaaaatgtgaacctccgcctgctccgggtacaccatgaccgggataaaacggcggttgcctgaacggtcaaggggcaggaagtcaagggcattggaagtgccgccaaacacgcactgacgggggcggtctgccgggtgggtttcatagggtatcttgtaaacctctttctgccggcttaaaaacgacttgatttcctcaatgctcttggcgttggcggttgccatcatttccgacatttcgataatccagtgaccttgcagcttacggtacacattgtcatcgtccagcttccgcaaatcatcggagaaccactcgtcccggactgccagcagacggaagaaggtggacttgccagccccctgacctccgaccagacagagcatgatttcaaacttgcaccccggctgaaaggctcgtgagatagcgcccatcaggaacagcttcaacgcttcataggtgtaatcatctgcgtcagctcccagaaagtgccgtaggcagaagcggattcgctctgtcccgtcccacacaagggaacttaaataatcccggatggggtggtacttgttttcattcgccacaatcccgatggcgttatcaatctttttctcattggtaagcccgtaggtttcttccagatagagaagcagatatttcatgtccgtatcgtttaaggcggtgctgtccctgtggaagccgatgggctttatgatgtccttgcggtcggtcaggatgttgtatgcgatagccccggaaagcagcgggtcacgctggaatacggtcaggcagttccgtatgctctgacggacaccgcctttctcggtggtttccagccccgccttgatttcctcaatgctctggggcggctgcatggcgttcatggtgttttttagttcttgctgcgtctgcggctgcaagctctgccattcgctgttcaagctgtatcacatcctttccgtattccgtaatcaaagccgctttttcctctgtttccccgaacagcagcacatccagcagatattccacatggtcttgcttctgtaaggcttccacaaaccggggatgaaagacttcctccggggagtgcggggcatattcctttctccacactcggagtaggtggagataatcggcaagaatacggaagcagcggttttttgcttcctgaaactgttcctccggggatttctgccggggcttgggcttttttgcttttcccggcggtttccagtcctcataggaaagcccgaagtcctgtgccagctgtacggcggcttctttctttcccagcccatacagggcggcggcaaaatcaatcacatccccatccgcaccgcagccgaagcagtggtaacgccgatccagcttcatgcttggggttttatcatgatggaacgggcagcaagccatcccgttccgccctacatggattccataatgctccgcagcctgtctggttgtgacggactgcttcacagcttcaaatacattcaaatctatccctccttgaaaaaagaaaaaaacacctgacattctctgattgaaaatggcaagtgcctgttaaagttccatatcctgttgtctgtgtttcgcctgtgccggggcggttctttgtgcttttttctcgtctgccttatcctgcaagacttccttgatgggctgcttcctgggcggctctttgctttcctctgtgccgggtgtggctttccgtacccagtagcggatgtcccgcagcttcttcaaatcagcctgtacctcgatcagaggtgttttcagggctgcaatttcttccagaagcgtttcctgctcctcttgcagcttcttttgggtgctgtccttatcgtccgggtgcttggcaaggtaggcggcggctttcgcataccgggcaacctccgggtgttcctggttgaatttctcctttgttttcttaaaaaatatcttctggtacttctcatagacaggcttacattccttgcagtctgtccgggcagaaagcagtccgtcaatcactttgcttcgggcttcctttggcttcatctgactgcggtaatctgcggctgatttcccggaagattccagaaaggcttccaagtcctccacagtggaaagccccttttgccggagataggacagggcttcgctgactgcctttaagtcctgtgaagtcccccgattttgtccagccctcgtccagtccttccgttcttcctttcgtatctccatatatttcatcagtagattgggaagaagtgtcgcttcctccgccgccttttgtgcaagcagttctttccgtttttctcccagctcggtaatccagcctttgaggttttggataagctgccggatggacttcatcaggcggttggcggctctgatttcccggttcaggttgccgatattcgtctggatacctcgcttttccatctgccggacagcagcaccctcatggacagtagggataatatcaagcccctgtctggcataggaacgcaagtccacacgctccgggcgatcattggcttccagatagcggttctggatgacctcccattcatgccgccagatttcacaatacttctggtcgttccagtccaccgtatcctccttgtggcttttccacctgccggatggcagctttatccgttccccgttctcgtcaaggtcataaaccttgcggctcttggaaagccatttcccatgttcgtccattgccctcatagtgagcaggacatgggcgtgaggattgtgtcccggcgggtgggtgtcatggatggcaaagtcagcaatcatgcctttggaaacaaactgttgctggcagaactcccggacaaggacagcgtactggtcaggcggtatctctctgggaatggtaagcacccaccgccttgcaagctgggagttccattgtttctccacagcttcggcggcgttccataaagtattgcggtctgcatactccggcggggcatttgccgggagcaggatttcattgtggacgatacctcgcttttctgggtagtgcttcacttcttggtcgtattcacagaacagcttttcgccgctctggtaggcagcggcggcaaccgcagactgctgttggctacgctgaacaatcgagatttcgttgtgtggacagggcatttcgtatccctcctttctatgcttggtggatggggtggcgttttaccacctcattttgggcagaaaaaaagcaggagacctttttcagatttcctgctcggtgtgccgctgtgtaagcggcgggtatttagttgtgaaagttcgggacaagttgacccgatgtgtgtagaataacaaactggatttatttttctttacattttatgccgtaatttcccctactaccattttcgtagcccctatatatttcatatctttttccatttatctccacttcgtcatcgttaataaatgtataagacttaccattttcttcacaatactttgaaattgcttccatagtttttgcaagagttgggtaattggcactatcctcataaggaacccaaaaagcttttttaaacatataaaatacctccttctaatttgttaagtaatccacgaattttcaaagcgttataaaataataatatcatacagcttcgcaaaaatccacttataacttcaaacttgtcggctgggaacagcttgcaacgcaaggtgtccccagatggcaagtccacaaaagggtagctggtggtagccagcgcaggggaagcgtagcgtcccctgtatgatttggagcagaccatgactgcggaaaatcacagccctccggcgaggagccttcggagaacgcaatgcaccaacctctgggtggtgtataattgcgcccttagtaaactaaggggtttctggcttcttccgttccagcagttttttcaataattcctgcgtgtcctgcctgtgaaaaatgattttgagcaacaccttgacatcatcatctgtcaggcgttccggctcttgcagaaaactttccagcataccgccacggatacagagccggtgcgtccgttcctttcgggtaagctgcttcaactggtgctgcaacgccttttcatcattgatggctttccgcagtttcttttcgcttttttccaactcccggttgagcttttccagctttgaggtatcaggcaagggcagcgttctcctttcccggtatcagcacataaatcctgtttggttctccaatgccctgacgcacccgcatgataagcccggcggtttccagttcattcaaagaacgcttgaccgtcatggggctgcgggacaggactgtagcaatggctgtgacagggaagcagacaaacaggattccattttcgtcctcctgccctttggacagcatagcgtccagcatccggcagtacatgacctttgcggtgctgctgactggaaatcctgtcaacgctctgggaaagggcatacagggcggcaatggtgtgtctatcgtcataaattcaaaattcattcggtgtgttcctcctttttctttgctcgtttggataaataacgggggcagtcaatcacaaccgcccggaagctctgcctgcacccgtgctggcatttccggcataattcgttgtaagtgacacgcccccggtcattgaggtaaaaggaaagctcaagcttcctctttttgctcattctcggcatattgcgcttcctcccgttttagtgtatggtttcggggcgattttcggcaaaattacgctcatagagccgcttaaaatctcccgaattatcagcgatagggtagactatccccctatccgattgtcgtgtttcggtatcatttcggtgtcagttcgccagttctccccggtgtcgttcctcccctgaatctcacagcggcgtatcgctccctttggtatgctcgtttcggtcagggttcctccacatccctgccaaaagtcatggcactacatcgccggggaagcatatcccacacaggctggtcattcgattggaataatccatcgatgaactacctgtatcatagaacatttttgtgccctatgccgtatgtccacaaagtaggaattaggggtaaaaatcagaaatttccacgattgcggaattgatatggtataatcaattcaacggttataaatgttgtcagaagggggaactgcttcaatgaacggagctactacaatacaggaacggctaaaagatttacgattaaacaaaggattaaaactggaagaactggctgagcaaacgggtatttcaaaatcggctcttggcagttatgaaaaagatgactataaggaaatcaatcatggcaaccttatcctgctggcagatttttatggggtgtccctcgattatctcttttgccggacagagaaccgggcggagatcaacacgccattaagggagctgcatttgagtgatgagatggtagcacttctgaaaagcggtcggattaacaaccgtctgctgtgcgaacttgccacccataaggactttatcaagtttcttgcggatattgagatttatgtggatgggattgccaccatgcagattcagaacctcaacgcccttgtcgataccgtccggcatgaaatcattgaacggtatcgccctggcgaagacgacccccatttgaaagtgttgcaagccgcccatatcagtgatgatgaatatttcagccacatggttctggatgacctcaatctcattatccgggatattcgggaagcccataaaaaggacagcgagagtgcaccccagaccaccgttgctaatgaactgaaagaaaatctggaagcggtcgaaaatttcaagggcagccgggatgaaaagctggttgttctttactgcaagcagcttggtatcaactataaaaatctgtcagacgaagaatttcgctggctgattcggattctcaaaaaatcaaagaaaatgggaacgcctattagccagaggaaaaaacggtaaagaaaaaccgctgttgcatggtttgttggcttccatgtagcagcggtttttgctgggattattcagttgaatttttagaacgacactggaagttgtttatccaaaatgaaatggaataaccatatcaagtaaaactgcaagaactatactaattgttcccattagcacagaacttttcaatgtgtccctcctcaaaacagtaagtccgatgataaagactatcaattctaaaacagagcgtgcttcgaaatatccccatccatatacgaaagtcatgttaaacaatactgctaaaatcaatactgatagcataaatgcaggtctgctttttcctttcgcataccaacagacaaatgccaagaacggagaaatcatggtaaagccaaaccaaatcatagcgtagcttcttgggaaaaatcctgcgacatagtttgaatacaaatagtaacttgcaaccatgccagcaaaaaacgcaaaaacattaacacttgctcttgttgcagaattactataaatagaaatacacagtgcaatcaatacccaaatttcaaaacgcccaaggaaattatgaacatctaatgccccatctattgccataagcacacttggcagttcagtttgacgaaaatccaaaaattttgaaaaagtccccaaagctattccaaggaacaatacagctatggtatttataatttttctattaccagatataggattttcggcactccttatatcattcaaaaacttgttcataggcatctcccaattctaatttaacagtaatcattctatcataccgttatgaataaatcatctcatgcaaaacaatttcttctgcccggttgtgaatgttattgcaacgctgcacccattccatttgagaagtgcgctttaattcctctgtcacgccctcgacagctttcatctgctccatgatggtggctaaccgttcctgtgcttgttcgttcaggtctgcaaggtatgtccataactccccggtcagtgtcaatgtgttcaatctggctgggtgggcttctcttaaatattcccggtgtagccgtccatactttccaatggggcggtgttcctccggcagtttcaagtctgggatgtagtaatccccaacaaggatataatcaattccgttttccgttattcttgatttcaattcgcccatgttttaatctcctcattctggctcatttttttgcaagtctggctctccagaaatattggtaaatctttggtaaatttgagactgaaacacaaaaaacgcttaaaaacggggcttatgagacgatttgagatttttcatcatgcccggtaaatcctgccgtggcagatgaagaggacttttatcatagttattatttactcctttttgcccggaaatgctgtgttttgcaagaattttctggattattgtgatacgctctgaaaatgcggattgtggcaaatcacagcaaaattcatagtaaaatgaaacttcttaccactaaatattttctatttcaatactaaatattttgcaatacagttctcattcattaatttttttttcaatatttttataaactttatatccacacaagattttctttctttaaaaatcaaaacattattatatgttttcatatctgctatcataggtttatattcctcctcaaagcaaattatcccattttgtgcacatgcattaaattctttctctaatttttctttttgtttaattatagatgcccacatatttgtcgcattatcatatgaaatttggacacttgttatctttaacttatctaataacttttttataacctgcattctaaacccattataagaacctgttgcatgacatatatatttgtccaaatagtcaataccaattcctattacatcttcaatttctatcatgtcccctaatttcgatttattaatttcataacggcaataatcacattcctcattttctactagctttgaaaaaagctcttgcgaaccataaacttgtataacatccttactactctcagaaattacgacagttttatttttatacgtaacattttgattccgtaaccctctacaattttctataacattccattttaaatctaacgctgaagtttttccactttctaattgctcttttattccagatataagtttattagcttcctcttcatatacataagtgataatatcgtccttcagctttccatcaatttcaacctcacttcttgaaagattaggaattacactttccccatacaaattcctccctgttcttgttgcaaaaaaaggaatgtcaacatttttcatcatatcgcttgtttccgatcccaacgtgaccctaactaccatatcattaatcaatgctgtcttatttgcatatctacgctttttgtcttcgtcatacattttatctatgtacaaattgttatttaccatactcatgccactaacatctagcttttcaataactttagtctcctgagtcttattaaaagtaataataattttagaatcgtcccatacacaaaaattgtctaaacctaaaataggaattacatcttctattttttttgccgcttttagatgattcacaatttgttcatcatcaatatttacctctaatatcgttgctttaccatctttaaatacagcttcatcaacctctatcttttccactttcttttcattattactctggaaaatacgaattcccaagtgcattgacgactcttttttagaatagacttttgcctctttaccaatcaaaaagatggacaaaatacctattccaaattttccagtcaagccatcgtcatctttattcttacttgattctccaattgttaagaaataatttactatgtcattaaggtccatacctatcccataatcttccacttcaagtttagcattattttcttcaacattcactcctattgtaacctttattggcttattcgcttttttgcatgcatctgtagcattttgtagcaactctctaaccaccacctgaaacttgtcttgcttttgatataatggttttattaataaatcaatagcattttctgatattgtaaacttcaaatctttttcttgtatatcacacgtagcatcgcttaatgttttataaaattcgccatatgaattgtccaaacaaaatctttttatatgagccttattctttcccgtaataatttcaatttcttcgaaagattcgactccttcatctgcatatgctaatacccatactctctgttcaaaatttcttttttgttcatttgtcataacttctagcattgtatctaaaacattttttacattttcgtcactaatgctatatcccataaagacaatcggattttcccaaaataacgtcatcagcttcgcatacagatatttactatttgccataaatttgtcataatcttcctgagttatcactatagatgatggttcagaaacacatccatgtatcttatatattgtcttaaaatgattgtctctacttgaaaaaataatatcctgtcccacacaaactttatacgattctccaaacgtattttttagcaattcatcataatttgttgtaataattgcggtaggtatgatattagccaattcgctgagttcatgtttcttatcttctgtaatcacgtctttttcttcaataatttgctttataatttttcttagcggatacctcctatcttcacctttatcatattgtggcttttcagatgcaaaacaatgatattccaattctgtagctatcttttcatagctcccccatttttgtatttcgtctttattaatgccaactttatctgccaccatttctaataatgttttccaatctggtgtattataatatcgttttgataaaccagatccaataaataataccggtgcctttcctattttatatattttatctttcatttctttaagtgcctcaattatctccatttccgcctccctgtataattaatattatccttgaaattatatcacatccactcataaaatgtatcattttaaatcgcccaaccctaaaagctggagcatcatctatctttcatattaaattgccttgagcattttctacgacatcgttttcccattcttcttttcaatctctacttgtacctttcggcccccatcctgttcagttactcctcagcatcgttaaatccgatatgtgtatacacattcatcacgctttgcacctcactttgctttcgactttttacgtatttccttatccaatgttgtaaaaactgcctgtgtacaatcagctatcgtcagactgttaatcgtgtttcctgcaaaagtgccatatcgatttgtaatatcaccgatataaagttccaattcaatatcagagcgtttctgataatattcactattcagcacaagtctgttccttctgtcatcaaaatgtaccggaagttttgtaatatcacactgaccaataatatgaatccccttgccccttaagctgttgctcctttcgtagattttgttgtatccatttcttcaataaccgtttctctgctaccgctcttggagactaccaggccctgcagtaacaaaagcttgttcattgagaacgggatgaaattgtcaaggtacaaatccgttacatcattttgtgtaactttttattgttttcaaggatattttaagctataatgtaaccgaagtcaaaaagctgacggtaacggttacgaattaacgattggaatgaggtatgatatgccattaaactggaatgatgaagcgctcccatcagaagcagataaaacaacagatatattaggatttaaagaagtcggcggtgtcggacaactgatttatcatcctttccgattcaagaaatatgaacttgatattgataaaagcaatgattattgtgcaacaccattttgccgtcccggatatgaaccaatcttccctaaagaagattttctttctgggcagggactgcttgccagcctttgcaatctggcaatgcagataaacagttttgaaaataaaataccctatacacagctcattatggaatggtgtacaaataatatgcatccatataatattgatttcatctattctgaattgaatgaatcatttgatataaatagcttcgatgcagaaatggtagaaagagatggaacattcgagattaacaccttcttagatgaccttggaaaattatataatgcagtcatgttttatgttgctctcgagggtgtctgtattgccgatgacgaatctgcatatgatttatccaaagaaggaaaatactttgagggctactctttctttgataaatataagcatcctatcgttgcaataccggatgacttagattatggggatgcaaaaggaaacctcatagaagaaatgcgaattgataatgagtacattaaaaatcatccggcagaaaatcctccaaccggagaatttgctactacaccatatgacgattacgatgaattgcggaatgctcttattgacatcattccggaatttaccatgaaattaaaggtagatccccgcactaaccgattagaattttctaccgatattaattctgtatttgatattgcatggctgacacttgcaagaatgctttccgaagaccctgcaccagaagataaagggaaatcagataatcgtccagaaggcattatgattcgttgtcgaaactgtggtaaattcataatacgaaagagcaaccgacaggagttttgtgatgccgaagaatgccagaaagttcgaaatgcccgaaagcaaaaagcctatcgtgagcgaaaagccattgaaaaggctcaaaaaatcaagaaaaaagcacattaatttatatgatttggcggaaaggcaaatagattattgtatctaatgtcagccagatacatgcaattatgtgctatgatattatataaaatatgttaaaagacaccagaatcccccctatgcaatttcgcgaaaaaacgtgtgtaagggggcatgggtctttaggacaaaaaggcgcagagataatactcccccatgagggctaaaggaggacatatggcaaaagcaaatatcgaattacctatgttttcaacagatataaatgaaataaagatttatgagcttgatcacgtgattttagatttattattagcagacaaaagttccaaaagaaacattctgtgggccacaaaagactatctctcgtatggtaacttatacgatgaacactgtcaaataatgccggagcaaatcacttatgataatctaaatattattcaaccacgtgttttgaaagagaaagacaaacaaacatcacgtacaaaaggaaaagcagaagtttttacaccagcttatgtttgcaataagcaattaaatcttgtcgatgatgcatggtttggtcataacaacatttttaataaaacaacacgtttgggttggaaaacaataaaaagaaaaatcgtattttcagataaaaagccttacagatggcaagattatattgacctaaaacgtcttgaaatcacttgcggagaagctccatatataacaagtagatatgatatgcagacaggtacttttattcctgtacaagacagaataggcatacttgaccgaaaactacgcattgtatccgaaaatacttcttgtttagaggattggataaaatgggcaacacgtagcatcgaaagcgtttatggatttgaatttcaaggagatagtttaattattgctagagaaaatgtactatttacatttattgaaaatatgtacatgaaatttgaatgtgttccagatgctaaattgctcaagaaaatagccaatattattgcatggaatatatggcaaatggatgcatttacatattctattccctacgaaaaaaatttacctcaatatcaacagaccagtctatttgctgatgaagtgaaaaataatctttgcaagataaaagattggcgttcaaaggaaaccctcacatactcagaattatttaaggaaggtgactgatttggaaaatatagaacttatttcagaactaataacaggccgagttaaacctcatatttatgcatttacaactaatacaatcccaaactatttaaaagttggtgatacttatagagctctcactgtaagactgaacgaatggagaaaacactttccaaatttacaacaagtgtacagtaatcctgcatctattgatgacgagatattttttagagattatgctgtgcatgattttctcattcacgaaaaagggaaatatcgtttattgattgaggatatggttggttttcctcccggcacttattattctaaagaattttttaaggatactaccaaagccgatgttgaagaagctattattgatatccaaacaagctacaagaataatgacaataaatatcaattctataatgccaatactgctctaccggaaacatatacatatgcttcaaccggatattggactcctaggcccaatcagcaggaagcaattgataattttataaatgctgtagataatggcagaactaatttactgatgtatgcagtaatgagatttggaaaatcttttactgcaatgtgctgcgctaaagccaaaaattttaaaaaagttttagtcgtatctgcgaaagcagatgttcgagaagaatggaaaaaaactgtgcaaagcgcagataattttaatcaagattatgtttttctatcatcagaagagttattaagagatgaaaatatcgtatcagatacattagcttcagaaaaaggaattgtacttttcttgactcttcaagatttgcaaggcaccgaaattaaaactaaacataaaagcgtgttcgaaaatgaacttgatttactaataatcgacgaaactcactatggagccagagccgaaagttacgggcgaataataaaaacagctaatacggtcaaagatattactttaaatctatctgatgatggcgatgattctgtagatgcaaacattgttgatgagcaaataaaagaattaaatgtacgaataaagcttcatctttcaggaacaccatatagaatactaatgggaagtgaattttctcaagaagatattatttcattttgtcagttttcagatatcgtagcggaacaagaattatgggataagcagcatatctcctatgaagatgataaatatattgaagaagacgaagacaaatatcaagaatgggataatccttattttggatttccgcaaatgattcgatttgcatttacaccaaatgagtctgcactaagaattttggatagtttaaaacaaaatggttctacatatgcactttctgaattattaaaacctatgtcaataaaaaaaacatcagatggagaccataaaaaatttatacacgaaaaagaagtattagacttgtttgaagcaattgatggttccaaagacgatgaaagtatttttgcttttttagactacgataaaattcatgaaggaaaaatgtgtcgacacatggttatagttttgccttactgtgcttcatgcgatgcattagaagaattgattattactaataagacttcatttaaaaatctttgtaattatgaaattataaatatatctggtgttgacggtgctcgaacatacaaaactgtacaagctataaaagataaaatcagaaattgtgaaaagtctgacaaaaaaactataactcttacagttaacagaatgcttactggaagtacagttgagcaatgggatacaatgatttttctcaaagacacttcctctcctcaagaatatgatcaagccgtatttagattacaaaatcaatatgttcaatcttatgtagatgaagaaggaaaagtcattaagtttaatatgaagccacaaacattattagtagacttcgatcctcatagaatgttcataatgcaagaacaaaaatctttaatttacaatgtgaatactgatagttcaggaaataatcatcttagagacagaatggcatctgaacttaaaatatcacctatcattactatcaataagggaaaaatccagcaagtatcagcaacggatattatggctgttgttagcgaatattcaagcagtcgtggagtaaaagatgaagcaaacgacattcctgtagatgataatctatttgatattgatgagataaaatcagagatagaacgtcaagctgagcttggttcaaaaggtggattaaagactgaagcacacgaaggtgatggtacaggatttgacaatactgataaaaacgatggcaatagtaatgcaaatactacaggaacagattcaaatggtggaaatgatgatactgctgcttcatctacaacagatattgaaaaccagattcagattttaagaaacaaatttaaaacatactattccagaatactcttttttgcatatttgacagaaaaaaaagttacttcattatccgacattatagacatttctacagaatcagatagcaaaagaattatgaaaaatctggatatagatataaatatcttaaagctaatggtttctcatatgtatccatttatactgaccgctttagattataaaatacaaaacataaatgctctttcccatgacgaaagcattactgctatggaaagagcaattactgctatgggtaaattcggtaaattatctgaatctgagataactactcctatttctgtagcaactaaaatgattgaactaattccagatgaagcattttcatcattagcaagagacaatcatcacatattggatatcgcaagcaagatgggtgaatttgcaattgtaatatttaacagatgcacttctcttggaatagacataaatctctacaaagataagattttgtccattccaacttcatccgtagcatatgaatttacacgaaagatttattcaattctaggaatggatatttcatgtattgcagaacagtttacatcatacgatttattaagtattgttgataatacccaaaatgtagattatgctcatatacaaaaaatattgtcacaaaataaatgttttgcagatatttcattagaatgcgttgcagaggaggttgaaacattgaaatttaacgcaattgttggtaatccaccatatcaagaagatgacggcggcgccggtgcaagcgcaagaccattatatccatatttcgttaatatggcgaaaaacttttcatcagaatattcaaccctaataattccaagcaagtggtatgctggtggaaaaggattagatgaatttagagatagcatgctacacgacatcaaaattagagaattgcatgattgtatccatcctgaagacatttttccagatacaaacaacagaggtggtatctgctatttattatgggatgataagtataacaacaccgaaagcacaaataaaataaaaattgtcacacatgaagaagccggaaaagaatatgtagattcaagattacttataacaagagatttagatatttttatccgtaatggcaaagcaattagtattcttgataaagtaatgcctgaagatggcactatcaaaccattatccgatattatctctccaagaaaaccttttggattggaaggaaattttgttaaagatcctggttttcacaattcagaagatggattaagcaccccaattatttgttatgggaaggcaaaagctagaggatttatcgagcgttcttctgtcctctcacatgctgagtggattgatacttggaaagtatacatgccatatgcaaacaacatcggaactgagttgaatgatgataaccaaaatacttttatcggagagccaggttcatgttgtactgaaacatttctctctgtaggtcatacactcggcttatccgaaacaacggccaagaatttatccaattatatgagaacgaaatttgctcgtttcttacttagcttagccaaaatcagtcaacacggaacaagtaagacatatcgttttgtacctattgttgatttcaatgaaaaatggactgatgaaaagctatataagaaatttggattatctcaagaagaaataaactgtatcgaaacaagcataaaaccaatgtaattctaactacaaacagctatgtaatggtgagaactattacatagctgtttattatttgaatatatatcatttatgcattcaatcttgccctcttagtagtaaggttggtagtatcgttcaattcatctgccctattatgcccaatattgccccaatttacaaagagttgcttacctatccaactgacctgccgtggcagatgaaaagtactttaatcattattttatttctccttgttttgccccggaatgccctgttatgcgaaggatttcggggattttgtagtttgctctgaaattacagattgtggcaaatcagagcagaaccctgcaagttgttactacctgttagtagtaaaattagtagtaaaagggaaaaggttactactaaggggtttcaccaacttcacttccgcttggacagttaatgttcttttccggatatccaatagtcccataatcaatataatttccttcatatcttagcaattttaatattaccctaaccaagatacactcgtatacctgacttgtcataaattgttcttcgtaatcaatactatctccagcatatgaaccatgcgcagacaaattacgtgcttgcaatgccttcttctctttttttccaattaccatgtctattccttcaaaaaaatgtgttaattgttcactcacagacatgcggttcataccttcaacacttctcttcattctttccacatactccgttcctgcaaactgtgtttccaccattttttttattgattttattctttttgaaaaatcttttttgtccattagcaatgtttctggattaagttcaacttcttcataccactttcttttcaatttctccaatgccgcggaaaatatcggtaagtccataggttgcgtaactttttgagcataccaatatgctgaaaaaaaagaatcaaaatcaagtttcccatataattcagaaaatggctctatatatttttgaattgtatcgaaataattatgaagaaacgatacatcatctttaataggcgtctttgccccagacatacattctttttttatatcaaaaccatatgtgcctggatttttcataacgaaaccgatttgattgccattttcgtcaaatgaagactcccccacatacatcaatctctttccaacaaaaaaactcaaatactctctaatttgttttctttcttctatacttggaattcttccatacttctcaaaataagaaatactaagattggtactccatgaaggtccatatttgttcccaacaaaatgaatgtcaaatgccgtatctttatatttaaagtgtataaaccttcctatatactcctgctcttccaattcctcttttattggaaactgtaaatctccataaaccccagaaacagaaccttgtaccttatattcaaatcttgaattttcacaaaagcgcaaaccacttttactaccattcagtatccattctttaataaccgatggtgttttcacactttttccttcaacacaataacaagatagtttatagtccgttttgtccagtttacttatatatccatcacaatacataggtgtaaaagtaaccgtataatcatcaaatatttttatttctaattttcccgccggcatagtctccccaggtataaattctcgtttatccactgtaggtctttgctttatttctttatattgattcaaatatcttacgcacgaaatactgatattataattatcatctctgtttacacataattcatctacatcatcccaaaacacatcgtcaagattttcttgttttatatctgaatggccactgactataaaattatcaataggaatattttcccatagcaatgaatcaagttttcttttattcataacacaccttctttcaaatacgataatccaaattacattatatctgatatgcttattcttttccacagaaaaatgccccagcctaagccagagcgtttcctatcttccatatcaaactaccttgaacatcttctgcgataccgctttggcatcgtttttcttttcaatctcagcctgttcttttctaaactcttccatccgcttcaattcttcctcagcatcatcgaatccaatattcgtgtacacatttattgtgaccgatatatccgaatgctccatgacgtactgtaacgtctttggattcattcccgattttgccatattcgaacaatacgtgtgcttgcatacatgtggtgtaatgtttggcatctgtactcggtagatatcattgtatctgccaaccatatgattgaatcggtgctgccagtgcattgccacaagtggcattccattatcatcgcaaaacaggaatccgctatatccatctatggctttctccactttcggtgcatttctatcctcaatgattgcctgaaacatctgccacatcctctgtaatcggcaatattcttgtcccgacatctgtccttgtggtttctatgatgtatcacatatccgatgtcctctgtaactggtgggcgatattcacggttctattctcaaaatcaatgtctttcagcgtcagtccgcaaaattccgatattcgcattcctgtatgaaagagtatgtacaccacttcatagtatttgcagtacaccacatcgtcatgcacaaatttaagaaactttctcatctggtcttttgtaattgcctctcttgtgactgcgtcatttaccaatactccggcaagctgaaatccgaatggattctttactagaatgccatcatccactgccatctgaaaagctggtcgcagcactccccggatggtataaatagaactatagcttttcccatccatcttcctgctgcaattttataaggaataactttgcatcggaagtttttatacttcatatcgtctttttgccaaatgtttctttcactaagagttcataattttacagttacttcaaggcgaaattcgcccgaagtattaaaaattatgctaagctaacttttatttttgtaaatttggccacttgatatatttaaaatatttatattgtccatagtgttcagcatactcattccatgtataatattgtatacttgttttgtaatcattactttcatatatagcggccccattttcatcacgagacaaaagaatctgagaatgcttattttttcccattctatcatttcccttaatctcatcacatatcctaataaccgctcctggctcagcactaccaaggtatttcctacaattttctggtgtaatagtacgttcttctaatgaatgatatatacgcatcatatcatcatctgtacctgttctattagaaaagctatcacaccatatatgccaatacacttcccttgcaaaatcccaacaattctcccacccataactaggccagtcgtttcttccatcattcggtccatagaatgtgccatcttttatataaggcaaaatctttccttgtataacataaaagacacgttttacttttgtctcatcaatatcactcttttctatctctgtaatacgaaaatcctttatcatattccgccacgccaaagctctattcaaatcaattcctatttcattaacaacttgaggatataacaccattctcttcggtgtaaccggagcacctgtcagcgaaagaattgcgacataaaattcatcaatatcccactgttctacccgctggtcttttttaaatagcttatcaattgttttaaaatcatttccaaacatatttaatcgtattgaatgtaaataaacgtacaaaataaattttttaaattctctacgtttactattctgagtattctcataatagtctctcaatccattaaaaaagatatatgtatagacgaattcaaacatctttctacggataatgcacttatcataacctttttcaattccaatattacgtataagttgcatttccaaagtagaacatccgcgaatcttcatttttaatcgacgaaaaaaataatctatcgaccatttagattcactgaatttctccacaaatctatttatgacgtatcttattaatctaaatctctttattaatctccatatacattttagattgtatcgccaagatcgcttcgctttaaaatgctttttccatgctctattctctctatatgtttcaatcttgtatttaaggaattctacagaaaaccaattatatgaattctctctatcaaaataagatttatcctccaatccaaccataatatcaaatctgcgttgtaattcttgactatcccacataattttcttaccatcgaattgatcaaaatgtctctttatcgtttgaaaatcatataagccaaattttgatgtattaagcatgtgaattgtaatcagcaaaatacctatattcacaccgtagaatccatctatcggtatttctctcaaaaaaccacaaaggcgctcatccgatacaattatatttatgacaatacctattcccgcatcgataaaaataaactgatatgtaaaatcaatcattttataccagacattaccaagcaattcgcactttaccttatcatcagacaagtactcttccaaaatgaacatcgaaataagcagcataactaatgtaagtgtccaactatattttgaaataagttccattgcaatagttgttgcataaatcaatgatatcttttgtctctttgtaaaatgctggtaactaaaaattacaatacacgacaaaaaatatacatatatcgaattattttcaaatacctgcgcctctgctaacatctttctcttatcctctaaaccaatccaatctcatatctacaaacctacatatagcatataccatatccacaccatcgtcaaactacattttatgtttctaaaattagtattttccataaaaggcatatcctctttcaggattccttccctgcggcggattgctcctgcctcttgcgacatcctttgtcatcgccacagtgcgctccccgcggagccttttacttcatagggcgcattttcctataaagtaaaaacgggaaatccgatcattttccatcggacttcccgtcattcttcttatcctattttcccatcccctactcataatcgaacttcccgtcgtttttctcctccagcgccttaatcatatggtaggtaaactcattgtacggtgtcgggatccccagttcacgccccatgcgcaccaccgcgccggcgaacatgtccacttccgtgtgccgccccgcatccagatcctgcagcgtggaatagcgcgcccgatcccgcaccttactgccgaaggtggatgaggtatcagccttgtcaaaatcgatcccctttttctccgcgatccggtccacctcttcccgcagccggtcccgcaaaaatgccacatgctcactgtcacggtaggcgcccaccccgcagcccaccatcgcctgtgcctggttgttcggcacgttgagccggaatttgctccagatctccgtgaggataacgtccgtcgcacggtaatgcagccctgtatccgcgaaaagatcattcagcgcctcaatgcgtccggtgcctctgctaagatccgcttctccatatataataccgatggtcgtctccggatcgaataccacctgattgccctttcgctccgaggcaaccttgatcaatgaatggacaattttggacggatcaatgatctctccgatgatctcctcgctgtccacgccgttcatcagactcatcactgtcgtgtgttcgctgaccacggtctgaatatcgccaagtgccgagcgaagtgcctgatacttggtggcaacgattaaaagatcgacaccggcagcctcctccggcgtcctgacagcggggtggtatacctgcccgttaatgacaaagccatccctctcatagcgcgccttccgctctcccgatgcgactacgcacagatcaatctctttcttttttgcaagcccccacatgacataagaacccactgctcctgcgccaagaatggcaaccgactgatatttcattgctttaaccctctttcttctgatacctgcttatcatttcctcactccgctaattatgaaagcagaaaatatttcatataaacattgccaaagatcaacacggcagctgcaacgatcagcacaatcagtccgaaaacagcaatttcctttaacatgctgtgttttttctcaaaagagtcgttttcttcctggtcgatcacttccacgttatccattttcattctttgatgatctgtaacatttccctccgtctgtctttgatctacagcccgcagaaaatcttcttttgcgtgggttgcatgcatactttcctctgtctgccattgatctacagcccgtgggaaatcttcttttacgcgggttgcatgcatactttcctctgtctgtcttcgatatacagccagtggacccgagatatgcatgatcttactccggaactcgaaaagccataaaacatcttcttcactgcagggataatcctcaaacgaaccttccccgtgtgccatctgattccttatatgtcttagttctctaagcctgtcatatgtctgattccattccggaatcctgtttctctgcatgaccggaacagccatcatatcattcagataacatgtaacgccgccgctgtttataccgtacatttccgaacaaagtttatccagctttttatattcatcaaagaaaatgatacttgtattctctggcacgttctgtacctcctacctcttctcccgcagctttttcagataagcattcttcacttcattctcatgccggagtcttccgatctcatccttcagatactgcacatactctcttgtcagcttcacaccgccccggaccgccacgtcctcatgctgctccatctcatccagccactgctgcagcgatttatcccggatatcattaaacgtcgtatcttccttaaaaaacatcgctctctccatttcctgcattattttctgcaccttcgcatcttccagttcagaccgcaccgcttttctgcgcattcgcatcttccagcccagaccgcaccgctttcccgcgcatctgtatttccagctcagaccgtattatttttctgtgcatccgtatcttccagctccaaccgcatcagcacgagttcctgccatctgccgtcgcgagtcagaaagccccgcggatttcttccatattccacaaacccgtacttcttatataatctcaccgcggtctcattgtcaccgaccacctcaagttccagctgccggaatccggcttctttcgcgcagtcaatacaggcgccggtcagtgccgcaccgattccctgtccccagtattcccgcaggatactgataccgaaatccgcgcggtgccttagcttctcgcgcgtgctaagcgcatggttccccgccgatcccacaaggacgccgtccacaaatgcacagatctcaatctccgtgcggctcgccttttgcgcggcaagccgctcttccatatcctgcaccgagtgcgtcccttcgtccgcatacgttgtcagaaaatccgtctccgcgtgtgtctgtgtaaaataatgcagaaacgccgccgcatccgcccgttccgcatttttcaaaagacattttctctgatcttttaagctgatctccctgtaatataacatgttgctcctctcccgcttttgcgcagcaaacctttcatcaaacctcatttgtcaccgagtatagcacactcctacgcaaaaagaaagaacgcactcctggacacatcagaacctactttgctgcacacgcacgtaattctgcaatctgcttctccgtcagcggtaccgtcggagaattgtcatcacaggtgttcctgttttccacaattaaaccaatgaccggcgcatattcctctcctttccctccacaaaaaattgccctgcttttctatttttattagtaagaaaacagggcagtcccatacacaatcttctgctccttgttgcagtacgccatgtgcatgtcattgtagtacagttcaatttcggaaaacaccgggtacacggtaacttttccggtccccgtcccatcctccgtttccactctcttcccgtctgatcaggtctcatccaaacaatatttttcatctgttataaatcatggtatactggattgcagcgtaaagcaacaacaaatccgcgcagatacataaaggaagtttatcatatgaaacgaatcgattttgaacatggaaccatcaccggaaatattttgggagccgcccttcccatgctggtcgcacagctcttaagcctgctctacaatattgtagaccggatctatattgcccgcatcccggatgtcggcaccacagcgctcggtgccgtcggactctgtttcccgatcatcgtcatcatcaccgccttcagcaatcttttcggcagcggcggcgctccgcttttctcaatcagccgcggcggcggagataccaaaaaagccggtcagatcatgaatacctcatttaccatgctgtgcgccggcgctctggtgctgatggcagccggcctgctgtttgcagcgccaattcttaagctgttcggcgcctcggatgccgccctgccatacgcctatccttacctgatgatctatctgctcggcacgctgccgtccatgattgccaccggtatgaacccctttatcaacgcgcaggggtactccgtcgccggcatgctctcggttgccatcggtgccgtgaccaattttctcttagatccgctttttatatttgtctttcatctgggaatcaccggtgccgcacttgccaccgttctctcccaaacgctgtccacgctctatgtgatccgctttctacaccggcgcgcggaatataaggtgcggctgctgcgcccggatgagtggagttccagtctggtcgaagcaaaaaacattataagcctcggcaccgccggatttatcatgcagctcacgaacagtctggtatccattttctgcaacaatgtcctcggtgcaaccggcggcgacgtctacatctccgtcatgaccatcatctcaagcgtccggcagatggtggaaacaccgatctacgcgatcaatgagggaacctcgccgatcttaagttacaattacggtgcgagacgaccgggccgcgtgcgaaaagcgatcctgaccctcgccctcctgattctgctctataccgccgtcatgtggagcatcatcatccttgccccgcgtgcgctgatcggtattttcagttcggatgccgcactggttgctgacgccatccccgcattaaagctttactttgccgcttttattttcatggatctgcagtacatcggacagaccgtcttcaaatccctgaataagaagaagcacgccatctttttctccctgctgcgcaaagtattcatcgtcgtgccgctgacctatcttcttccttatgctttcggcatgggaacagacggtgtctttgccgcagaaccggtgtcaaacgtcatcggtggaagcctctgctttataacaatgttgtttacggtgctgccggaattaaagcggatggaaaaagaagcgtaacccgtttctccctgctgtctttgtattcagacacactgcattcatctcctatgtttcctcgtactccgccagctctgtctccgtctcaagcatccgctccagcagactgtcctggttggcttcctccgcatccacagcgctctgcagttccatcagcttcggataatcactcgcaagcgccggatctaacatctgcatctgaagttccgccagcttctcctcgctctccgcaagcatccgctcatacttttccttctgacgctgcagccgtgagcgcaccttgcccggattgtaataggccttcttgtcaaaaacatccgagagcgtcggaacactgccggcatccgccgctcctctcacatcggctccctgtcccgcggcacttcccgcgttccgccctgcggcgcttcccgcattcgctgccacgccgcctgcacacttctgcttctctgcgagatattcctcataattcatcgcatactgcctcacggcatccccggaaaattccagaatgcccgtggcgatcctgctgataaaatagcggtcgtgcgacacgaacagcaccgtgccctcgtactcgcgcagcatctgctctaacgcttcttttccgatgatgtccatatggttcgtcggctcatccaggatcagaagattcggtctggtctgaagcattttgcacagtgcgagacgcaccttctcccctccggagagctgccccatttttttctccacatcctgcccggaaaataaaaagccgccgagcgcgctgcgcacctcctcgcgcaggtaccccggatacgctgcccagaaattctcaagcacggtctgttggggcggtgcctgctccatcaccgctttctgctggtcaaaatacccccactccacgttctgcccgaatttgaagctgccgccaagtgccggctgttctccgatcaacgtctttaataatgtagattttcccttgccgttctccccgatgatcgccagacgctcctttttctgcagcaaaaaagacacctctgccagcggtgcatcatagccgatggagaggtcttttgcctgaatcacattggtgtagctctcgatacgcggcgtataccgcccgtgaaatgcgcgcgtatcaaagcgtctcggcttctcaatcttcaccatgtgctcgatcgccatgcgttttgagcgcgtcgccgccaccttggtcggtgtgttcttccacttttcaatccagtccgtcagccgtttgatctctttctgctgttcctcgtaatccttctcctgcttgatgagattctcctgcttgcgctgcatgaaatacgtgtagtttcccggatagcgcttcatctcgtgatactcgatctcataggtcacatccgccaccttgtccagaaacatccggtcatgcgacacgatcacgaccgctttgtcgtagcctttcagataattttccagccactcgattgtcggcagatccagatggttcgtcggctcgtcgagcagcatgatatccgggcgcgtcagaagcagctttataaacgccactttcgtctgctgccctccggaaaaactgccgatcggacgccgcagatcctccagtgcaaatccaaaccgctggaacatcgtctccatatccctgcgccaggaatatccccgcatcgcctccatctgcttctgcaatctgtcatactcgcgcaggagcgccccatccggcgcagtctcctttgtctctgccgccgtcttcatctgctcctccagctctttcatgcgctcctcacaggcaaacaccggtacaaaaactttttttaattcgtcctccacggtcacctccgcgtccacaaagttgacctgccgcaggaaaccgatctcctggcctcccgccatcgtgatgccgcactcctcgtcactgtctgggttgctcatctctatatccccggcaatcagtcttagcagggttgtctttccacagccgttgcgccccacaatcgcaattttttccctgtcgtgtacctcaaaattgacgtcctgcaggatcacatccccaccgaactggacgcgtgcgtgtctgatctgatacctcataattaaaacccacttctttctatattacagtgcaaaagccacggctgtctgccgcggcctctcttttccatggaacttcatatctctgccgataaactcctattttgaactcttttggattataccgaatcccttctgtactgtcaacgcctcccgccgcaggttccccctcttttcctctcccatttatatacagaatttgctaaaattttaacaattttttattgattttatgagttaactatgtataattatggtaggggaagttggcaaattccagcatcccggaaaagatatcgtaaagcctgctatccgcaggtgtttaccatataaatatgaaaggaaagaggtttaataagatggcaacaatcgatttaagcaagtacggtattaccggaaccacagaagttgtgtacaatccttcttatgagatgttatttgaagaggagaccaaaccggagctggaaggctacgaaaaaggacaggtcagcgagctgggtgcagtgaacgttatgaccggtatctatacaggtcgttctccaaaagacaaattcatcgttgtagatgaaaactccaaggacactgtatggtggacctccgatgagtataagaatgataaccacccggctacccaggaagcctggaatgcagtaaaggacatcgctatcaaagagctctccaacaagagacttttcgtagttgatgcattctgcggtgcaaacaaagatacccgtatggctatccgtttcatcgttgaggtagcttggcaggcacactttgtaaccaacatgttcatcaagccaaccgctgaggagcttgagaactttgagccggatttcgttgtatacaacgcttccaaggcaaaagttgagaactacaaagagttaggtctgaattccgagactgctgttatgttcaacatcacaagcaaagagcaggttatcgttaacacctggtacggcggagagatgaagaaaggtatgttctccatgatgaactacttccttccgctcaagggtatggcttccatgcactgctctgcaaacacagacttaaacggcgagaataccgctatcttcttcggtctttccggtacaggtaagacaacactttccacagacccgaagcgtcttctgatcggtgatgacgagcacggctgggatgacaacggtgtattcaacttcgagggtggatgctatgctaaggttatcaaccttgacaaggattccgagccggatatctacaatgcaatcaaacgtaacgcacttcttgagaacgttactctggatgcaaacggcaagatcgatttcgcagacaagagcgtaaccgagaacacccgtgtatcttacccgatcgatcacattcagaacattgttcgcccgatctcttctgcaccggcagcaaagaatgttatcttcctgtccgcagatgcattcggcgtacttccgccggtatctatcttgacaccggagcagacacagtactacttcctgtctggattcacagcaaagcttgctggtacagagcgcggtatcactgagccgactcctactttctccgcttgcttcggacaggcattccttgagctgcatccgaccaagtacgctgaggagcttgttaagaagatggagaagagcggtgctaaggcatatcttgttaacacaggatggaacggcacaggcaagcgtatctccattaaggatacccgtggtatcatcgatgccatcttaaacggcgccatcaagactgctccgaccaagacgattccatacttcaacttcgaggttccgacagagcttccgggtgttgattctggaatccttgatccgcgtgatacctacgcaaatgcttccgattgggagacaaaggctaaggatctggctgcaagattcgttaagaacttcgcaaaatacgaaggcaacgatgctggtaaggcacttgtatctgctggtccgcaggcataattgctgcgaacaatccgcctaggaatcataaaagaaggggctgccgcataaagcggtcagtccctttttacgtggtaagtactataatggaaaacagatcatgcccttcgatttcagatggaaatgtagctggaacattcgttgaaaaaaatgcgtacatttcttcctgtcggatttttgcatcggattccgtgtctcttccacgttttgacaatccacggaatgtgtccgacaaaccgcagacaatgagcggattccctagcgtccctagcggcactgcttcacagacaatataaaaccgcgcgaaccgaactcgtcgtcatcagctattcaaaacagggcagatgacgactcagacagcggcttcgcgcggttatgttctattcagcagtgccgcaagggacacacgagaatcctaaaattgtctgcgggttgcggacacacccgtggagtgctcaaaacttggaaaaacacggatcatcacggatgcaaaaaccgacggggtagaaatgccgcattttttgatccgaatttccagatgcattccatctgaaatcgaaggatatgatcttctctttataatattacttatcaagtcaaaaaggggctgcccgcttatggggctgcccctcgttttactgcatcttaaagtaatcaatactgctgaccagctcatctgcgatctcgcggagctgctctgcactgacatacacctgcttgaaagtatccactacctcttccgtctcatcgtatgtcttcttcgtgctgtccacattgccctgcacgatttctgagagttcactcaccgcctgcagcacttcatttctggaattttccagatgtcctgtgctttctttgatctgacggatactctgcatggagctgccgatctgcgcgattacctcttccactaccttctgcgtatcctgcatgctcgcgctctggttcataatgatctcctgcatctgctgcataatctcaaccgcctttgcagaatcctcactgagtgtcttcgcggtctcctcgatctccttgctcgactcattcgactgctccgagagcttcttgatctggtctgccacaacaccgaatcctctgccgctctctccggctctcgccgcctcgatcgaagcgttcaggctgagaaggttcgtctcctccgcaatcgacgtgataaacgcggttgcctcatggatcttctgtaccgaatcgttggtccggttcgtctgctcctgcacttcaccgataatgcgttccacctcgatattgatgttccgcagattgttaagcgtctctgccgccttctcactggactgctgcatggaagctgcattgtcatccaacagttccacctctgccgacgtctccgtaatattctcacccataatacgcatatgttccgatgtattctgggaattctgtgcctgttcggtggaattctccacaatctggttgactgccatgcgcacatgatccatggttccgtttgtctggtctgccgctgtaccaagcagttcggacgcatcgagcaggcgtttggcattctgtgaaatctcctggatagttgccttcatggcatcccgcagcgtaatcgtcacgcgggacagatcaccgatctcgtcgtgtctcccgagcagcttgtcttctacccagacattcagatcgccgtccgccacttttcctaccacctcaatactgctgcggatattgcggctcattgaggttgcaagcttcatgccgatcgcaatgcataagatcatcacagcgcataccgccatactgattgttcccagaatcttgttgatcacggcatccttttcctgcttgtccgttcccacaaaaatcataccgataatctcatccgtcgatccgttctgatataccggtataaaatatccatagttcaaagtgccctcgatcgacaccgcatgactgaaataggattcaccgccctgcaataccttttccacaatccggtcaccggctttggaattcaagatgcggtcaccgtttgcatcgaccgccgatgtcataatgcgggtatctccgtagaaaaatgtgacatccatgccggtattgcccttgatgcggtctaccagactctcggactttgaaatattatagctgcctttccagatatctccattgctggtctggagataatctcccgtgttctgatcgtaggctgcgagcgtggctgccgccgttccccgaagtgcttcctcaatctcctccagcatggcgctccgtaccattgtggttgtcaaaaacatggaaatcaaccccaatataataaccggtgcaattgtaatccccagaatctttttcttaatgttcatactaatctccatttcgtctgtgcatctgcatgtcgcttttcgtccggctgctccttaatccacaacattcaccgtcttaaaataccagttgatgccgccggtgattgtcgcatcgtcgagcgtcttgcccgcttcaccgaccgtctctccggtatttgtctcgatcacaccgtcaaatacaccgttctgccccgaaaggatctgttccttcgcctcgtctaccttctcctgtgtgccctccgcacagaaatccgccagattggtaagaccgaccagattctcgttcatgccgccgtaataattgcttccatcccaggttccgtcaattaagctctgcactgccgcggtatagtaggcactccagttccagataacgctgcacaggcaggcctccggcgcattcttgctcatgtcggaattgtacccgatactgtatacgccacgctcctgggcaagtgtctgcggatactccgtatcacagtgctgggcgatcacatcacaatccatatccagaagtgtctttgccgcattctcctccgcctccggatcataccagctgttcgtcaccttgacgtaaaccttcgcgtccggattgaccgaatagataccgagcgcgaacgcatcgattcctcccgtcacctctgaattgctgttatccatggcagccacataaccgatcttgttcgtcgtggtattcattcccgccacaataccgcttaaatagcgcgcctgatagattctgccgaaatagttattgaaattcctgccgttgctcatataaccggttccatgggaaaaataaacatcgggatattcctccgccatctccgctgtcgcctccatgtaaccccagctggtcgcaaagataatgttgcatccctcgtcgatacactcctgaatcgcctgctttgtcgcatcctcgtcggaatctgagacattgattttccgcacaatctgatcgtcggaaagtccgaggttctgctgcattccctgaattcccagatcatgcgtgtatgtgtatccgcttccctctgccgggtctgacagatgaagcaccccgaccttgatctcgtccttcggaattccctccgtcgcggatgctgccgcagccgccgactccgtccctgacgtctgctgcacgctctccgctccggcatttgtagcataatcatcaatctgcgtatctgcaccgcagccggcaagcagaaaacttcccatggctgccgcaatcagtctgatccatttttttctcatatccggtactctctttctgtatgctattatctgccaactttttacatctgcctttattatacacattttttattttgtcatcaataaatttgtaaatttttggaaatgtataagaatgttttctctgaaactttcataggaaagttccactttcacacatgaatgtatcacggtatttcctatgaaataaaaaagccttcacagttctgccgcattttactgccggtggcaaatctgtaaagacttttcaaaatacatattcagttagctcaaaagattctgcatgctctttaagctgataaccagcgtagaggtgttatgcagaagcgctgatgtggtcggctgtaaaacgccgccgactcctagcaggatcaatccggtattgaatccgacaatcacgcggtaattcttgcgaatccgcttcatcaggccgtcgctcaacagctttaaggtcacgatctgatagagatcatccgaacttaccatgatatccgcgatctcacgcgcaatctccgcaccgtctgaaatcgcgatgccgacatccgccgcagagagtgccggggaatcgttgatgccgtctccgaccatgataaccttgcgtccgaccgccttttcacgctcgacaaaaccggctttatcctccggaagcacctcggaataatactcgtccacgccgacacgctttgcgatggcgcttgccgtccgctcgctgtctcccgtcatcatgacgatcttcttgatgccggagcggcgcagggaattgataactgcctccgcctcctcacggagcggatcttcaatacagatcacggctgcaagctgtccctcgatggccagatacagatgggaatactcctccggcaggctctcgaacagttccttcgtaccctcaggaagggcagctccctcatcctcaaatacaaaatgatagcttccaatcacggctttcctgccgttgatcgtggtggaaataccatgtgccaccacatactccaccttggaatgcatttcctcatgatccagacctttttccctggctgcctcaacaaccgcttttgccatggaatgtgggaaatgctcctccatgcaggctgcaatcctaagaagctcatccgggctgtccccgttaaaggaaaccacttttgccacggtcggctttgccttggtcagtgtgccggtcttatcaaagacgattgtatcagcctcagccattgcctctaaatattttccgcccttgaccgtcacattgtaaaaactagcctcacggatcgccgacaatacggagatcggcatggcaagttttaatgcgcaggagaaatccaccatcagaatcgacaacgccttcgtcacattccgagtcagaaggtatgtgagcgccgtgccaccgagggaatacggtaccagacggtccgccagatgctctgcccggctctcaagcccggactttaacttctgggattcctcgatcatctgcacaaccttgtcgtagcggctggagccgcctaccgccttcacgagaatggtaagctccccttcctcgactacagttcctgcatagacataattctcactaatccggcgtaccggctcggattctccggttaaggatgcctgattgaccatcgcctcgccgtctgtcacgacgccgtcaaacgggattacattgcccatatggacaaccacctcgtctccctcacggacttccttcgcgccgacaagaacctccacgccgtccttcttcagccatactttgccgacattcaaggacatggtgcgcgcaaggtcgccgacggacttcttgtgcgtccactcttctaacagctcaccgatgccaagcaggaacatgatcgatcccgccgtctcggtatcaccgcgcagaatagacactccgatcgccgtcgcatcgagtaccggtacttcgatctttcgtgccgccagtgtctttatgcccttccagatgtagcggaacgacttgaccgtcgtccagcacgcccggataggatacggcagaaaaatcttggatgcatagcgtctcaccactctgccgatcagcttctcctggtagcttgcattcagctctcttccggaattctcgatcagcccgttcggcacttccacatcttcatagtgaaaatgtctgagcttgtcaatcagttccgctctgctgccgtcataacagatgactgcgtcacccgtacgctcatacaccttggcgcttgagacctgtatatcattttgtaaaaaatacagaagcgtatccgcctgtgcacaactcatgcggtactgtgccacatgaatccgcatccgccccttaatctcatgcttgattgcaaacttcactttactcgcctcttatcaaaatcttattcttcggtgttctctgcagtctcggtcttctctgctgcttctgcctctgcatctgcaaatgcctctgcctctgccttggctgcgcgctcctcattgatctcctttgcgcctgcatagatgtctccggcattctcctgtacggtgcttacggtgttcatcacgcactcttttgctcttaaaaaagctgcggtacagcttgtgtaaaccttcttggcatccttgctggaaagtactttgataccggctgttccaaataatacgccgcctgcaaaaattcctgtcttcttccaatcgatcttctcaaaacactttaacatacgtatcctccatttctatgcacaatcccgtgcatcctttgctgaacatgttgttcgctctttacattattgtgcattatagtaccgctttttgtatttttccagtattttttcgttattgataaacttcatcattatccaccattttccatcctgctcccggtttttaatacctccgccggatggctgcgttttttccttattataaaccggttcataccggctgcaataaccgatggcatcaaaaacctgtaaagcagcagagatttactcgatccctgccactccttttatttctatatttttctatttctcttccggttcgtccccaagcatctccgtaagcgtgtgccagccgagtaccgcgcatttgacacgcgccggcatgtgtgaaatgtccacaagcgccgatgcctcctcgagttcttctaattcctcgtccgataccgtccctttaatcatccgaaagaacagatccgccaggtgcatggcctcttccttggtctttccgatgaccagatccagcatgatatccacggaagcctgtgagatggcgcagccgtcgcccgtaaaggttccctccgcaatcctgccatcctccacgcgcagctgcagcacaatatcatccccgcagctcggattcacaccctcaagcaccagattcgcatccgcaagcttctccttgtgacccggatagcggttgtgatccgtcagcacctcattataaaatgtccggttattcatatcccatcatcctcctgacttgtgccagctgatccagaaatcgtccgacatcctctggcgtattataaaatgccacgctcgctctggcacaggacgaaatgccaagccattctaacagcggctgggcacagtgatgtcccgcccgcaccgcgacgtgcgcctcatctaagatcgatgcaatatcatgcgggtgtacatcatccacggtaaagctcacaattccgcaatgctccttttcgtccccgcttcccagaatatgcacgcccggaatttttttcattccggcaagcaactgggcggtaagcatctcctcgcgctccgtgatttctttccagccgatgaattccagataatcgatcgcagcggcaagcgcggccgcgcctcccgcattgaccgtccctgcctcaaacttatggggaagttcggcaaatacggctccctctctcgtcacacggtcaatcatctccccgccggtcagaaacggcggcatctcctctaaaagttcctgttttccatagagcacaccgatccccatcggcgccatcagcttgtgtccggaaaatgccagaaaatccgcgtcaagtgccgtgacatcgatcggcatatgcggcgctgcctgtgccgcatccgccagtaccacaccgccgttttcgtgtaccatcccgatcagtttttctgccggggtcgcccgtccaagcacattcgagacaagtgtcagcgcggcaagctttgtgtgcggtgtgacggcatcacggattttctcctccgtaaaactgccgtccggttcacactccagatatttaagcgtggctccggttcgtctggccgccatctgccacggaagcaggttgctgtgatgctccatgatcgtgacaagaatctcatccccaggctttaaccggggcagcgcatagctgtacgccaccaggttgatgccctcggtcgtatttctggtaaaaatgatttctctctcactcttcgcatgtacaaaccgtgcgacgcgctctctcgcatgctcatactgctctgtcgcctccacgcccagctcatagagcccgcgtagcggattggcattccagcgctcatagaattcccgctccgcatcgagcacgcacgccggccgctgttctgtcgccgcgttgtcgaggtaagcgatatcgctttccgcaagcagcggaaaatcctttttataatctgtcatatgcattgctccttcaaataagtgtcaacagcgccgcgcacctcctctgacgggatctggctgtttatcgcttcgatcttcgccagtgtcagaagtctctgtgcctcctccgggggaatgcctctcgtggcggcataaaagagcatgttctcgtccagcttgccgatggaagcgccgtgattgccctccacatcctcctccgcgcacaggattaacgggatggtctggttgaccatattgtcaccaacaagaagcacatcctccttctcgtctcccttagctcccacacagccgtgcacaaaatcgatcgttccgcgcagcagcttcttcgcctcgttctttaagatgcccgatatctgcatattgctcttcgtctttttcccgcggtgcctggcgacataattcatatcaatcttctgcctgccggtgcccagatatccacttacgagctctgccgtgctctcttctccactaagttcaaacagtgttcccgtatagacctcggcgccacccagttccagctgcacttccttcacagcggcatctttttcacacgagacacccacatcatgcaggcagacggcttccgcattcatcgtctgcaccacatacagttctactttcgcgccctctccggcatataccttcgtctggatggcggacatcatcccgcccggctccccgctctcgcagagcaggattacttttgcccggctgtgcgctccggcatagatatgcaggcggttataggcgtgctgcccgctttggtaggaaaaacggtacacatacggttcgccgcagtctgcatgttccggaatcgccaaaagctcggtatcccatgccgcatctgcctccgacggctgatccatcgcctcgcccatcccggttgtgattttatcccaatccgtctgctgtgccatccgcagctgctcagcctctgcctgccctgcttcagccacactctgttttatcgctatactgccgtcgatccgcggcatcccaatcacggtttcattcattttcagccagttccaggtctttgcaggaagccggttgactgtgatcgtctgattctgttttgtcataagctcctcctttacccgatgctgcccttcatctcaagatcaatcagattgttcatctccaccgcatactctaacggcagttcctttgacacgttgcttgcaaaaccactgacaatcatcgaccgcgcttcctcctcgctgatgccgcgggacatcagatagaacacggcgtcatcgctgatgcggccgattttagcctcatgtcccacatccgcgtctcctgtgcggatgtccatcgccggaatcgtatccgatcttgagatgtcatcgagcatcagcgactgacaggaaactgccgatttgctgccggcggcttcctttgtaatgctcacggaactccggaacgtgctgataccgccgtccttggagatcgacttggtgttcatgtacgaggaggtatccggtgcggcatgcaccacctttgccccggtgtccagattctgaccttttccggcaaacgtgatgcctgtgaattccatgtgcgccccttttccctttaagatactcatcggatagagatacgatacatgggagccgaaggagccggacacccactcgatccgtcccccctccttgaccagcgcccgcttggtgttcagattgtacatgtttttcgaccagttctcgatcgtggaatagcgcagtgtcgcgccctcctcgacaaacagttccacacagcccgcatggaggttcgccacattgtattttggtgcggaacagccctcgataaaatgcagatacgcccccttatccacgatgatgagcgtgtgttcaaactgccctgctcccggcgcattgagccggaaataggactgcagcggaatcgtcaccgacacgcccggcggcacatagacaaacgatccgcctgaccagactgctccgtgcagtgcggcaaatttgtgatcgttcggtttgaccagtttcataaagtggctttgcaccatatccgcgtattcgccctttaacgcgctctccatatccgtgtagaccacgccctgggctgccacttcttcccgcacattgtgatacaccagctccgagtcatactgcgccccgacacctgccagcgacttgcgctccgcctgtgggataccgagccgctcaaaggtgttcttgatgtcctgcggcacatccgaccactttgccgtcatctttgtattcggccgcacatacgtcacgatatggctcatatccagcccctcaatcgacggtccccagtccggcaccggcatctcattgtaaatctgcagcgcctgaagccgaaacagttccatccacagcggatcctttttttcacgggagatctgctcgacaatcgcctcggtcagtccctcatcgaccttgtaagcatcccgttcctcatccttcacatcgtatatgctgcggtcaatgtcttctacgtatgtcttctctttcaccgctcatcctctcctttttgtgccagcttctcatactcctcgtaaccttcgcggttgatcttatccaccagcgatgcatccccggatgccacaatatgcccgttcaccatgatatgggttgcgtccacatgaagcgcgtccaggatgcgcgtgctgtgcgtgatgattaaaagtgcgccgtccggattctccttctggtactcgcggattccctcggacgcaagccgcaccgcatccacgtccagcccggagtctgtctcgtctaaaatggcaagatccggttttaacatcatcaactgcaggatctcggatttctttttctcaccgccggaaaatcccacgtttaaatcccgcccggcgtaggagggatccatgtgcagcacttccattgccgcttttaattcttttctgaaattccagacacgcattttatttctgccctgctcgctcaatgcactgcggataaagctctcgagggagagtcccggcacctcgagcggttcctgaaacgacaggaacattcccgccttggcacgcttgtctgccgcctcctccgtgatgtcatttcccttgaaaaggatttttccctctgtgacgctgtatttgggattgccggtcagaacataccccagtgtcgactttcccgcaccattcggtcccatcagcacatgcgtctctcctttttttatcgtaagcccgacctcgtgcaggatcaccttgtcctccacgcgcgccgtaagcccttctacctgtaaaatctgctctgccatagctgcctccgtttctgaagcgttttctgcagccggaatcctctttcacgattccctccgctgcccttttggttttctttgcgacgctcccacacatttttcatatcctagtcgcaaggtaggatatgattcaaccacattctagaacgaaaccgttaagaaagcaagagagaaatcgctccgctattgagattgtttctcattttcacagagggtgtgcgatcgcattccggatagaagcaggcggggaaattggttggagcaaaatccaggaatttcttcccagccgctttttatatccaattccgtgtctttccacgttttgacaatccgcaggatgtgtccgacaagccgcagacaatgagcggactttttagtgttcctaacatcaccgcttcacagacactataaaaccgcgcgaaccgaaactcgttggcatctgctattgaaaatatggcagatgccgactcagacatcggcttcgcgcggttatgttttgttcattggtaatgtaaggaacacacaaaagtccttaaattgtctgtcggcctgcggacacacccgcggagtgctccaaactttgaaaaacacggattatcgcagatgtaaaaagcggcagggttagaaattccgtattttacgatccaaatttccccgcctgctttcatccggaatgtgccggaacgctctcttccgaatctatgcctccgcaaaacgtgcgaatgaaagttccgctccgtttgccacgcggctgcagatattgactgcccggctcatcacatccgaaaactgtccgtcctttgtgacgacaaaaagcatccgctcgtctgctttgatcgagacgtcctccacgtcagcgatttctctcatctcccgctgtacttccctgctctcatcctctgtcagcttttttgataatcgataatatcttcccataatgccatcctttctgatcgttgcatgttcggggttagttatatctaatcctgtttttattatagcactgcgatctgaaatgaaaacggggttgctgataagttttctcattatatccggctctgccgcatcttttttccatattctgcacatactgtgcctgtcgcaatacggattacccggtatatcaataaaaataggagaaatcaacatgggaaataatatggaactcgattacgaaatgttctgctaccagtgtgagcagactgctaaccagaaaggctgcaccaagctcggtgtatgcggaaaaactcccgaagtcgcaaatctgcaggatcttttaatctttcagatcaagggcatcagctgctatgccaggcctctgatcgaaaaaggcactcctatggataaaagtgttgtcagcttcatcgaaaatgcgctgtttaccacacttacgaacgttaattttgacgcggaagtacatgtcgaacttttgcgcgaatcccagcgcatcaaagaagaactccgggcttacgcaggcgctcccagtcagcccacgcttcacgccacctacgatcttccgcagaccaaaaccgagatgctgcgcgacgcgcccatcgccggtatcatgtatgacaagtcgctcgatccggacatccggtccctgcgtcagaccgttctctacggactcaaaggcatcagcgcctacgggcatcaggcgagagagctcggctattacagcgatgaggcggatgatttctatattctcgccctggaagccctcacggacgaccggctgtcggtcgaggaactgatccgccttaccatgcgcaccggtgagatggcaatcgaagtcatgaaaaaactggacgaagccaacacgaccatctatcagaacccagccccgcaaaaagtcaatgtccacctgaaaaaaggtccgtttatcatcgtctccgggcacgatttaaaagaccttgaaatgcttttaaagcagacggagggaaccggcatccatatctacacccacggagagatgcttccctgtcacggttatccggggctgaacaaatatccgcacctcgccgggaatttcggcggtgcctggcaggatcagcagaaacagttcgacaatcttcccggctgtattctcatgaccaccaactgcctgatgcgcccgcgcgactcctacaaagaccgcatctacagcacaaatgtggtcggctgggacggtgtgaagcacattggcaaaaacgagaacggcgaaaaggattttagcgccatcatagagcaggcactggaactcggcggctatcccgaagaccaggacgtacaggaaatcctcgtcggcttcggtcaccacgccacactgggctatgctgatgcgatcgtggatgccgtaaaatccggaaaactgcgccatttcttcctcatcggcggttgcgacggagcgcgccccggacgcaactattacaccgaattcgccgagatggttccacaggactgcctcattatgaccctcgcctgcggcaagtaccgcttcaacaagctggacttcggggaggtggcgggtcttccgaggctcctcgacatcggacagtgcaacgatgtctactctgccatccgcattgccactgctctcgccgatgcatttggcacggatgtcaacggtcttccgctctcgctaattatttcctggtatgaacagaaagccgtcgctgatcttctcgctctgttaagtctcggcatccatgacatttatctcggtcccactctgcccgcctttttgagtccgaatgtcctgcagtacctgacagacacgttccacttaaaatccatcagcaacgccagggacgacatccgcacctgcctcggacaggcagtctgatttccgcagctttaaccgggttgttgaattatattctgattatatactatatccttctgtcactacagcgtctctccctccatgtagcgatgaggtaaaatccgctgactgtctcctgtcatctgctccacttccgggtcagcgtctatcatggcaaaaagcatctcaacggcactttttgccacctcatccaccacattggagatcgtggaaagctgcggtgtcacatatgccagcgtatcgatattgtcaaatccggtaatgccgtaatccaccggcgcctttctttttgcccgcttctgatccttcatgatctcaagtgcatactcatctgcggtacagacaaacgccgtccgctttccttcttttaatatggcatccactttctgcaggtaatcccaggagagaatacactccggccggagagcgggatagcgtttcatctcttcctcataccccagcagacgctccttgtgaacatacagattctgccggttttttgtatctaacggcgggcagacaaacacgatgcactcatagcccttctctgccgctctctgcactgcctcccgcactgctgcccgctggtcgatcccaacaaacgggatgccgtccgcaatccggttatccacagagacaatcgggcggtgcagggactccaggaatgtccggtacgcctccccctcgttgaccgaggagaggatgatcccgtcaacccgataatccgcaagtcttgtcagctgctcgcgctccgtcccggcatccccgccgtgcagcgtaatgttgacgccgtagccgcgggcatatgcctccgtgctgatcgtcgagagcatctgggcaaaatagcggttcttcacgtccagcacgacgacaccgatgttgtacgtctgtcccttagccagtccggtggcaaggagatccggccggtagccgtgttcctttgccacctgaaggatcatctcctttgtctccggcttaatccgcccggttccatttaatgcccggtgtatcgttgttctggaaacgccgcataactgcgccagatcttttgtcgtgatcgccatattttcctgctccccgttttctttcttttcaaaaaactttcttctattttaatcgaatctgaaccatttgaaaagagagaggtacaagttccactgaaatttcgtttccgctgcaggaggcgttttccagttccacaggtgttacacaatcatgttccttttgatttgtcgctttcttatcctcgtgaaacagtgcaatactttttaaaaccgcctccgtctccatgccctgtaaagaaacggtcacctcggcactctcctccatgcggtttacaaaaaaggcggtcacttcccgcttctgatcgtcatagacgagcacatgatccacacagggtaccgtctcaaacgtgctgcacgcgtagatgtctcccatataccgtgtatctaacgtcacgccgtgcgcatactgcgccatcagggcaaacggataatacaccggctgcacccacacaccgccgtccttctctgtcataatgcaggagctgatattcgtaagaagcgactggcaggcgatcttcacacgatccgcccgttttatgaaattcatcagcatacttgcaaacagaagcgcatcctccatggtatagatctgctcgctgatcgcaggtgccgtctgccacggtgcatcctccaccgatttctgcacctgcacgtcgctcatcgaccagacgccccactcatcaaaacagatgttgatcttatgtgacattttcttttttaccctcacatagtcgcagatgtttaagaccgtctcgatatagcgctccatatccagcgactgtgccagaaactctgccgtgcccttctcctgtcccccgtaatactggtgcagggaaatgtaatcgaggcagggataacaatgttccagtacggtctgctcccagtcaccgaacgtcgaattcgtggacatcgaacttccgcacgctaccagctcgatggatggatctaagattttcatcgcctttccagtctcataggcgatcctgccgtattcctccgccgtcttatgcccaatctgccagtctccgtccatctcattgcccagacaccaggtccggatgccgtacggcttttcatgtccatttgccgcccggagatcactgtagtatgtgccggtctccatattacaatattccagcaccgcaagcgcttcctcgattcccttggttccaagattcactgcatagatcggtgcaacctctgccgcgtccgcccacttcataaattcatccagaccgacctcgtttgtctcaatacttttccacgccagatcccgcttcctcgggcgtttctccacaggtccgatcccgtcccgccagtcatagttggagacaaaattgcccccgggatagcgcaccgccgtgacccccatctgccttaccttctgcagcacatcgctccggaatccgttttcatctgcagtcttatgcgacggctcgtagatgccggtgtacaccactcttcccatgtgctccacgaaggagccgtagatacggtcgtcaatcctgccttttgtaaatgccgtatcagctttaattgtcacatgtctcatcttctctctcctctgcctctattctttcattcccgatgttgcgattccttccatgaaaaacttctgtccgaacaaaaacagcagtaacagcggcagaatcgcaattaccgtagcagcaagtgtcggaccatatttgatcgaattacttccaaccagaattgcaagtcctgctgacagcgtccgcatttccactgaacttgtcagcatcatcggatagagcagatcgttccagttattcatgaaatgatagattcccagtgtcacaagtgccggctttgcaagcggcagaatgattttcagatatattttccactctcccataccatcaattttcgcagcctcatccagcgatttcggtatgcccgagaagaaggatgtcagcatgaaaataccgtaggcactcgctgcgcgtggtagaatcagtcctaagaacgtatttaaaattccaagcttatattcttccatatagagtggaatcatcaccacctgaaacggaatcatcatcgtgagcaggatgattccaaagagcagttttcttcctgtaaatttcattcgggcaaatgcatatgctgccatagaatcaaaaaacagactgatgatggtgacaccccctgcgaacacaaccgtgttaagcagcattctggcaatcgggagcactttccacacataggcaaactgtgttgtgacccactctgtcgggaaaaagattggcggccacttgatgacgtccgcatccgacttgaaggcggatacgccgagccagaacagtggaagcagcaccagcgctgcaaacaacagaagtaccaatgttccgatcacccgctgcgcacttatttttctcatgtctcatcacctccctgggggaaagcatattttcttaagatcacggttataatcgcaatcatgcagaacaaataaacggcgattgctgacgcatatccgagatcatacggcgctgtctgaaatccccggttgtagatataacccacgagcgtctcggtcgcgtactgcgggccgcctcccgtcatgacgtagatctgatcgaatacctgcagcgccataattaacgtcgtcaccacgcaaaaaccgatcgtatcccgtataccgggtattgtgacatagaaaaatttctgcagcccggtcgcgccgtcaatctccgccgcctcatataacgactcagagacgccgagcgccgccgccgaaaggatggtaagcgtatatccgaaccctttccacaccgtaacaaaaatcaccgtaggcatcgcccatgtcatacttgagagcatgtttggcatcgtgataccgatttttccaagcagatatggcagcattccgtagtgcgtattgagcagcatcgaccacatgatgctgactgccgtcatagaacacacatagggcaggtaaaatacggttctcaaaagcttgtgcagttttgtattgcgcagcataaacatgagcagcagcaacgccacgatcatctggaggggcacctcaagcagtgcgaaataaaatgtatgaaacgtagcatttgccacacgctcatcctgaaacattttgatgtagttggcgattccggcgaacgagatatttttcatataaatatcaatattcatcagactgatcccgatcgctcccgccagcggtataaatacaaatacggtaagtatgagcagggaaggcgcgataaacgcatacgccttcacctgatgctccatacggtgttgtctcttttttactttcataatttccatcctttacggcttgcagctatttttgcgtcagtgaccgtcagacatcagtcggagatcaccgcgtccagcgcgtccgaagcctcctgtacactctgcgtcacgtctgccccggataaaattttctccatcatcggtttcatgacatcgttgtcaatcatgcttccgcattccagtcccagatgccagtcacgtccgatctcggatgccttggatactgcacttaagatctcgttgttctgaatgtccgcatcctcaagaacagagtaagaccataccgggaagccgttccggttcgaccactcttttaacacatcatcagacagccagtatgccataaatttatacactgcctctttggtctgttcgtcggcccctttcgtcaacatgtaagagcatccgccctccggggagtacgcgccgtcgcttccgcccgggatcgccgtgattccataattcaaaccaagctgtgtcaacccgttgatgttccatggaccgctggtatacattgcaagctggccggactggaacatcgtgtccgcatccgctgcggtgagtccctccggggataccccatcctccgtcgcaagcttctgaatccactccagggttgcaatattttcttcggaatttaaaaggttctgtgttgcatcctcattgatgacatctccgccgttcgcccacaggtactcgcagtaataaccgtaatcggtcggaagtcccagtccatactgattattagacggatcggtgcaggcgatcgccgcctcgcgcagttcatcgagcgtggtcggcgggttctccggatcaagacctgcctccgtgaaaagatccttgttgtaatacagatactgcacattgtactgcattggtacgccgtagagcgcatcgtctatgtaggattttgcaagtacattttcatagaaattactcttgtcaatacccatcgtatcccagaaatcgctgatatcctcgatcagtccattctcctcatattgatgaagatactcaatgcccaccagcacaaacgacggtcccgtccctgtcgataccgccgtcgcaaattttgtctgcaaggtatcattgtccataatatcaatctgcaccgtaatattgtccgtattggtttcattgtagttgtcgatgatttcacgcagcacatctccgtctgatccggtaaatggtgcccacacagtcaatgtgattccttctcccgcagcacttccgctgtctttttctgtctttgctgcctctgttgccgtgcctgcactcccctgtgcatccgctgtctggctgtctgctgctgtgctgccgcaccctgcaaacatggtcgctgccattgtcattgccagtaatcccgccattgctcttcttttcatgttatcctccattctgcagacactttgtgtcgaggcaaccgcagatgcaacctctgatttgcacgggcaatgaatctgcacccgtaacgtgtcttccatctcgtttgctctgcgataagggctcattttgtggtgtctgccgcatcaaacagccctgtgcaaaatgcagtatcatccgcatttttgcactacttcctccccatacattgtttcgttgtgattttttctgttttgcgtacacgtgtacatttttgtgtaaaaatatcgtccgcgtatttgcggacgcgtgtactcaaaacactatttattatagcaacagcatagtttctgtcaattatatatttttcatgtatttggtctataaattttgtgaaatattactgatacggaacgctcacaaatcgccagacacttctacgctcccctgacatcctcccgcacctcataatacccctgtggataatggcaggcaggacaaaccttaggcgcactggttccgaccacaatatgcccgcagttccggcactcccacactttcacgctgcttttctcaaacaccgcctgtacctgcacatcccgcaggagctcccggtaccgctcttcatgcattttctcaatcgcgccaaccatgcgaaatcgcgctgcaagcgccgcaaagccttcctgctccgccgtttttgcaaaatcctcatacatgtctgtccactcatagttctccccgtgggctgcggcatccagattctttcccgtatcgccgatcagtcccagttcctcgccccacatctgcgcatgtgcgcgctcgttatccgccgtcttctcaaaaatcgcggcaatctgctcatagccttctttttttgcgatctccgcaaaaaaagtatagctgtttctcgcctgcgactcccctgcaaatgctgctttcaaattcttttccgtctgtgttcctgcatacttgttcatagaatcctccattttttcacacaatctcttgttctaactctttgctccaacttctggcttcaacttattgttcttgccttgccttattacgccagtatgcccgatccatcaaaatttatttatcctgccggtaaccttttgacggcttttttctattcccacaaacctgttcttcaaatatttctggggtcttccctgcctgcatagcaatgtgcgtgtctgacacggctttttttctctctcagacccgcaagagctgatttttttgcgttatgtaaacttattttcctcctgttcgggtctgattcgtgaaaatcaactttccagacccgttttttctgctttttcgggtctggcacagctttttcttcctcccagacccgcaagagctgatttttcgggtctttttccctcttgcaatggcattttcgggtccacaagtcttttttccttctgtagacccgcagtagacagacaagctcctccatatttccattgacccgaaaaaagcaaaaaacaggtcatctatcaaactggaaaaatgcatccaatagactggaaaaaaaattgcacctggcaggcagaaaaaacagccggcgcattctgcgccggctgtccgtacatttcccatttcaaagttttattttttctgcagacttcttttctttctgcactgtggctgtctgcactgccgccacgccaagtccaaaaaagatccgatatcccgatccggctcactccctaagatcagcgcttcacattgaaggccgccatgccgggatataccgcagcatcgcccagctcctcctcgatgcgcagaagctggttgtattttgccacacgctcggttctgctcggtgcgccggtcttgatctggcaggtgtttaatgccaccgcaagatctgcgatcgtcgtgtcctccgtctcgccggagcggtgggaggaaattgccgtatagcctgccttatgtgccatcttgattgcctccagtgtctctgacacagagccgatctgatttaatttaatcaggattgcatttccgcagccactgtcaattcccttcttgagacgctcggtgttcgttacaaaaagatcgtcgccgacaagctgcaccttatcgcccagctccttcgtcagcttctgccagccttcccagtcctcctcatccaacgcatcctcgatggaaatgatcggatacttctccaccagctgcttccagtgctcaatcagctcctcggaagtaaactttgtacctgccttcggcaatatgtactcacccttctttgtgcctttccactcggaggaagccgcatccatggcaatcatgaaatctttgcccggctcatagcccgcatttttcactgcctgtaaaatgtactcgatcgcctcttcatcgctggcaagatccggtgcaaaaccaccctcatcgccgacggaggttgcaaggcctttgctctttaacagggctgccagtgcatggaatacctctgcacaccagcggagcgcctcttcgaagcttgccgcgccgaccggcataatcatgaactcctgcacatccaccgtattggctgcatgcgcgccgccatttaaaatattcatcatcggaaccggaagtctgttgccggagattccgccaaggaaacggtacagcgggatatccagcgcgatcgccgccgctcttgccgctgcaattgataccgcaaggatggcatttgcgccaagctttgacttgtcctttgttccatccgcagcaatcattgccgcatccagcgcgtaaatatcgctcgcatccatgccacagatcgtatcgctgatgatcgtattgatattttctactgcctttgtgacaccctttccaaggtacctcgctttatctccatcacgaagctccagtgcctcaaactctcccgtcgaagcgcctgacggtgccatgcctcttcccacggtgccatccgcaagtgtgacctccgcctcaacggtaggattgcctctggaatccagtatctctcttccgattaccttttcaatctccaaaaaattcatgcttcgttctccttccctctcgccatccggactccgtcttccggaaaacacaccggaaggcgttcgttacataggatggaacgcgtcccggtgcagctgttttccggcaggaaacggattcagcagctccgcacctgtaagaagtcctaaaatgatttacactatagttagtcgcacctaactgtcgtcattataacggttggagaaaaagattgcaaccccggatgatgatactttttctcattgcggattctccgccggataagaacgccctttccttactgctccgtcgtgcgtcatcatctgccagccttccgcacgctctctcgcctcgataaatctgcgataggttccctcttttttaagcagctcctgatgcgtgccgcactcagcgatcctgccgtctgccaccacaaggatctggtcggcattctcgattgtcgccagccggtgcgcgatcgtgatgatcgtcttgcctctggtcaattccgatagggccgcctggatcagatgctcgttctccggatcgacgctcgctgtcgcctcatccagaatgatgatcggcgcgtcctttaacatcgcgcgtgcgatggaaagccgctgcttctgccctccggaaagcgtgtcgccgccctctccgatcatcgtgtcatagccctgcggcagttccataatgaaatcatggcactgtgccgcgcgcgctgcggtgatcatctcctcctcggtggcatccggttttccaaaacagatattggcgcggatggtatcgtggaacagatacacattctgaaataccatcgccatactggacagcaggctgtcgcaggtaaattccctgacgtcgtgtccgcccaccgtgatgctgccgctgttcacatcgtaaaaacgcgcgagcaggttgcagattgtcgtcttgccggaaccgctcggtcccacaatcgccgtcgtcgtgtgctccggaatccgaaagcttactccctttaagatcgttcggctgtcatacccaaagctcacatctgaaaatgcaatatcataatttgtaagcggaatatccgttccgttctcatcgataaaatgatcctgctttaattcgtcaagctgatccatcgcctcgtcgatcacaccgaggacatgcgcgctgtcgctgatcggctctaagctgctaaaaattccaaaagagaaaaagacaaacatcagcatcaccgggaactccatctctccccggaagccgagaaaacacgcctctgccgccagcgccaccgacgcgcattttagggcgagcagatgcagacagtttgcaggcgtaaagccccactcaatggcgaggcggatgtccctgctgtcgcggcacgccttttgcatcgcctccatggacgccccactcttgccaaacgacttcaccacggagattccgcgcgcatactcgagcaccgccccggcaagatttcttcccgcctccgcctcagcaggcgcatgcttcacgctgtgcttcgacaccagaagcagacacagaaacgacgcaaacgcacctgccagcgcaatcagagacaccaccgggttaaaaaacagcagaaacagaaagatacacaaaaagttcagatagccgcccacaaaattgtcaatcatgcggattcccatgctctctaacgttcccagccccgttgtgatggaatttaaaatatttcccgtattcatctgcgcaaaatagccgagcgacacgcgttttagggcatctccgaccgccagtctgtcccttgcgatcagctcataactgattgcctcctggcaccgcgcccgcagatagtcaaacaagaaccgcagaaagacaaacactcccatgataacaagactcttccagatccacgcgcggtcaaatgtcccggcgccgcgcccggcatctaagagcattccgatggtgtacgctgccaccatgaccggcattgccgcgaaccagtaggaaaagaacgagaaaataaaacccagatataattttcctttaaattccccgcaccagtcgatgatgcgcttcactgtcttaaacataggacacatcctcctttctgccctgggataccgcccagtgctttgccccgatatgaagcttccacatcttctgatacagcgggcagttcacaagcagtttctcctgtgttccctttgccagaatctctcctgcctgcagcacgacaatctgatccgccgtctgaatcgtcgacagccggtgcgcaatcacaagcagcgtctttccttttgtgagcgccgcaatgctctgctgcagtttttcctcgttctccggatccgtaaatgctgtcgcctcatccagaatcacaatcggcgcattttttaacatcatgcgcgcgatcgccacgcgctgcttctcaccgccggagagccgctttcctgcctcccccgccggcgtgtcataaccctgcggcagtttcaggataaactcctcgcactgcgccgcgcgcgccgccgctttcacttcctcgtccgacgctgccggattgccgagccggatattttccagtatcgagcagcggaacaggaaattatcctgcgtcacaaagctgacatgctccgcgagctgtcccaccggaatcctgcggatatccacaccgccgatgcagattgtcccctccgtcacatcccagaaacgcgcaatcagtttcgccacggtggattttccgcctccggacggccccacaagcgccgtataacttccctccgggagtgtcagatcaatgccgtgcagcacttcgtcctttttctccccgctgtaggaaaaatgcacgtttttcagctcgacatcgtgatgttttatcgtagtcttgcactccggttccggaagatttggcatggtgaggtaggcatccagctgttctaccgtcatcttcatctgacgggtattttcagaaaatacttcgagctttgccagcgatccgaccatcgacatcgaaagcatcactgcaagcgccgcctgtgcaccggtaatgctgccacggtccgccagatacaggctgaccggaagcgtcccgagcagtgtggacgggaacagggcaaatgccagcttcatcgtcacccatgtggaggaaagccacttcaccacaaacgttctgaaatccgtgattgccttcgcatatttttcataggacacacccgcgcgtccaaacgccttgatgacctcgattccctctatgtattccacgatggcgctgttcatgcgctcgttcgatgcattgtagatctcaaagctttttccgctgatgacaaacgtgagcaccatgcacaccatagcgggcggcagcgtcacaagcgaggcaagcgtcagccgccagtccagtaccgcaagcgccgccagactgaccaccggaagcaccagatgtccggctccctccgggatcatgtgagcgagcggcggctccatattctcgatcttgtctaccatgaccgctttgatctccccgatcgagtgcgcctgcacttccccgagcggggcacgcaaaaaccggtctgccacgcgaagtctgagctgctctaaaatgtgataggcaaccgagtgcgccagtcccgtggaccatccgaagcagagaatttttaccgcataaaaagcgagcgccgcaagacaccagtatgcaatcacactctccgtcaccgtcccgttcacaaatgcctcaatgacgcggtacaggcagaaatacggcagaatccccgccacgatgctgaccactgaaagcagcacggaaagtgccagttttcctcttctcccctccgtgtaggagaacacaatcgaaagccatccttttttttctgttttatctactttttccacataaatctcctttctctgatgccgccgggtgccgcagttctcctgccaggtccgccatttccatgtccacgtccccggcatctccccggcatccgtctttaccggattgcgttccggtactccaccggcgacatctgcatcactctcttaaatgccatggcaaatttgctcgggctgtcgtagccgaccatccccgcaatctctgccacatttttctccctgtcctcccgaagcagcaccgccgcacggttcatgcggtattttaacagccagtccccgatcgaagtcccgtacacggacttaaaacactgtttcatcccggtctgcggaatgtcaaaccgctccgacagttcccgctgggtgatgttctcatccatgtgctctgtcagataacgttcaatcgccttgactttctccacctgcgtccggtaaaagtacgccggttcgtcgatgcgccggggaagctccgccgcctccagaaacagcaaaagttccatcacttttaacttgaaatacggaattctgatctgctccggaaccgcataaagttcactgaaaatatgctcgactgccggatgtccgtgcagcactctcggatattttccctcgcagaatttccggcagatggccgcagcgctcaccgggaaccccttcatctgcgcggcaagtccagcatccgcggtttccagatcaaaacagatcatggctccgtggtaatgtgccagcggaaattcaaaatgtcccgtgtgcgtcaggcggcggtccagctttaaatctcctgcctccacataggcgtaggcatcctcatccgccacatactgcatccgcccctccctgcaatgatcgatacaaaaaacatgcttctgcggcacaaattccgaatcaaaataatccatatgaaaatcattgaacccgagcatgacacccgggaacagttcatacatcgcaatcgttccctcgccggtggcattttccatccgaaagacactgcatccttcgctcttcgccagacacttcatctgctcctcattccggtaagtctccatcgtccctctcctttttaccgtgtgcagcatggctgccctctgcgccagaacaggaataccataacaaacagcaactcataaaatacgccctgcccgggattcctcataaataaagctccggtttcacaccttcgcacctattcatcaaacggaataccccagacagggcgctctatccagacattcttttcctcctcttctggttagttctttctaacacatttttatcctaacggagaacggagaaaaaatctgtcccatttcgtcgtttttgttccgattggacaacatcatgtccggatgtcttaatctatcctttttcttacttttcgtgacgaaatgcggaaaaaagtcccttcttttcataaggttctctcgtcacagttcccatctcatagccggtcttgtcaatgacttcctttaactttgcatcatcgatgtcctgttcggtcagaatgactgtctccccttttgcatgggaagaggtcaccttcttcaccggaaacgcagccctcactgcctcattcacatgtgcctcgcacattccgcactgcatgccatccacttttaccacaattttttccattgctgttcttcctccgtattacttctgtctgcatatatcctctatcagctccacccattccttcggatgtactgcaagaagctcctcatgctgcatgtccagttcatgcagtaccgggtgcgcaaaatgcctgtgatagcgcgcccggtatttttctcccatctttaaggcatataaaatgtggatctcggtgcccgccggatcgatcgcatccggcagcggcgtaatcagatccgaataaaactgattgcgcaggctctcctttgtgataaaggagagatccacaccggcgccgcgcatcatgccaataaacgcatccacatatccgtctcccgccttgcgccacttctccagcttacggtttaaaaacggaagccggaatctgccggtcgtaagaaacggataaatcatcggcagcatcagggctgtcatcagcttcgccggcagttttgcagactgatccagatccgaaccgccgagaatgccataatccatatgaatcactccgcgtgctgccataagtccaacgaatgacccgccgagtgagcagccgtacgccgcacagattttcccgtcatagtgtttcttaatatattcctcgatcttcgccgtctcctcgatcatcgtgggaaactgcgtctgttccgtttcgtcaaatccgtcgtaagagacgcacgccacccggaatgtctccgccagcggctcgatcacctttccaaagttgctgcgccagtaacagccggttcccggcaaaagcatgagaaccggctttccctgctctccaaattcatatactttcatctgttcccactcctgtctctatggtatatttttcggaatcttttctatcgttttcataccagacagacataaagccatccgcccggtctgtaaaagtatcagcccagcgccacatcgagcatcatcatgacgctgaatcccactgcaaagaatatcgtaccgacatccgagtgctctccctgcgacatctccggaatcagttcctctacgaccacatagagcattgctcccgccgcaaaactgagcagatacggcagtgccgggacaatcagtcccgccgccagaatcgtgaggatcgccccgatcggctccacaatccccgagagcacgcctcctaagaatgccttcggctttccggttccctccgcccgaagcggcatggaaataatcgccccctccgggaaattctgaattgcgattccaagtgacagcgccatcgcggccgccgcggaaatctgggtgttgcccaccagataccccgcatacacgacgccgaccgccatgccttccgggatattatgtagtgtgacggcaagcacaagcatcgtcgtgcgcttcagctggctcctcggtccctccgccctctggctgttacggtgcagatgcgggataatatggtcgagcagaagaagaaacaggatcccaagccagaaccctgcgactgccggcacaaacgccagctttcccatatcgccaacctgctccatcgccggaatcaaaagactccagatcgacgccgccaccatcacacctgcggcaaatcccgtcagcatacgctgtagtcggtctcccatctcctttttcataaaaaacacacacgccgcaccgaacgatgttccaagaaacggtatcaatattccgtaaaatacactccagttcatttgcaagcctccttttcagttagcttttactaaccttattttatcaatcacttcctatttgtcaagcctcccgccagttccggcgcaaaatgtgcggcaaaaaaaatttccatgatacaaaaacggacactgaatcttcttcagtgtcctcccatcacttctaacctgcacattcctggtacagcgtcttttgtccggtcccgccgaagatatccataatatccgccattcccactccgtaggaaagcagcagtaccagattttctttcgcgtactcaaaccgctggaatagctgctgcttctgttccaggttctcatataccttccagtacccggtgcagagataatctcttccctgatgctcgataaaccctctcacatcctccaccggatagcctaaaagcagtcccatctcatgagggaaatccctgcgctcctgcatgtatctgcggtaacgcatccggaaaacaggaagcaccgcctccaaggaagtatcctgatatcccagtttatgcagcatccttttcacctgttcctgttccatgtattcttccaggctttctcttcggtataagagcacagccgcttttctgccggttgaaaaaagcacatacatggatattccggtatcccggatcagctcccgaacctgacatactccctcacacggaatattgaacagattcgacggctttaagcctgcaattaacggcgcacactgcagtgcaagctgcaattccacatctttgggctccatctgctgcaaaatctcccatgtctcacgactcatgccgatccctcctgtgtcatacaatcttttgagttagtccattctaactatctgtatgatatacgacagcgggcatcttgtcaagaatcaaaagaattgtcgcaataagcatagactgcttttgtgtgataagtaatattattagagagcacatattaaaaaatgaatatcttgattatgagatggataatgctgttacctttttcagtgaaaactacaatcaaaatatcaatattgatgattatgctgcctcacgaggcatgagtgtcagctggtttatccgaaatttcaaaaaatataccggttctacaccaatgcaattcattgtgggaatccgcatcaacaatgctcagatgttacttgaaacaacaacttattccatcaatgagatttctaagattgtcggatatgataaccagctttatttcagtcggctttttcacaagttgaaaggatattcgccgagagaataccgaaagctgagaaacaaattctgaaatcccacgatgtggtcttctttctgataatattacttatcaaagcaaagcacgatatgcttattgcgcctgttacgggagcagtccctgctcctgcatctcacgcgccaccttcacatattcccggctgttgcggtaaatatcttttttctccgcttccgtcagctgccgcacgaccttcgccgggcttccgagcaccagcgatccatccggcacccgggtgtgctttgtgacaaggcttcccgccccgacgatacagtcacagccaatctccgctccatccaggatcgtcgccgccatcccgatcagcgtccggtcgccgaccgtgcatccgtggacaaccgcctgatgcccgatggtcacattgtcaccaatcaccacatcgccctcaatgctcgcatgaatcgtacagctttcctgaatgtttgtctctcttccgatcgtgatggttccctcatccccgcgcacggtggagtaaaacagcacacagctgtcctccccgatcgtcacgtctccgaccaccatcgcctcgcgtgcaatccgcacaccggggaggtctgtaatccgcttatagttcattttcccacactccttataccagctccgcattgaatttctgcgcatttacacggtaaaaatcatcccccacgctgtcgataacgtggtaagccgccgtggaatccatcatctcgaagatcacactctccccgctgcaaagctccggaatatcaaaatccacctgttccggtacggcggtgccaagcgtggacattacctgctccactttccgcacctgcaatgcatccgcctcaattttaagacagatatactggttcttcgcaaaggacgccaacaccagaaccggataattataatctacggacggatgctccatgccggttttttcatttatcattgtacctcccggcacatattttaccagatagcagtgctttgccgtctttatcgtctcttccgtttcaatctgtgcaagctccggattaaagatcgcaatcgcgccgtccggcgcatactcctgatctgtcacaagctttttattgatatagcagtcgctgatcagcgcatagtgtccattgtagagagagataattccgagtttcggagaagcccccacatagcgcgcctcctccgcttccagatattccgcaagcggcagtgtctttgaaacaatcttttttgtcactgcggtcaccgccaccggagcggttgactttttctccggatacggatgtccggcaccgatcttcacatccttcgcgcatgtcttgccatgcagggtatacggggtatataaaacctcgtaataataacttttggtattcagcttcggcatcgtctcacagtcaatgtctgtctgcttgaaatagacggttccctccttgtcctccagatgggcttccagttcttcctccggtacaataaaaccgaaccctgcactgaccggctgcttgatcatgtattttacgatataaccgcgcagtctctccggtttggattgttcctgcttctcctctgcaatgacagtcttctctgagatcagagcgacatccttcgccgcgcaaagcttgccctttaaagtctgctcaagcgtaaatgaaaccctgcgccccagaaccagctgcgacgcctcaccggcatctgtgagattattgacatggaaccagtattccccggaaatatagccggtgccgttatccgtgcggtaagccgtaatgggtccaaaataccgcacctgcgcgatatcgccggtctgcagcaccgtctcctctgcgccatcgtctcccgtaagaagcgtcagtttttcatccgtatattccttcagctttccgacagttctctctccatttgagagcagcacttccacgtcctgtcccacaaacttctttgcataaaaaacagagaccggcagcatctttacctcgccgttcccatcaatccacactttcgcataatccgcataaggatacatcttctccagcgttacactgaccgcttcctgcaccacctcaccaggttctttggcgcaggtgtaggaaaccacgtagatattgcccggtttgaatccaaagtcaatctgctcctgtgaaaacatgatatttccgcgcggcaatccggcattctccatcttcgcataattctgtgagacatagcagttcccgataaagccgttcgtccggagtgcattcgggaaaaataaaatgattccccttcctgtataccccgcttccgccggttcttcctttcctgccgcatccaccagccggacatccttggcaatccattcacaatccgtaattccaggcacgaaggagacctgatctccaacgccgatctgcgctgctccggaatgttccggcactctgcaccagaaaccatcttctgcatcccggcttcctactgcgatcttccacgtatccgtcttcccccggctgcccggttcccgcacacgcaccactttcccgcagtaacggatttcctgcatatcggcaaacggaatcatggccacgccctcgccgatcaatacgaacatggtgtccgtcacagccgacacgacaccctcccgacagctcccgtccttcatggtaacatgcagtgaatcgttggtctccggaagcgggaaaatctccttcaccccggcaaaatcgaccggaacctgtccgctgcctgactgctccagcatcccggttccgtcctgctgcaatctgccgaccaaaaatgttccatcaaaaaaactgtaaattgctgccgtccggcttaatttttccgcgcagatcttgtgtgtgtgcgataccagccggatgtcatccgcgcagatctttccggatgcaagcttcagatgacaggacacggtacacgcaaaatctccataccgcatgagttccagttccgcagcatcacggcaggcttccggcgcaaatgtaaaattcccgatcattccggtatcacgcatcacatcataatctgtcagttcccctgccagccggatatccgccacatccgaaagcatgatctccctgccctctacagtgatcgtctccgccgtgatgttttgcagaatgccttccgccctgctgtcatctttcagcgtcacttcgacccggtttaataaatagatcccgctctctctgaccgttatatcttcacccatacaagctactccttctactatccgtcatgtatttatggtattacagcacccgcgcttttgcaaggaattctttccgcgcaaaccgcccggagattcacggtgctcgtcaaatctgcatacagtcatacaatataaataatgtctttctgcatttcataatctcccggcggattcatgcaactttctgtaccatggttgtatttattccggctgctctgtattctgaaacttcgggtctacagccgataaaatacgccgtgagacccgttttctggaatattttgatcattttttctatctgctggagcgttctcgggtctacagcctacaaaatacgccgtgagacccggaattttacaatttccgggtctcacggcgtattttttgcttccagtgcccaaaagccatggatttatccctctttttctctcttatcaagcggttttggggtctcacgcagctatttttcctctgtagacccgcgccagccttctccaggctttctcacaaacgttttctgcaataaaaaatatgccacgacacattttcgcaccaagcgcggtcgcctgcggcatgtctctccttcgcgcaagtgcgcatcctgcccggagggctaaaagcaccttgtcaagcgtcttcctgtaccgtaatattccgcacccagatatattttttataatgtaagtacacagcaggaatcttcacaatctcgtcgaggttcacgatacagtacaccaccatgaccggccatttcagcacaaatgccgcaaagaagccaaacggcacggaaaagcaccacatcgccccgagattccccttcatgtcgaacttggaatcccctccggcacaaaagatgccgtccagcaccgtcgtgttgactgactgcgccataatgttgcagccgcagaagatcagcatgtactgcagatactccgccgccgtatcactgagcggtgcaaaacgcacgatcaaaggagagatcagcatcagaagaccgccggtggtcatgccgaccacaatcgccatgcgcgtcagtctgccgccgtacacttttgccttgtccagttctccggcaccgagcagatttccgatcagcacgcccgcaccgccgctgacgccgcggatcaggcacgataacatattcttggcgatcgtggtgatggaatttgccgccaccgcgtcgcttcccatgtgtcccataatcacagagtaggacacgtaggcgattccccagacgagtgcagcgccgagcaccggcatggtataacgccagaaatcttttgtcagaacggcatccgccgcatggaacattttcttccagatgatctgcacacgcccggactgcttcgtctccagataactccaaacgagctccaccagacgggcggcaaccgtcgcgtaagccgctccctgtattcctaacgcaggaagcccaaacagcccgtagatcaagatcgcattgcagataatattcacgacgaccgctgtacagctgatccgtgaactgaccgtggcatagccggtatttttcagcaaaatcaggtaaatctgtgaaataccgcacagcagatatgacagggacaccgcgcgcagatagaccgctccgctctcaattaacgcaggatcggacgtaaaaatgcgcatgagcacctcgggtgccaccgccgcaaacacggtgaacgcaccgctgaatatgagattggtgcgcagtgcaatcggcatgacctcctcaatggaagccgcgtcctttttcccccaatactgtgctgccatgattcccgaaccggcagagataccgctgataaacagatttaagacaaactggatctgccctgccagagacactgccgacagggaggtctggctgaccgccccaagcataatggcgtccgtggcgctgactagcgccagcataaactgctgcatcgtgatcggcagcaccagaagctttaatttctggtagaattcatcgtggaaattgatttttgcaaacataattttcatcctttacatgtataactcatgagattttatcatctatgccttgccgccgtcaatttcctttcttgcctttttttcagtcagattccggatttttttacatatcctgcactttttacatattcgatcttttcactacggtcttttcaccgtccactcgtacgttccggcaggcacattctcacttcttccatccggaagaagcactaccgcctccaccggcgttgcaagccggatatggcagccgtccggttcgtaccgccatgcgctctcgatcttccctgccacggaaagatagcttccggatacgcctcccaggcgctcgtccggataaggtgcaaaatgcagttttgcaaagcccggtttttccggtctgattcctaggatatattgatagtaaaactcccccacactgccgaatgcgtaatggttaaaggataccatattttcaccggagcccgccattttctcctcgttgacggttccgtccggctttaaggcatcccagcgctcccatgttgtcgtcgcgccacattttacctggtacatccaccccgggcagttctcctgcagtaatacatcataggcaagcttctgctctcccgcctccaccagaagcggcagtagatgctccgtcgcaaaaaatcccgtctgcagcccgtttttacggatgttggcaacaaagtttttcctgacccgttcccgcagctcgccctccggcagtacatattttaacgccataatataggcagactgataatccttcgccacgattccgtttttactcacgaattttttgatataagcgtccgtcgtcgcggcaagctgtctgcggtaccgcgccgcatcttctcgctttccaagccgttctgccgtctcgctgatgacctttaaatcatgcacgatgaacgcgtttgacaccggattgttgtgcatcgcctgccatgcgattccttttcccatcgcgagccagtcgcctagggacggaccaatccagagatttttcttccccatcttgcggatctccgcctccacaaaaagcttcatgctctcatactggcgcggcagtgcctcctcgtccccgaactgacggtacatcatctccggcagaatcgtgaccgcattgccccagcccagcatgctgataaatccgatcccggcaggtcctgtctgcggcaccgtggcgcacacatatccctcggtgttgtcaagctgccccagctccagatcccttagaaaatttttccagaacgcatccgtattaaaattataagcccctgtcagtgcaaacacctgaccgtccccggtatagcccatgcgctcatcccgctgcgggcagtcggtcggcacttccacatagttggatttctgtccccagacctggttctcatagagcttctgcaccagcggattttcgcaggaaaaatatccggtacgcttcatctctgtgtgaagtgcgtatgccctgatcatccccggctgatatgccgcaccggaaagttccatataacgaaatcccatataagtaaagcgcgggcggtattttttcttctccgcacctgcatggtagacgatcgtcgcctttgctttgcgcagatttgcggtgtacaggctgccgtcggcatttaagatctccccgtgccggatcgtaattgtctcatttttcaaaaaagaaggatctatttctacaattccggcaaaattctgcccaaaatcaaggatcgtcacatctccctgcaccattgtctcccgcaccgacatctcatcctgcaggcgcacctccgtaagtgtcggctccagtgcgaacggcgtctcctttgtgtaggcggccgcatgaccggtcacgttctctcttccgtctgcaaaataaatctcaccatcgtactctcctgcatattcatacggagattccagttcctccaccgtctcatcggagacgatctttctgcttcccgccgcatcctccagttccagaatccatgcgaccgccggctgctctccgtatatctgcgtctgattttcacagagaaaacgcccgcagtaccacccctgtccgagatagaccgtcagcgtattttccccttcccgcaacagcttcgtaacctcgtgtgtctgatagagcacacgtctcggatagtaggaaaatcccggcgcaaacatctgcctcccgatcttcgtgccgtttaattctgcttcatacacgccgagggctgtgccgtaaaacacggcttttttgacctgtgaagctgtaaatttctgccggtatacaaaaacctcgccctcccggtattctttttctgaagtgatccactgttttcttaattcttccatctgcatttccatccttgttctgccatctcccgctctgtcagatccgtgcgtttaaaaactgtgcgcttacctccagcgaccgtagtggagaattgtccacccagtttttatggctttctaaaatcacggcatccacattcacgttctttgcctgtgcaatgaatgcatccagactcatattgccgcagccaagctccatgctgtccgattttaagatcggcgtcatggcaggcttcaaaagccgcgtgccgcggtcattgatatgatagagtttcattctcgtgtccagttttttcatcagggcgagcgcgtccacgcccgcctccgtcggccagtaggaatccagctcaaagttgacatattccggatctgtctccgaaaggagcagatcatacgccgttttctgcggctcaacgtgcagaaattcacagttatgattgtggtacaaaagctcaatgcccgcctctttcaaaatttttccggaggtattcagatcccggcacagcccctgcaccgcggctttatccgcgtaatcaaagcggtacattcccgtgatgacaacatattttgtgccgaaggcttctgcctcttttgcaaccgtctccggctcccgtctgatcgttccaagatcttcgtgaatactcgtcacgcaaagtcccgcttcttttacgagtgcattccagtcatagctgccgccttttccgaccggcatccccgccgccttcgtgagcatccgcaccagaaaagaggtcggtttcaccataaaaccgttcagttcgattccgtcgtagcctgccgccttgatccgccgcagcgtctctgccgtctgcttttcatttttcgttactgttccaagcatgatctgctgtactgcttttttcatccctctgcgctccttacttcctattccttagttcttcggaattttctgcaatgcgtcgtttaacgctttcatctgcgcctcgctcacagcgtctcccgcctgctttaagagacttgccagtgtcatgcgctgcatcatccgctgcaatgccgggttgtccttcacgctctccgccacatcgccgcggcttgcggaagcctgtgccatcaggctctgcacaatggcgtttgccatctcatttttcgccagttcccccagtgtatcggaaatcgaatagtgatcggctttaaaatcctctttgtcaaaccagttgaccacgtcgccctgcttgttgaaaatgtaatccggattcggtgtgtccacttttctcactgtaatctcatcggtgcagtccccggacactgcccggatcgtgtgcgttcccgtaatcggcacccggaatctgaagatgcgtgcaccttctttcgtctctttctctgctccgtccacaaagagcgagaccttcttctggttggagtacactttgatctccgtcacatcctctgcacggtccgtgtacctgctgccgcagagatgcacaaatggggctttgctccagtatgccttgtatacatagaacgcatcctttttgatcctgcggtccatcgtcacaagccctttctggttctcgccgtgcttgccaccctcgtcgcgcccgtccgcagcgaaatcaaacagattccatacatgcgttgcccacagatacgggcgctcctcaatcatttttgccatatgctcgtggtaaacgcactgatattcctccgtgtaatcgccccgctccggattcgcactgtggtacgccggattcgcgtccgcgccgtattcggagagtccgatcacccggtcggggtaagtgctgtgatattcgtcaaaaaagctgtcgttctgatccagttccccgatgtaccagccaaagtagagattgtagctgttcatatccggtatctccagcatcgggctgtccgtctctaacataaagacatccgccataaccgtcggacgcgtcttatccagttcatgacacagatcatttaatctacggtgattctccagcagttcttcgttcaccgcgcttgctgccgtgatctcattagaaagtccccagcagacaatcgacggatgatgatagttctgcacgatcagctccttcatctggcttaacgtattttcggtgccgtccgtcatgtgcatcgtgatatacggaatttccgcccacacaatgattccgttctcatcgcagagatcgtagaactcctgcgcgtgctgataatgtgccaggcggatcgtgttggcaccaagctctcttacaatcgccatatcctcccggtgcatttcgtatgtcagcgcattgcccgcgcccgcgcggtcctggtgacggctcacgccgcgcagcggataggatcgtccgtttaagaaaaagccctccctgggatccactttaaagctgcggcagccaaacgtccgctccacgacatcgccgcccggaagttctgcttttgccgtatacagatacgggtcatccacaccgtcccagagatgcacatttttaagcgcaaacacggcttttgcataaccgttttccacgggaaccgtctgtgtctctcccgccacggtgaccgtcacgtccggtgcttcccccgtcatccacagttccaccgtcacgtctgcgtccgcctgtttctctgcggcgtccagaatcgtcacctccggcgtcactttcatgccgtttccgcctgcatagtccatcacaaaatgcactttaggcaccgtcaccagctttaccatgcggtacagcccgccgtaaaaagtaaaatcggctttctgcggatacacctttgtgttgtcagagttatccacatatacttctaacagattgtcctctgtcaactgctccgtcacatctacccggaatgtagagaatccgccctcgtggtggaacagcttcgttccgttgaccacaacatccgccgtcatcgctgcgccgttaaattccagatacgctcttcctcccttttccagttccggttttgcaaaatgacgcacatatttgcaggttccgcgataataatcgtttccgccgtcctgcccgtcaatcgcgttccaggtgtgcgggagcgtcaccgcttccccgctttcactctgtggatttttataaaatgtccagtctttttccagcactattgtatttctcatctattccgttttccctctcttttcttctctctatttcatttcctcaatcactttttccacttctgcctgttttttctcctgaatgctcttctgtacttcctccatcttctctttggagagcggcgtctcgcgcattgcgcagagcgtacatacccagccaatcagcgggagtccgaaatacatgctgatcgtcatccagaagattgccggtgtagacgggtcggtcggctgtggcatcgtgtgcctgtagccgatcaatgccaccagaccggttgcaatcgctgcagaaaacgaggatactaacttgtcaataaagctgtatgtacctgtcactgctgccggaatgaatttaccgctgcggtctaattcgtaatcaatgatgtccgccatcatcgcattgcttgacatcgtcacgcacatttttgcaccatttaacaccagggtcaataatacatatacaatcatcattggaagcgtcgtcgcaatcagggtcggatcaatgaaaataaacaataccacaagcaccgccgccacggtgatgcacacatacgtccacgtcaccatcgcctctttatttccgtgctttcctgcatatttcgctccgataaacgcgaagatgatcgaaggaagcataccgattacacttaagattgtcccaagctgcatattgccgataataattccgaacagcatcgtcgtcacaaccgcctggcttgccgtctggctcgcaatcttatccgaacttgccgcaacgatgaacgtctgtagcgcacgattggatttgaccagctcccacatatcttttacttttaccggctcagccttcttcttgctcgtcacgcccacaaaattttccggtttatcgatatccgataccgcgatgcagcagagaagtaatcccacacccgatactgccacgcagacgatgcaggatgctgcaagcatctctaccgaatagacatttccatattttggaagcaatatcaccataatcacgatgttaagaatcatcggcaccagatagttataagctgtactccagacgcctaccatcgggcgctgcttcgggtcgttcgtaagcatcgccggaacgatctgcgctgtgacgttgcacatcgtatagccgatcacatacaggcagtagagcagcacgaacagcacgattccatgtccctttccactcgcccagcagtacatgatcaggactgccagtgactcgatcagccatcctgccaccatcagaatcctgatctttccgaaccgcgtgttcatcttatcgatgatgatcgcaatgatcggatctgtgacgccgtccaagattcttgttgcagtcaggataatgcctaccaccgctgttgcaatgccatacccttcgtttgccacatagcttgccagtccaagcagcacataaaaacacattccaatcccagaactgcatcctgcaagcgctaccctccatgtctttgcacggcggtagacaatgccgtttgtctccacagactgttcttttttctttccaaacatttttataccctccagacttttccatattttgccgcttccgtatgtctgctatatctgcggcctctgtttttctatggctttattctagccggtctttttcctttctgtgtttacaaattcgttgttatgtactaaaattcatgttataaaatgatgtattgctatttttctaacattttcacgattttgtaaactccgggttttataaaatcttatatagtaacatcagattacaagagatgcacaggaaaaatacggctgacgctgtattttttcactgcagaatggaggattttatgagattaccggaacattttttgatcggggctgccacagccgcccatcaggtagaagggaacaacatccgcagcgacttatgggcgatggagcacatgaagcacaccagctttttggagccgtccttagacgcggtcgatcactaccaccgctatgaggaagatattaagcttctgtccgacgccggcttaaacgcctatcgtttttcgatcgaatgggcgcgcatcgagccggaggaaggcgtgtttgatgcaggggccgtcgcacattaccacgacgtcatcacctgctgcaaaaaatacggtgtggaaccgtttgttaccctgcatcatttttccagcccgaaatggctgatgaccaaaggcggatgggaagcttcgactacacctgccgactttgcccgctatgttcattatattatggaagaactcggcagcgaactgcactatgtatgcaccatcaacgaggcaaatatgggcattcaggtcgccgcaatcgccgagcgctacaagcggcagatgatggcgcagatgcaggcagcacagacagcgccaaggagcggcgacagcgcggacggtacggtgcaggtcggcatcaatcttgagaaaatgatggaaaatcaaaaggcaaccgcccttgaaaatatggaagtcttcggcgtggaaaaagtagaaaactttacctccatgcgcaccagagagggcgatcttctcatcatgaaagcacatgagctcgccagaaaagaaatcaaagcgctctatccggacattaaagtcggtctgaccttaagcctgcacgacattcagccgcaggcgggtggcgaggcgcgcgcagcctctgagtgggatgaagaatttttacactatctcccttatattaaggaggatgatttcttaggcgtgcagaattatacccgctccctaatcggtccggacggtcagcttccgaatccggagggtgccgaactgacccagatgaattatgagttttacccggaagctttagagcatgttctgcgcagggtggcagaagattttcacggtgacctgtatgtcactgaaaacggaattgcaacttccgatgacaccaggcgcgtcgcttttatcgatgccgcacttaacggcgtcgctgcctgcatccgcgatggtctcccggtaaaaagttattttcactggagtctccttgataattttgaatggcagaaaggctactcgatgacttttggactgattgcggtcgaccgcagcacacagacaagacatccgaaggaaagcctgcgtttcctcggaagctggaaccgctaaagaaaggaatacccgcatggacatcaaagaacgtctctctttttttcaggaaatggttcaatgtgaatacccgcttcatctctggcactacagcccggagtttgagctgatcgagacagactgtccggcagaactcatgctgccggacattatctccatgctgggtttttcctctctcgtactcgcacatatagaatccgggaaccgcatgccgctgattttggacaccgagttcggacttctctggatcgccggttttgagtatcagggctttgcgctgcagcagatccacatcgtcggtcctgcttttaccggaagcaactcacatctggttctgcgtaaaaagctggattcctaccagcttaccgtcaagctgcgctctaaaattgtaaagcagatcgagagtgtgccgatcattccgtcttccgtgctgctctcctacgccatcatgtttcactgcgccattaccggcgagcggatcaccgcggatctgatctcttttacctcacacagcacgacaagcgttccggatgactcgccgcttctctccggggagcatccgggcatctggatggcggaacagacatttctctccatgatccgcgagggaaatccggaatacaaaaaggctcttgcaaaatccatgaccttaagctccggcgtcaaggccgagatcggcgattcactccgcatgagcaaaaataatctgctggtgctcctaaccctgtgcagccgcgctgcgatcgatggcgggctgaatccctccatcgcatacaccctaaacgattactatgccgggcgcatcgaggaatgtaaaacgactgccgacacgaccaatttaagccgcgaatttctcgatgattacgtccaccgtgtccgcgccgcaaaggagacgaatgcacattccaggcagattcagaacatctgcgactacatcagtctgcacatccgcgaaccgctctcgatctctctgctctccgaacggctcggctacacggaatattatttttcccacaagttcaaggaagtgaccggcgagagcgtgaatgcttatatccgccgaaaaaaaatagaagaagcaaagcttcttctatcgggtacccgcatgagtattcaggacatcagcgatgaactgtccttcggcagccgcagtttctttttctccagctttcagaaggagaccggcatgtcaccgacggcataccgcggggagcactgtaaggggtgaggggaatgctccttatcccatccaatgttgctctatcgtctgctctaattccataaacatgtcataatacttattttttgtctgatcgataatatcctttgcgatcacttcattgtatgcataagccacattatttcttgagacaagtgcctcaagccaaagttcctcgttatttatcattccggccttatatgcggtttttaaaattgttctcggagatccggtcgctccttctgaatatccgtaattttccagaatctctttcattgccttccatgcctgctcaaagcagatctcatataatgcaaccattcctgctatttccacattaccatacggttcctggtaagcgtaaatatcttttagattgtttaatgcggatttaaaattctcatattttttcatacaacaaaaccccttcccgcctgattgcctccaacagttctttttgaaccggtttatccagatcaatcacatcaaattccagcagagtcgatgtttcctcatcaacatcaaatataaaatgacaactgttaccgccacgaaacgccagatcaatatcacttcgctctttgaaatcccctcttgctctcgaaccaaaaagaatcactttctctacctgattttccttagccagttgaattatttcctgtattacctgctctttaattccggttttttgagataatcgttcttctgccataataatcccccgcaaaatcatcctgtagaattggtgatattatatcatctttttgcgctgccttctgcgcatctgaaattcctgcgcttcggcaaatagttcctttaaaacagtcagcacacaaaagatcccactctcccgcgaaaaccgactcccttacaggagacgaaatacctgttccactgaatcggtgagattctccatggctttttcccgctgcatggcctcctctaacgtgcacacccctcgcacgatcgggaaaaatgcgtcaatgccgttgtcattgcacgcagccgcttcttttgtgaccgaacccgcaaatgcaatcactttacagccgtacttcttggccgccctcgcaacccccatgggcgcttttcccattgcggtctgaaagtccagccgtccctctccggtgagcacaatctgcgctttcttcgcctcctcctcaaaatggatcacgtctaatatcagctcgattcccggaaccagtctcgccccaagataactgataaaggcatatcccatgccgccggctgctcccgcgccctcccggtctgcatagtcaacgccaatccgctcggcagtgatcgcggcgtaatgcttcatatccgcatcgatacgcggcatttcctcttcccgtatgcccttctgctttccataaatataggtcgcccctttttctccgcagagcggattcgtgacatcacatgcaatctgaaaatcacattctttcagttccggcatcagatgttccagtgaaacgaaatgtatttttccaagcgcatccgctccctctcctgcttcctctccatccttggtcagaaacttcacaccgagtgccctaagcattccgattccaccgtcatttgttgcgcttccgccgattccgatgatgaatttgcggcagccacgcgaaacggcatcccgtatcatctcgcccactccataggtggtggcttttcccggatttctctgcgcctcctccacgagcgtaatacccgcggcctgcgccatctccataaccgcagtcttttcatccgcaagaattccgtagtaagcttccacccggcttcccatcggtcccgtcacagacagttccactttccttccgcccagcccctctatcagggcatcggttgtgccttctcctccgtctgccagtgggcggaccgtcacattggcatgcggatagacgcgcaacaccccgtcacgcgccgcattgcccgcttccatggaagtcatactccccttaaacgaatcgctcaaaaccattacatccatttttttctccttacaggcatgcagcggacgcactttgcaatgctcactctgcaatgccatattttttcatttttctccacagtgttgccgtgctgattctcagttcttccgcgatcttctgtctgcttctgttatttttgagaagtgtgtgcatatgaaattcactgacatatccataatcacgtctgtttcaaccgtgaaactatcttatacaccaaagaatactgtcaattttcttaatgcttgatattcctttataatcaggcagcacccggtcaaattcactaatacattctcttcccttttccgtttccaaaaaatcggcataccacttttccatatcagcatagagcagaattgccttcttcaatttttcttccttcgttactcctgtcagctgcatgttcagattttgaacaacgtagcggtcccatatcggtttctctggaagtattgttgcaagcattttaccggaaaaggacggctcaatatttcctgtacttttataaagatatgcaataatactttcaaatgtcggcttaccatttttaacactctcaaaatactcataataggattttctccaacacttatttcgtcttactatataaaagctgttgaatattcgttgaaaatcagtgtcgactgcaacattggtaatactcacttgctccattaatataccggtatttatcaagtcccatgcttgatgccaagcgttcttggaatacttcactaacattaaaattcatatccatcatcttatccatccttttctctaagatacgcttcacatcgccgcctaccacttcgattttctccaccagctgcacttgtgtcacaccattccgatacaatttacttttacatccgcttctatattgtttttaatcatattcgccgttccaatttatatcttctgttagttctgacacaaacaagataatttattgtaccacacattacctcatattcattcactatatctccgactttaattgattaaaagcctcatcaacagatacagaatcgttcttttttgcctgtgcaagcccggtctgcaccatcgtatcaaattcagcttgtgttatagaatctcttgtaacaagtttatccggaatatctagtgaaaatggtactccatcacgcataataacctgtctgtaagtcatatctatgaatacagatacaggaattccaagtctgtcaagaattgcctctgcctgctcttttatattcggttgaattcgtgctgttacatttgcagtttttgttgccatagtatgcacctcctgtttcttatagtgtaccaccatgtattgctttttacaatacaatcttttaactgctgccgtcaatctttttccatccaattcaatgcgctctgtgcaataacatcatcataaaaatcagcatccgaatcagcattatcatccgtatctgcctgcatctttgcctgttctcttaatttccacatctctatcgttgactctggattgcctggcttgtgattattcatatactgattcataatcacatccagcatttcatacgcctgctcatttatctccctcttctgacagataggataattccacaccaattgtaaatgctatctttccctcatccaccatagcaagtatcttagggatgagattcgtcagccggatatatctttttatctgtgctacacttcaccgacctgtcttgcaagaagctcgttaaggtcataagaaacgctctgaagaccaccgctgatggcattgacgaacagctaaggaaactccagaaggagtttctcaaaaaagctaacaacaaggcagcctacgatgaaattgccgcccaaattttcaagctccgtgagcagcgtgaagaatgcactgttgacaccgccactagagacgcacagattgcaagattacatcaaaaaacagccagccttgcgaaactattccttttttcaaaaaatctgtaaatattctgtgataaccatatctcttcatgattatttgctccttccttagtcctgaaatgtgtactttttgaaactacaaaaaaaggactgctaaacagtcccgaaatgtatggatattcctttacggaacgtcccggtatttgtgtatgctttttggcaccacctccttaaaaatgggtataaaaaaagaaggtgtatttcaaccttcttctctgaaatgacactactctccttaattttcatcataagtgaggctaagtcaatacttacaaactttgaacctattcaaatttattaagttagcagttcaacatcattcctactagttgatgcaatttcttgtaaatctcgtaagcagttctatagtcctctgatattaaacaatgattaacattatccgcatccaaaatatatacttctattttatcaatacctgaattaaacgccttttttatcctgtgatttccattaatcacaaatggttgaacaaacatatcattcaccaaaacaatgataggattatcttccttgctctttcgtaaagtatcattcatttttatatactttatatccatatccgattcaactcgacagcacttacaaattacttgcgtgtctacactttgtgattctatagaattctgtaatatgaactcataaacttgatttacattatattctaaacaatctgaactccaaacttcttcatttaacattaactctgtttgctccgattcatctaataaaaattgtaaatcacataaagattgtactaacttcaataccttccgttttttaaaaaaaggaagcttctttttatgtattgccgacacaatatcctttttatactgtttttttcgttctatatcattaacataattttcatgctcataacacattgttgctaaatatctctgcataccaacctcccaaagctaaatcagcttgaaatgcctcaacgcatcctttatatactccaccttctcctgcggacactgctttacttctggattctctttcttagacttattataattctcgcccatgtccagaccacacatcctctttacctgtgcaatataagaagtatgcacattcacaccatacttgtccttcacatattccttaatctttgaataagtagccttttcttgtggtgtgtaattactctcttcatcaggctccattgtaacctcaattttcggtgtatcttttttgagggataatttgacaaccgtctccacatgcggtgaaagttacttcttatactaaatagcgaaaccgtcaccttttacgaaaaggtttataccccatttagggggatagcatttaccccttctaaatatcaacattccgtcattttatagacacaaacattttataccattcgcttgaaatgctcagaagtgaagtgtaaatgtatcccgttaattttacaccattttaattgcattcttaacctgaactttatcaacaactttttgatatacatccactccacaatccggagccatttcaaatgttgcaaatagtgcatatggtatcaacatttcaggattattctctgatgcacatcctcgacaattaacttttaattctatggatttatcaatatcccatacctctatactatcattttcaaatatttcatgctgaagagtacctctttgtacagcatgataatcatattccgctctagaaccaatcaagctatttccattatttattgttacccaaacttgtttctctctatatttaatagaggaaggatgtataggggataaatatgcaagcgttactgttaattttctctttaaactcttctcatgaaattcaataggtatcggtattgaataaataaacgctttatcttgggcgatatctccaaatccgataagcgtcacttgctcttttgtacattccttaactctttcaacatcaggctccccatatcccaaatatctatgtaatgcattctttgcactattaccagatatacctaagataccttgaaacaatcgatcccagccattccaagatgctccatgagcaagcattgcctttatcaatacagcaacatattcattaggaactcccattcccgtttctttcataaaaatctcatctaacacagcataacattcctgcgctttattggtaacaagagctgttgcatcactggttccaaacgaaaacgctttatttacaattgctcccgtagttaatcctggtgctgctgaagaaatgcccggtgcccttgttgaactttccctccatctaaccacacctctatgcatataatcttcatgaacaaaatttcttccaccaggaaagaaaatatctggtttaattgcattattaatcccacttccaaacgaaccataaacagcaggtatattatcagaacacaactttgctaaaggaccaattggattttcatcgttattatcggtaaaagttgctcctaccgtcaaagcattcatactttctgccggagacaacaaacgtctatttcgaatgtcctgatctatgaatttaattattattccatctttatcctcatcacttaatttcttaaaatcattaaaatccaatcctgtatcaattgcctctggatgattccccgcactcactataaataaaactctatatttataactcaaccaatctaacaatcgtgccaaagggctaataatattatagaattctctataacgtattccgattgatagattaataattcgaacattcgaagccacttgtccagcttctggttcgaataatctacgaacagcttcatggattttgtctactaataaaaaatcatctggaatatattccgtaactttattattccaagtctccggtttcataataggacgtacatatacttttcttatttcgtcctcaatagtagacatatcctgtcctcgtaaaataagtgatgccatggcagtcccatgaacacgctcacgtacctcataaaaactttcaaatccatccgggtcatcgaccatcaacattccttttaacagaggatgattggcttgaggaacaccatcaaacaaagcaataataggctcctcgataacatttgttgggacactaaaactatttgaatccgaaaagttattattatcacttgaaaacaccgcttgaacacatggttttagaaacataattggttcagctattacaagtgctacttcctctctatctataattttttgagcatattcacgaggaatagtagctaaaatggcatgatactcaatctctggtatgaccgaacaactaagaatttctcctcccgtttgaataacaatattttttatattgccttctacttcttgacgctttgaaattgatgaacggaagaataattcaatttgaacctttaccttttccaacgatgcatcttgcaattcttcttcccatatctctattaatcccgtatcctccaacctttcctgaattccccatttatgcacatcatacaatgttctgaacaattgcttgaaaccagtcattcctttaggaaacttaaaattttcatcagcttgataatgattccatagcgatatgatttcattcaatgccacttgattcgtcatgatgcaaaataatttcgttgttagtttttttgaatcatcacgagctgcctgactatccataacataaaaatcatctgaattattcaaattagaatccgataactccattaaccattcaactgtaggatactcctctttcaatttattaaccgctttgtaaaaatcacgtggatctcctactgtctcaaatactaatgtatattctggatcaacgcctgtggcataattagtaaaatataaatttccgctatttattgtattctgaagcacattaaactgaggggtcaatcttgatacctgtcgtgaatgtgatggaagaaaatactttgatgcaccaccatatcttctttccttatcagcaactgttggagctgcaaacaacactaatggtctttctgacattactcatccctccttatttttcttctgtctgatatccacaaaggcgaagctgcatattagtaatattttttgctttagcactcggtccattcaaaatatattgacgaaaaacagataacgcaaactcctctgcctccgcatagctttttccatataatttttttgccaaagtacttggtgcaagtccaaaggaaaaattcatacgcttttcaaatagcacaaaccacttttctaaattggctcgtgtcggttttggtaattccaatttcatttggaatcttctccaaacagcttgatctaataaagcatcatggttagttgctgctattgcaacaacataacttggcaatgaatcaatttgcaaaagaagtgagctgacgactctttttatttcacctgtctcgtgctgatctcctcgttcttttccaattgtatcaaattcatcaaaaaacaacacacattgcctcgtactagcatattcaaataattttgagagccttgatgcagtttctcccaaatatgctccaataattgtatcatatcttacagtaataagtggcaccataagagcttcagcaattgcctccgctaaagatgtcttgccatttccagggggacctataagcaaaattttgtttcttggttccaacccataagatctaagcaaatccgccctcatctgttcttcaataatcgctctacatgtttcaacaacattatccggaagtaaaagctgctctaatcttttttctggcattttttcttcaaataaatgctttggaatactattaatactgtttatagtgtgcatattcgtattcctcggagtaggaattgtctgttctggattttcctttagaagctgctctattttattcgctaatatctcatgttgttttgttcgttcttcggcacagattgcttgcgttgctctacggaaagtcatatcatcttttcgcaatcctgccttaattaattcgcatagtaaatctgctctggccattttacatcctccaatcaagttttataaataaacaagaaaatcgtcaaagctttttcaattcattaacatcaataaaattgctttcacaaaattcataaaaagaatttttagctagttgactcggttcatttcttgaattttcccacctattaatggtagcaaaacttactcccagagcattcgctaattttttctgactcatttctaattgtattcttacatttttaacctgattcgcaaacatacaatcctcctattatcacactatacaatatataacatttgttatacttaagtcaatagatatagacatattcacttgtttttttgcccaaatcaccattttgacattacgttcaaacattttattcattttttgcaaaacaaaaagccgatcaggaatcgcaactcccaatcggcatcttttcttactcctcttcatttttacattcaatctccgttccgtccaaaaacatcaccaacaatgttccatcctcaaaaaccttgatgtggtccagcgttttcagcatgaagtccgtatccatctccgtcaaaggttctgccccatcggtgtactctatgaacttctctgctcgataaccttccaataggttctcgctctgaagctgctccgtccactgctccatgaaatcctctctgttctccaccagtgcgttccaagccatcagataagcctttatcaatgtttcttcctctacatggcggttggcacatcccatgactcctttgaccttgtatcgttcactgcattgccataccttacggtcaacgcccgtgctgctccgccagcctttccgtgcaaacaccttattacagtctccgcaaattatcttggatgcaaatggattgctttccggccggtgggaataggagtttgtcccatgctcctccagatactttttcctgcgttttatttcaagctgtacacattcccatatccgctttgaaatgatggcatcatggtcatcctccacataaaacatctggatttcccctttgttctgtgtacgtttcttggtgaggaaatccaccgtataacttttctgcagcaaggcatcacccttgtatttttcattttccaacatactcattaaggttgtggactgccacttcgtaccgccatcccagtttttcacaccttcctgttcaaaaatcctcttgatgtgatcggttgtttttccgtccaggaattcctgatacaaccgaattacaatcggctcctgtgtcctgttgattaccagcttccccgtttcatccgtatcgtatccaagaaaacgctttgtactcattttgtgttttcctgtttcaaaccttctgcggattccccatgtgcagttctctgaaatggaccggctctcatcctgtgccagtgaggaaagaatggtcagcagcacttcgccctttgcatcgagggtattgatattttccttttcaaaaataatccctatccccaaatctttcaactctcgcacatagctcaaacaatccagcgtatttcttgcaaatcgggaaatggacttagtaataatcatgtctattttccctgccctgcaatcagcaatcatacggttgaattcatctctctttttggtattggttcccgaaattccttcatccgcataagtccctgcatattcatagagaggattctcgctgatataatttgtgtaataattgacctgattctcatagcttaataactgttcttcttggtcggttgacactcggcagtacgctgccatcttcaatttctgcactgactgtgctgttcctgattccgcagtcaaaatctgctttgctggtataacagtaatgcttcttgccatttttaaccacctcctcaatcactgtctgttccgtaatgttcaagccttgcaattcggcatcatcaatccttatccctttacatgccttgactcctttttcaatgtaggtactgcaaagccattggattttcttcttgtaaacctgtctgcgccggagtgtttttccgcagtaagggcaaatcagcattccgcttaagggatagcggttttggaacttcattgtgctgtcctgcccgatattcctgtcacgctttctctgttccctgacttcctgcaccttttcccatacctccggcgatacaattggttcgtgattttccgaaatgtaataactctgcacttctccgttgtttttccttgtatggtttcttttgttttcaggggtgtaatacttctgcagatgaaaatcccctttgtacttttcattgcaaagcatcccattgatggtcccgctctcccatgttgttcccgtcactgttttcacgcccaggtaatcaagcagctccccaatccttgacgagccgacattcagcagataaaggtcaaaagtcagactgacaatttccgcttcctttcggttcacaatcaaatcaccatattcgtttttgtcataaccgaggaagcgggatgtggtaatcatcacttcccctctctcaaacttcttccgaatggaccatttattgttttcactcatgcttctgctttcttcctgtgcaaaagaagcgaggacggcaagcatcatctcaccgtcccctgatagagtgttaatgttctgttcttcaaaaaaataccgacacacagttctttcagttcccttgcaaactttagaacggtgacggtatttcttgcaaaccttgatatggattttgtaataattaaatcaatctctcctgcccttgccttttccatcattctctggaactgtgggcggttctcacaatagccggatatgccctgatcagcaaatactccgataaattcatattccggatttccggtaatcattctctcataggtttccatctggttttcaagagagtcttcctgtcttctgctgtctgtggaaactctggcataagcacaaacccttttcttttgtaagaccgaagctggtcgtttgttaatcacttttactcgcacgttacatcacttccttcaaaaaaccttttcttaaactcctgaatccttcggaaaatggcctgtgcatcctctaccttatcaatgcacactacttccacatttttcttactgcaaatcagcatgaactccataaactgtccccagttacgggcaatcgtggcagccctcatggtaaccaccacatctatcttctttgctgcgatttccgctttcagacgattaaattcttttctgttcgggtcggctcctgaagcttcctcaaagaatatctgcaaatcccatttctgttttccatattcttcttccaaccgcctcattacatcgtccagatatttttcatagtctctatcacgatggttgactctgcagtaaaaagccaccctatttatcgttcctgcaatcaccatattaaagaactacaaaacacacgtccattttctttccttaatgtccaacaaaccgcaggaaatcaaggtttctttgaaagcagacaaatggtttcaatattcccctgaactttgattttatactgcatagcgaaagtgacactattaacttaagggtggggtaaataccttaaccatttgaaaattccttttaatgttactactttaccctgtcctcggcaggatcaactgcataccaatgttctgcatttcgcttacattctaacacaggtattctttttgtcacttcacgtttcgtgcttccatcactacgaagaatttctctccattccactggtttattataatatttcattttgcccccacattgagggcatccttcaatatgtattttctctatggtcaatctattcccataaccactaattgcaaaattgaaaaacaaaggatgtctcgtttgctttttagcaattcttctaagtgtaaaaaagattaaaaataaaaatacaaatattataaaaataatagaatatttctgcatatctaaacttattgtatttccattcatccctctaaaaaagcaaactatactttttactattttggcaaacggaaatattcctacaattgcaataatagtgctaatccatgttaaaacagctaaagtaaatggactacgccattttggttctggatcataatttgccgttttttgcttctcttccgagatattattgataatatctcctgctgcaatttgagtttttcctgtaaaattcacatttccattgaaattattttgcttatactcttcttttcttcttctcatatcgtcatcttccttctcttttgcgaaaaagtattccttttgccaaaatgtatactgataattccgaaaatcttatccctgaggtaaatcaattccctcatacccattctgcggaaactgaaacacacatccatttttgccccaaatcggcggaaacctttgatttacggggcttttctcgtcagcagagccactgtttcaacggtactttcgttgtcccaacaaagttcctgtgtctccctgtctccaaaatacaccggaaaacagaactttatgtgcttcaggaatctgccatctggctgctcctgctcgtaaatgtccacctgttccacaaagctgttaagaaattctttcttctccaggtcggtgaacttatcatatagtttatcaaaatataaaagaaattgatagacgttttcttctgatattttctgttgctgaatattcagcaggcggttcttgacttcctctatactgttctccacgccttcaatctcatcatacaaacggtataaccttgtctccatatcctgatatttcttctcataaaatttatccatgatatccagattgtccatctgctgtccaagtcttgcttttgctccggtcagctgcctgtgctgcttttccaatccttcaatctctttttctatttcttctgtatcaattcttgaaccgattttattcagaattgcttcttcaaatttaggattcttcaccagcttccgaataacttcttccactgcattgttaatcttctcctcactccattgtttacgatatccacatttatgaccatctaccaggcgacgatgtttgcaggcataatagaaataatccttatataaagttccgtctttctttttctttcggttcacgtttccatacataccacttccacataacgggcatctcaatattccagataaaatatgctcatgatcgagactatgtgtcttttcatatttcacacctgttttttcccgtttttgatgtgccagctcccaatctgtttctgaaataatcccttcgtggataccatcatgcagcatataattttcctgttttacaatgcgatattcatttcttgtaccagaaactttctcgttttttcttcgtccataagccagctttccacagtataccggattatccagaacgccttttataaaggaagaggcaaatgcgtccagtgtattattctgtcgttttttctttttatatccatgctggttcagccatgcagcaatcgcagagattcccatatttgtatgaataaatttgtcataaatcagacgaataatctccgcttcgtcctctgcaatctgtaattctccatttactaattcataaccatatggagcgaatcctccgttccattttccttccctggctttctgcttacgtccttccattgtctgaacaaggatattctctcgttcaatctctgccaccgcagacagaacagaaatcatcagctttccactatcttttgagctgtcaattccatcttctacacaaatcagattcactccaaaatcctgcatcctctgcaaagaatttaatacatctgccgcattacgaccgaatctggaaagcttgaacaccaatacaaactgtacctcatctgttccattctcaatattatccaacattctctgaaattccggtctgccctctacgctctttccagacttaccttcatcggaatactcatttacaatttccatattctgaaattccgcatatctcttgagtttttctttctgagcatccagactgtagccatctacctgcatggttgtggatactctggtatatatatcgcatttaatctttttattcttcataatcttcctcgcagtataactctgttttattgtcccaaccttattttagtacttgttccaactattttcaatacttattttccgtattgacgcatttcttcgccaatcgtataattaagttagatacagagcatttctgttatcaaaatattgcccgcccaccattggcgacttataaatgattggctcgaaaatattgttcgcttaccggaagcgtctaataaatgtccggcttgaaaattatttagaaataatttctgtttttgatattgtgtttttatcacacattgcatatactataaatacacaaaaaagccaaaaaagaggaggtgttagtatggctacttcaagtattactcataattttgtcgtatccaatccaaatagcgtaaagcgttttgtcgcagcaattgacgaagccgaccgtgaccgcacaccaaagcagacacttcccggacgtcagttaacgaacccacaggaaatcttagctttaatgtcaaaaaggaagaaaaaacatgtctgataaatattttaccgttaatattcgggcatatttggataaagacgaaccgacatatatcggagaggaaagtctttacgacttactctccgatttttcttgtcccaaaaatcccgatgtggaatactttttattacataatgcgattgagtttaccaaaaaagatcaatctatcacttatctggtatttgatgctgaagatgcttcactggttggttatttttcacttacaataaaaccaatctctgtccgtgcttcaaatatcagcaagacaatggcaaaaaaactgtcccgtgtcagtattttggatgaagaaacacaatcctatactaccgcagcttacctgatcgcccagttgggaaagaactattctcttccaaaggaaaaacgaattcctggaaatattctactgggatttgcactggaaaccatatccagtctcaaatattccgtaggtggcgttatggagtttcttgaatgcgaagataatgaatttcttctgagcttttatacgcagaatcatttcaagccatttgatacgcgtattaccgcttctcagaataatgagccacacactctgcatcagcttttaaaatttatttgatttaaaaatgcatgaaaaaagcgacagtctgatttacattttgtatttcaggaaactgccgcttctttttcttccttattctgttttttttcctccaactcccggaggacttcagcgccgtacttatcaatcatccgtaccagaaaatcaatgcaccgctcaaattcaatattctgttgcataagctcctcccgttattgttttgatctgagcttattttacagaacctgccggaaaaccacattgaatagaaattgattgtaaattgacacaatcaatttaaaaatatccgcattttcttgaatcgaatatatgttcgtgttatgatagatatacttaatcttaactacgaaaggggaatttctattgaatcgatgcgatttttcttctattagcacttgcttaaaaaatcatatcagcgaaagtaatcaaatgagtcagcctgattttttatacgaattatttgaagattttatggatgatccggtaaatcaggatttttcaatggacaacggtctggtttgccgctggatgactggtcaggctaaaatcagtcctaaaatatccgcttactattccaagccatccaatcaggaaaaattagcccataccatccaccagaatcttcttccactgatgtctgactgtaatatggctatacaagatatttacactttattcattcaggatgacagcatctcagatgcaaaaaagaaaaatctgactcccttatataaaccagccagttcaagactgctgtttcttgcaaaactgatttcttttggcatggaacgccaattcatcaaacgtaataccaaaaatcagaagctgctcgccggaggcgctttatcccccattgtgctggattatattatggacagtgaggttccgaaaccatgccgtcattttatcggaagagataaagaactggaagaattatataccgtgcttgaggaaaaccgtcatgttttcctttgcggaatcgccggaatcggaaaaagtgaacttgccaaagcctacgcaaagcggtacataaagcaatacaccaatatactttatatagaatataccggcaatcttcatcaggatattactgacatggattttattgacgatccgccggaaagcactgaccaggaacggtttcaaagacataaccgttttctgcgttccctgaaatctgatactctgcttatcatagataattttaatgtcactgcgacacaggacagctttctgtcagtagtattaaaatatcgctgccagattttgtttacaacccgaagcaaactggatgaatactgtactctgccattaaaagaaatagaggatatgaacgctctcttccagctggcatcagtattttattcagaggcagacacgtaccgggcaacagttgaaaagatcatcgaaactgttcactctcatacttttgccgtggaactggcagcaaaacttctggaaaatggaatctcaactccagaccagttattaacaagacttcaggtggaaaaagcatctttccataacgaagataaaattaaaataatcaaagatggacaaagcagcaaagccacctattacagtcatatccatacgctgttttctttatacactttatctcttgaacagcaggatatcatgtgtaatatgtgctttcttccttccaccggtatttctgcccgtatatttgccaaatggctggaaatgcccacactaaatgaaatcaacgatttaattgagactggtttcgttcagacaacaacacgtcgcaccatctctctgcatccgatgattcaggaaatcaccctttcagagacaaaaccatctgtaagtagctgtcacatattactggattctttacagaaaatatgtttaatgcatggaattgaagtcgattattacaagaagctgtttcagacagcaggaaacatcatagaattgattgaaaaagatgatataccaaaatatctactttttctggaaaatgtttttccatatatggataattataattaccagaaaggtatgaaagcaatcattcaggaattgaaaaattttttgaagcgtaaagacattggcaccgattctgaccgggcattgttactggattttcaggctactcttgaaatcaagccagaaaaagcaataaaactggaaaaggatgcacttgcccagatagaaactatcactgctgacaatgctcgccttgtttccaaccttcatgccaatctcggtggactttaccgcatgaacggtcatcccgatcttgcaagagaacacatggaaaaaagtatctcactgcttgaccaatttaacctgcttcatataaatgacagcatacctcagattgccaattatgcaatgttcctgacagaacagcaggaacccgaaagaggcatctctgaattgcaaaaattatccggcatcatcaaggaataccattccgatgactgtctggattatgccaaagtacaggaaacccttggaaccatttatctgatgactgccaatcttccgcaagccaaaacacattttaaaagagctttcaaaatatatgaaaagatctgggctgatgaaccagaaatgattggagcaaaatatcaggaaattcaggagttatatccacagattggattttgcattggaaaaaatctatccggtcttttaacaaaataagcataatttacggcgggcaacttgcccgccgttatattcaactattcgtcaaataaatatatgcatcttccaaagtgatatcattatccaggacacaattctcatttggctttcctttgcttaatactttcatatgaattccattttctacatactgcttagatgatatagaataattggcttctaacaaacgggcttcttctgcgttttgtaccgtacaattccaaacacagccctttgcattttccagcaacccactcacgcttccagaatataaaaaacttccctttttcataatggcaagctgtgtacaggttgctgctaaatcttctactacatgagtggaaaacagcacagttctatcctttgaaaaatcaaccaaaagattgcggatcctgattctttcttccggatctaacccggtggtaggttcatcaataatcaaaaaatccggattattaagaagtgcctgtatgagtccgacacgtctcttcataccaccagataattgccgcatttttttattctgatgctctgtaagagaagtcttttccagataataggtaattctttgttcgaggtcatttctggctactcctgacagtccccccatatatacaagacattctttcaccgtaagattcggatataagtcgatttcctgtggaagataaccaatctttttctgtattttctcataatttccctcgttatacagaattccatcaagggaaaccattccttccgtttgttttaaaacagttgtaagaaccctcatcaaagtggtttttccggcaccattctcacccaaaagtccgtaaattcccttaggtatttcaagagatgccttatttactgcaactacaccatttttaaatctaactgttaaatcatttattctaatactcataatctatcctcttttctttaaagtcattggtaatactgcaaataaaaacagccccgctataaaagacacaagcgttccataaatccaactctcggacattaattgagtaggttcacaaaagctgaaagaaaacaatcccagatttccgaaaaatgaacttcccgcttttgatataagtccaatgacaattccaaataaacatccaatacctgcccacatatttcgaagcaatgtacacaaaatcacagagcatatactccaaagccagatagttccaaacattgcaatgaaatataaaagaaatatctgaatacccgaaatgccttcgtttacactgcccggtttttgccagaaaaacaaaacatatccaacacaggaaagtattaataaatataatatttgaacgcccactctctgcgatattacttttaactgctttttttgatcatacaaatgaaatacatcggcacgcttactttttacttccatcaaatatgtgtcactacaaaaaataattgttaaaaatgctattggcgactgaatcgctgaaccgatttcttcatagtatataatcggatgaatagcacacaatatcagtataaatgcacatgaataaaaaatcttatataacgacaggcagttttttagttccgttttcaatgaaccctcctccttttccagattgtaacagaaatacatactaatataactgatgaaattacaagaataatctgatttatgtttgacattttggctacatgtgtttcaaaaaatctgccagggaatcgcaccataatagagaacggtctcatataataaatatcattcttcatggtcagcatatttgaatatataatgtgtaaaaacaagattggtgctgccggaagcggatttttaaatattaatgctgtaattgtatagacacaacatatcatcaaaagattcggaacaatatagatcagagaattcacgcaaaaatcaattggtgttactggaaagcccgattctaaagacgttttcaaacacagcataaagaatataacattcaaaatcactaatactcccagcatactaatgaatccgcttattactttcccacatatatattggattgccgtaacaggctttgtatgtaataattcataggtactttttcgtgtatcctgaataaataaaaatgatagcaagactgttgcaaaaaaggccatatgcaatcctgcaaaatccgtaaattttttggcaaagtaccaggaaaaagaatgttcggataatttccgctcgatataatgattgatttcttctgctgtccccttatgaatttcaaggtcctcataagcatatattgcattataatagccatattgggattccaaaaactcagaagcagtctttacatccatattctgaatttctttcattacatgatctgcttcctgcctgctaaatccaaaaccatttttggaggtgtccattaacgtctctttgatcgtatcttcccactcccttcttctttctttatcatcagatgtgggaatgtacccatccatgacatcagcatcttccaatgctacgtcattttgtgtgatctgttcattctgtttgatataatgaatttgcaaatacgatgacagacattgatacatactggcaactataataatcaagccaatccacaaaacagggttctttaaataatcaagtatacttctttttatgattgttttcattgtatctcttcctttctttatttctttaacaacatcatacaaatcaattctcaataaattcacaacaaaaaagactaaaaccactttatttgtgatttcagccttataaagtatttttattcagctttgaaaagagcttctacatgagcaccgccttgtctggcattatatattttcaaatttcctccatgcttttcacagaaaatacgagaaatatacataccaaggccaaaatgctttaaatcatcttgtggattcttatgataaaatggctctgttactttttcctcagtatccacaaatcctattccatcatcttcaacagaaattataagaaaaccatcctttttctttatctgcaaagcaatacttttttgtgcatatcgaaccgcattttccagtaagttgtctgtcacttccatgacaagttcctcatccactttcacaatgttttgttcctgcactctttctaccttacataatttactttccttcttggacagcatggcagcttctgcctcaatcttttttgccagttccgataactctatctctgagcattgcagttccctctgttctaaatgggacatttttctcatgttttccgtgaaatgctctatacggtcaatctgatacatgcctgtttgtaagatatcaataacatcctctgtttttatactctcggcagaaacaaactctaagagcatttcctgatacccacgcaatatggaaagtggagaacgtatatcatgtgcaattgcattccgcaaagccttctcgtcatcaatcattcgccacatctttctgttgttatctgctaaatcacttcgcatcatttcaaattctttacacaaagttcccatctcatctttattttcataggacacatgaaaatccagttcattatctgcaatcatttgtgaggcatcttttagttcctgtagaggtgtctttaacttatttttataaaaaaagaataccgcaacagcactcccaacaatcgaaaaaatcagtaccgaatatgtttccataaagtcacacatttccgaaagatgatagtccaaacgattcatctgcgattgattaggtcttgatatctcaatcttgtatttctttccatattgctgaaacacgtccgtataatctgcataatcaatatatttttcccatattttattctgcatatttcctgcaaaatgaactgtaactccagataacagaaatgctgccgttaagctgatcacaaaataaagcagaattgtttttttcagtgacaagtttcttattttttccatcggtatccaatcccccatacagtttctatgtattctttttctgaataatccgctatttttttccttatacgccgtactaattccgttatcgttctactgtccccttccgcatcatatccacagacttgtgcatatatacgttctttatcaaacacctgccctggatgcatggataagaattcaataatctgatattcaatttttgtgaactccatcctgtgtccggctatagctactattttttcagaataatcaatcagcatttcatccatgaaacggtattccgttttttgttgatgcctttcttctctctttatgtttgtgacaatccttgcttccaactcccgaagactaaatggtttcgtaatatagtcatccccacccgaaagcaacccattaattttatcatcttcatcaactcttgctgttagaaacaaaatcgggcataacactttactgcgtatcagacgacatacttcaatcccatccatgcgtggcatattgatatccaacaaaataatatccggtttcatttttattttatttaatgcttccattccgtctgtagccgtaatggtttcatattgtttcatattaaaataactacaaagcattttcaccaattctttatcatcatcgacaactaaaatcttgtatttcatccaaaccacctccagtatccatattatacgataaaaaacaatgaaatcacaacaagagtacatgaagaatgtacgcacaatatatcttttttctcaattccagctcaatttcccctcaatgcctttttcctccgattttcgtatgcttatcccacagcagagcagtaccacaccggtacgacctgctgaatcaatcaatacgaaaacggaggtattttttatgcgagaactcagaaacaccaaaatcattgctgtagatcatggctacggcaatatgaaaacagcaaacaccgtcaccccaaccggcatcaaagcctatgaaactgaaccaatcttcaccgggaatattctggaatacaacggcatttactaccggatcggcgaaggacacaaagaatttatcccggataaagctatggacgaagaatattatcttctgacgctaatggctattgcaagggaactgaatgtcttttccatccgtgaagcagatgttcatctggctgccggacttcctctgacatggatcagaaatcaaagagaagcttttcgttcctatctgctccagaatccagaagtccattaccgtttcaacggcaaagaatatcatctccgctttgtgggatgtagcctttacccacagggatatccggctattgtaaaccaccttggaaatttcaagggaactaatctccttgcagatatcggaaacggaaccatgaacattctgtatatcaacaataagaaagcacaagaaagccgatgctggacagaaaaacttggtgtaaaccaatgcatgattgctgcaaagaacgctgttctggacaaatttggagtgaagattgaagaatctacagtagaacagattctgcggtttggaacagctgacatttcagcaccatatatggattgtatcagttctattgccagacagtatgtggcagaacttttttccacactccgcaaatatgaatacaatcctgacctaatgcacctgtatgtagttggcggcggtggatgtctgatccgtaacttcggaacgtatgacaaattacgagtcaccatcattgatgacatctgcgccaccgccaaaggttacgaatctctggcttatatgagcctgaaaaggaggggataaaccatgcagaacaatatccgcaacacaaacctgcgctttaatctggacaaagaacagcaacggagagcctgggaatatttacagacgatggacaggcaggattttaaatcttacagtcaggtaatctctcttgcactggtagattattttgaccgctactaccgcacacaggctgatccttatctggaaacaagagaacgggaagaactttttgtaaaacagattgtagatgcagtggaaaacagtctgaaacaggcattgccactttttctttccggactgactgcaggcatggcgcaaagggagccccaaatcagggcatcctttccagcacctgaaaattcacagccagatagtgatgtagactgggattttcttggggaataaacccttttgattggaggtgaacacatgactgactttctgacagcagacaccaacctgccatcttatatgatgtttccccgtttccttctggacatggaaataaacgaaactgccaaaatgctttatattatcctgctcgaccgggcaaggctttcccagaaaaatgaggggtggtcagatacagacggtcatgtgttcatttactttacgattgaagcactggcagaagttctccacaaaagccagatgacggttaaaactgctctggcagtactggaaaaacaggagcttatcttccgaaaacggcagggtcccggacagcccaatcggatttatgtaaaactcccaaaagaaaccatccactatacagacagatttctttccctaagacagacaaaaaactgtcctattgacagacaggattcttttcctaatacagacagaaaactgtctggtaataagaaagagataaaaaagaacaatttagcaataagagggagtaaggggccactctcaccctatggaaaatttcaaaatgtttttctgtcagaaaaagagcttgaagatatccggcagacaatccctgactggaaggattatattgaacgcttatccggttatatggcttctaccggaaagcaatatcagaaccacgcagctaccatcatcagttgggcaagacaggatcatcctgcttcccgacaacgaaattacgaaagtgaggaatacgaaacattatgacaaaatttatagaaaaaccaacagctataaccccaaacagagagcttcagtctgatgaatattttaacgaaacagaccacctgatctactgttccaaatgcaatacgccaaggcaatgcaggcatgaattacagggaaaggtgcttattccttccattcgctgtaaatgccagcaggaaatctttgagcaggaagaaacccagagaaaacttcatgaaaaacaaatggaaatagagcatcttaaaaccagcggcttacaggacaaagcactctatgactacactttttccaaggataacggcatcaatccggaaataaaactggcacacaattatgtaagcaactgggaagagatgaaagcaaacgcctccggacttctcatctggggtgatgtcggtactggaaaatctttttttgcaggctgcattgccaatgccctgctggaaaaaggcgttcctgtactgatgaccaacttttcccagattctgaatacccttaccggaatgcattttgaagacagaaaccagttcatcaacagcttaaaccgctacagtcttctgattattgatgatctcggaattgagcggaactctgactttgcactggaacaggtattcaatgtgatcgacagtcgttaccgcagtaaaaagcccctgatcataacgaccaatctcactttatcagagctgaataatgccgctgatatcgcacacaaacgaatttatgaccgtattctggagagatgtattcctgtccgtatcaataaccggaatatccgtcaggacaatgcaacagataatttaaaacgggcgaaaaaaatcctgttgaacaatcatgctccgaaccagaattgactcaaagaagtataacgcaatgattatttttcactgacagtggtactactatctttccttatttttcaccaagaacatgccactgtcagttatctaaaaccatagtaccaaaccaaaagattttaaaaccaaaactgcccggatacgggcataaaaaggaggtgccaggtatggcagataaaagaatcatgacaccggaagaaaaagcacttttacaggcaagacaccgccaggaagaagctgaagcaagaaatcgcaaaaaagaacgtgatgccagaacacaccgattagtccaggaaggagccattctggaaagtattgttccccatattaaagaaatggatttagattccctaaaacgggagctgatgatccggctacggggaatgtaaacgcacaagttctactcccgaagggcccgaagggcgcacttactcaccacctgataaatcaggcagtggtatccccttcggggctcgtgcgctctgccgagggctttatccgctgttgcaggcaacatcgaaaggaggtgccagatatggcaatttatcatatgcaagccaaagtcgtcagccgtggttccggtcggtctgccgttgctgcttctgcttatatgagctgtagccgcatgtacaatgattatgacggcatccagcatgactataccagaaagcaggggctgatctatcaggaggtgatgcttcctccaatggctccattggaatggaatgaccgggaacaactctggaatgctgtggaagaaaccgaaaagaccaaagacagccgacttgcaagagaatttgttgtcgcactccccgttgagttggataaagacagcaatatttctcttcttcaagattttattaaaaagaattttgtagatatggggatgtgtgctgattttgccattcacgatacagatggtcacaatccccatgcacacattcttcttactgtccgaccattaaatgaaaatggaacatggcagtataaaacagaaaaagaatatctctgtatcaaagatggggaagaaaaagggtttactgcttctgaatttaaaactgctcagaaacagggatgggaaaagcaatatcgctataaagttggaaaaaagaaagaatatctgacttcctctgttgcacaggaaaaaggatatgaacggattgataaacaccccaagagcagccgatatggcagacagaatcctatttcccaacaatggaacagtgatgaacaactttgtatctggcgggcaaactgggcagatgccgtaaataaaatgcttgcacgtaatcagataaatgctaccattgatcaccgcagctttgcagatcagggaatcaccgaacagccaaccatccatgaaggctacattgcccagaatatggaaaagaaaggcatgatagcagaccgctgtgaaatcaaccgtcagattcgtgcggataacaaaatgctccgagaattaaaagcaaaggtagcaaaactggctgaagctgtagaaaagtctattccaataatagctgaaacgttagaagcgatccgcaatcatatgatttttacacagtatcatttgctccacaatgagatgcaaaaagaagtgatccatgactggatgaatcattttaatccaatactgaataaatacaacaccattaaaaagaaactcaaagctaaagttacagagcggaaagaactgaatgtgaaaaaagagaaaaccagtattttgaatcccatccagcatataaaattgaatcagcagcttaccactgttaccgaagaaattgaagaactgaaatcaaggaaagagcagctaatcttccaggcacaatgctctaccgataaagatatgacaaatctatccaagaaatatgaccaaatgaataacaatcttgatatcctagattctcaggacatctcgctcaaaaaacagcttgaaaaagatgccgccgctttccgggaagaaaactttcatcctgaaccagaacaatataccgagttactggataccagaatccagatacgtcctgatttccgggataagctgatcgagcagctcaaaggtacttttggtaagtattatgactatcaccgtcgtgatattgcagccgatgaggtggattatctcaatgtggaagaccctgatgttttctcccatcgtgcatgggaacttaaatatcagagagaacaggaaatgcggcgaaatcagtctgctcggactaagaaaaggtcacatgatatggaattgtaatcatctaaagtattgtcctggcaccataaatggtgccgagacaatgaataatattcacacattattattttaatattccaactatttacttttatttgaaatctaagtcatagtctagcattttcaatgcctatactatcaacattctttttcttcgattaaatagacactgtctgctaaaacaatcaagctacaacgattttactgttcaatctttttctgtatgaaatgttcaataacattattgaacataatgtcatcaaatttttctcctgaaaatacgttatcacaaatttctattaaccaatcgacatctttgaccggaagcttgttcttcaataaacaaagcatttccgtaatgttgagctgaatatcttgcgtttgagctgcaagataacacgcatcttctggttccgtcaacaactccacagatttagaatatatccatagttcttctgcaatatatcctattggaagttcatcgacatcggtgacttttttttcaggcaaatcatatttttcactaaagcagtcaagcatttgtgctgtcacattcacaggatatggaggcaccagtttatcaagcaatgaatgattttctgattcgattgccttcttgacgtcaacgagcatccgtcgagggaactgtaaagcagtagaatctatttctttggactcgtttgcagataatatgactaggtaatcaaagggagcatcagcaaatgcgatacagcccagaagccattcggttaaattgctttccgatgccatatcaaaattaccaactatgatgggataatagctcaacatgtcaatggtgtaaatctgatcaggaaaatgaatcgaatactttgattctaattccgacaatccgtcttctactatctttctctcatcccgacaatgcccgtcataccaattgctaatttgatatttattaaaatacttatttggcgaatgtgtctggtagtagctacagcacattattagtcgctctatgttttgtgtttccataacacaaagagtcaactgtctttcctgaaagctaaaatcaattgcaatttctgcaaagtaattctgcattgtcacaagagcactttgagctattgtgaggttaaccatagccaatctttgtttttgttcattcttaatgaggaaccctgcaaactgattcataaagttttgtatgctttgaaagtatttactctttatttttcctaacctctcgggcactgtagctttttcttcaaaaggacgatcttctttaggatatcgcttttcaccagtagtaattagggcaaattcttcacgaagttgatctacctccccggccaaactccctaatggttttccgccaaggagtttgtaaatacaggcacagcacttatctgcaagcaaacatatatgttctctcacatcaaaccagtaatttaaccattctgtcgcggtatcaaattcgtaattgctcataatggtcttgttccatagcgacgtaagattctgatggaacatgattacaatatttttaatgggcatttctttatgtgcatcgtcgggaacaggataagccgagagcaaatcaactgtcggcttgagagcatccgcgcaatacaaatcaaaaataggcaaggctttacaaaggaatttcagccttgagacgctctgctcatttcccgttttaatattgtgcaatcgaaggatatattcaatgtgaatcgcttttttttcggaatcaataaataccctatgtgatctggtccactgcttaaggtacgtaagaatactcttaagatttcgttccacaaattccatatatttctctctgttcccgcagtaggagagatacatcagcgtagaaacgcactccagcgtcaatttttctggcttgctccaaagatcgtccagagaaaatccggccgatacattccactctggattgatgttatagatccactcagaaatggaggtataggacgtgatgtcctttattccgtcaaaacgaaaggtgcgcattttcctatataaacaatcgcagaaaatatagacatacgtttcctgcaaacagcaggtgggaatacgctcccgtaatcggcaaagatattctatattcttattatccggaaatgtttcccgcattttgtccagcgtatccatcgacacaccgaaatcctcgaatacagcaaaggggcacatttcggtcgatagaagaaaaagaccgccgtgggcatctgcatcgtcaaacgcagcccggttagaaaggaaatactgcatcacactccctgaaaaaagcccctgtattgcagaagtatagtttgaaaggtctttttcatcccatagactctcgaccgcatcgcggaaaaacgtttctttgttcagggtaaactccggcagatgagaaaacagtatcgataggtccgctttgtccgccattttcataactgaaatggcggtattgtcaattggcaggaattcatgcagcctcttaacaacgtgctttgaccgaatgggatgtagcccctcaatatacccactctcttcatttacatgcacaaggaactccgattccataccttttaaaagctccccaaaatccgagccagagtcttctgattgactcgcagaaagtttgatagcagaaagcctgactccgcaaagatctgcaaaacatactttgcgtaagatttcacattttgctttgccagaagatgattgtcctatttcggatatttgtgaggctattctttctgataacatctcaccatgagtaagcaagtagacatactctataagtagttgcctttctgcaatcttattccatgctctttgccagcttgttatgcttgggtgaagttgcttagcctctctgaatagattgaatatctctattgcttccttttcttctaaaaccggcttaattactttcaaagactggatattgctcaagtcaccactataattataccaatccatctctcgcgatgtgatgagcaacttataatgacaatgcaattcggattgtaagagctgaacaagataattccatttgctgagatggttatccagattgtcaattaagataagaatcttttcaccaagctgaattcttgctttgaaatattggacaatattcccaatttcttttatctcatcacaccatagtaactgatatggtatatattcattttggagaatataagctgcccgcaaagccagcgtggtttttccttgcccactagaagctttaattacagtaaccatgttttcgcaaatagaattaataacatctttttctaaactcggtcgtttgattggaaacccacttactatatctgctggtgttgcttttttcccttcgtaaaaactacacccttcatcaatgctaggcttagagtagtccagtttacgaatccaactatgagctggattttgaggacccttactgatatctattttgacagattggattttggaatctaattctgcttttgtcacataggcccgctgctccattttttcaaagcaaagaatttttatgctatttgcaaataatgaaacattgtctgtgttaatctcataaattctaattaaggttttttcaatttcagtagcaagtatagatttttcaatcttctcaaatgacagatgtgaaataaatttatcgaaatcataaacagaccaattccaagaaggattgtttttcttgatatttgaaatcacgccagcccaatgggtgcgtgatttttcgtctaacttagatgcaaatatcttacttagatggccttttgcaacagggaaatcgtaaacaagcttaaaaaatctattttgatccagcaaatatgcttcaagaaaatttttgagcacatcagttaaaaagctggcatcctgtttgttgacagaatatttcaactgtatatgagtaatatcattactaccatttttctgcatgatacaatcaatatcttcaatcccctcaagctggaaaaaattgcttggatttgatgacgaaagaattaaataacacgaatacaaaaattgatatgaataccccctgagtgcaatttgtccgccatccctagaaatacttaattcctgaatatttgcttttggagctgtaatctttttgtttttcttctttgtgctttttcccatatttttcctttcgttctcttattacatctacacgtgctctaatctgtacttatcaaattttccaattcagaatatcgaacgattctatttctattaggaagtttaatggcattcatcaattccatttccttgtaatgaataaaacattttagatactataataaaaaaatcccgttgctttaataataccatcttcttaacccattttctatataatctcttccaaacagcgaaaagctcccgaaggagctttccattaccttaaatatacactaattcttttaacacaatctcttctgcagcattccggatattgtttaccgctctgacccattccatctgatcacgagctttcaattcttccgtaatgccctgctgctccatcatctgacgtaccagaatatccattctctcctgtgcttcatcgtccacaagattcagatgttccaccagtctgtcttccaacatatacagtgaatacattgccagacgatgctctttcagatatgttttccgcatcattccatatttcccataatgcggttcttcatctgtactgacaagattcggatagtaaattccgtctgcgccaagtgtgtaggttccacccattttttcaaatgtgcttttcatgtgttattcctccttgaaatcagcgatgtccttagatcatcgcaaaatatttcagggcagccttgatagcttcttccttctctttcgggcattgtggaactcttgcattttctgattttggaagattatagttttctcccacttcaattccacatttgcgttttacctgagaaatatataaacttgaaaccttcaagccaaattctttcagcacataatctttgatttcctgataggttgctttcaactcggcactggtagcatccagctcgtccaggtctaagtcgatctctatcgtgtcatccggcttctgttgggacaaaagaacaactgtctcaacatgcaccgtcgccgggaacatatccacgcagcacaccttcttcacctcataccccctcgcctgcagcacctcaaggtctctcgccaggctggtcggtttgcaggagatatacaccatctgcggcacaccgtagcggatgatcttctccagtgctttcgggtggatgccgtcacgcggcggatcgagcacgatatagtccggcttctcctcgatctcatcaattaccttgagcacatctcccgcgataaactcgcagtttgtaagaccgtttaactttgcattctccttcgcggcttcgaccgcctccgggatgatctccacgccgattaccttttttgcaaccggggcgagcatctgcgcgatcgtgccggttccggaataaaggtcgaacacgactttttcatgctccgcgacatctgcgtccgctccgctcggcagggcatccccgatgaactcccgcgccgtctcatagagcacctccgcgcccagagagttcgtctggaaaaaggagaacggtgtaatctgaaaacgaagtcctaacagctcttcatagaaatggtcctgcccaaaaagcacatccgtaccctcgtttgtgacggtgtccgccacactgtcgttgcgggtgtgaagcacaccggtgagcgttccctgataggcggcagcacacaacacatccttccatccggcaagaagcgcctcttcccccccttctgctatctgtgtcgtcgttaccagatccaccaggatctcccctgtctttaccgccttgcgcaccagaagatgacgcagatatccggtgtggcgcagtttgtgataatacggcagattccgctctttaaaatagtctagcgtcactgtaagcaccgtgtgaaaatcatcgtctacaatccggcattccgggacatccacgatatcgtagaagctgccgcgcttgtgcatgccgagtgccagcggtcctcccttgtacgcatcaccgaatgaaaactccatcttattccggtactcctgctgtctcgggctcgccttgattccaaggaattcgtagtctgtattttccggtacactgacgtcgtcgatcagtttttttacctgtgacgccttcatggcaagctgctcctcgtaaggtagcgtctgatatgtgcagcctccacactctccggcatggatacaggcagcctccggctgctccttcgccgaacgctccagcacctcaagcagtcttccctcgcattttcccctgcgcactttattgatcgatgcggacactttctgtcccgggactgcattttttacaatcacgcgtcccccgtcttccgttctcacaattcccttattgggaaactctacgcattctaccatcccctcgataatctgtccctttttcacgttctatcctccattgtccgtccagtttcttctgcacattgccaaacataaaaaatcctgcatgcaggattcactcgcctgactcagccacttacgatatcgtttcctgctacagaataaagtgtgcgcctgccgcacacttgcgcctgtcttggcaggctgcctgatgcggtatgcaaagcattatttacctcaccacgaggtgcgcatccccacagagcgtttcctgttacataaaaatagggctgcatctctctgcagccccatgccctttgtcttaatcttcggttgtttcctctttgtcctcagactttgccggcgcttcctcatcatcatcgtcctcgaagaaatcatcatcaaaatcatcctcgaaatcgtcctcgaaatcctcaagataatccggcgtaaagaaacggtagataccgtatactgctgcagctacagccgctacaataccgataattgcaaaaatccatactacctttgaggtcttcttctcctccacttcttccttcttattcagaagttcgtttaactttgtcatgttgatcagatcttccatcttattcatcagattcccctccttgatttatcttcatttattgcatgtcttcttattacgcacattatagcatatctttccctgttcgcctataaaaaatttataaattaacatattttatactttttttaattttgcgaacgccgcaaacattttcttggttcccgccgcgtcaaaatcgactgtcacctcaaaatccctgccgccgggcacgatggcctttaccgttccctccccgaacttcatatgggagacgcggtcgcccacaccgtagcttaagcttccgccttccgtatgtaccgatgaaaacgctctcgcctgcatgctctgaccagacagctgatcccgcatcgtcggccgcttcttcctcaccggctccgccgtgcgccgctccctgttctccagatatgccggctttttgatctcgccgtttaaaagctccggcggaatctccttcacaaaacgcgagactttgttgtactgcgtctcgccgcgcaccatacgctgtctcgccgacgtgatgacaagctccttcatcgcacgcgtaatgccgacgtaggccagcctgcgttcttcctccagctcactgctggcattgtctgacgtgatcgacatatagctcgggaacagaccgtcctccattcccgccagaaaaaccttcgggaactccagacctttggcgctgtgcagtgtcatgagaaccacataatcattctcctcgccgacgctgtcaatatctgccacaagcgcaacttcctccaagaaaccacttaacgtcggctgttcttcgccctcctcgtaggcaactaccttgcttaacaactcatcgatattctcgattcgcgcctccgcctcgtcggtgccttccgcctcaagctccttcacatagccggtttcctcaatgacctcccgcagaagatctgccacgctgatataaggcagcttgctgcgcatcgtctggataaatgtcacaaacggtttgattttcgctgcgctcttgccaagggacggtatctcctccgcacgctttaaggactcgtaaaaactgatgtcgtacgcctccgcataatcggatacacgatttagcgtcgtcgcaccaattccgcgcttcggcacattgatgatcctgcgcaccgccagatcgtccctcgcattgtcgatcgtctttaagtacgccagcagatccttgacctccttgcgcgcatagaaattcacaccgccgacaatcttgtacgggatattggacacgataaaacgctcctcaaacaaacgtgactgtgcattcgtgcggtaaagcaccgcgtagtcgccgtagccatactttccgtcccggacaccggacgcaatatcccttgcgacataatccgcctcctcgtaggcagtgtcaaattgctcaaagtcaatcttctctccctcgccgtttgccgtccagagcgacttcgcctttctgccgacgttgttcgcaatcacactgttcgccgcgtttaggatgttctgcgtcgaacggtaattctgttccagtttaatcgtgaccgcatccggaaaatgcttttcaaagttcaaaatattgtagatattcgctccgcggaacttgtagatcgactgatcgtcatcaccgaccacgcacaggtttttgtatttgcccgcgagaagacggatcagctcaaactgcgccgtgttcgtatcctgatactcgtccaccatgatatagcggaaacgctcctgatagtaggcaagcacctctggatctgtctgcagcagctctaccgtctttacgatgagatcgtcaaaatccagcgcattattcttctgcagcgccgcctgatactcctggtagacctgcgcctgctttttctttgcaaaatcactcgatgccgacgcctgcagggcaaactgcgtcgggcttacaagctcgtcctttgcagaggagatcgccgccagaaggctgcgctccttgtagatcttggtatcgatattcaggcgcttgcagatctccttcatgacgctcttggaatcatccgaatcatagatcgtaaaattcgtgtcgtatccgatgcggtcaatgtgtctccttaagatgcgcacgcaggtagagtgaaacgtcgacacccagatgctctccgagccgtatccgaccagcgcatcgattcgctccctcatctcgccagccgccttgttggtgaacgtgatcgccatgatattgtacggattgacgcccttttcctcgatcagatatgccgtccggtgtgtcagcactctcgtcttgccggaacccgctcccgcgagaatcagcaccggtccttcggtggttataacgccgagcttctgctgctcgtttaatgtatcataaatactcatgcctgtttttccttttccgtttatagtgatatgagaaagtataacacatttctctctgtttttcgataccatacagaacatattttctatttttcatgctggggcactgtcatatacatttcccaacatttgtctcttgtcatctggttttgaaaactatataatgtgataagaggtgacacatatggacaacgatacaaaaaaatttctaagtgatctgttagcagaattacagagaattgattatgtcagaccggaagatattccgaacattgatttatatatggatcagattaccacatttatggattcccagttggaggcatccaaacggcatgcggatgacaagattctgaccaagacgatgatcaacaactacgccaagaacaatcttctccctccgccggagaagaaaaagtacaccaaagagcacgtactgacgctgattttcatctactattttaaaaatatcctaagcatcagtgacatccagagcatcttaaatccgatcacggacaaatatttcggaaaagacggcagctacagcttggaagacatctaccgtgaagtcttcggactcgagcatcaggagacacaaaatctcatgaaagacctcgccaggaagttcaacacctcgtgtcagacattcccggatgctgcccctgaggacgccgagcttctgcggaacttcagtctgatctgcatgttaagctacgatgtctatgtcaaaaagaccatcatcgagcgcctcattgacacgaccacctcggacaagtccaaggcagaaaaaaataaaaagtaatcgaaaaagccacaggcacgggcaaaagttcccgttctcctgtggctctttttatctgtctctactacttgtccgtattctgcatgcggctaaataccatgtcataaccgtcatttccataattcagggatcggttgacacgactgatcgtagcagtcgatgctccggtcttctccgcaatatccagataagtcttctggtcacgcagcatcttggcaacctcgaaccgctgtgataaagaaagcagctcatttaccgtacatacatcctcaaaaaatgtgtagcactcttctctattctgtaagctcaagatggcgtcaaaaagatgatccactgcatctgtcctaagtttcttactcatgttcttctccttcttcccaaaatggattcttttgttattttagcatattaaagttttaaagtaaatacccaagtttctgtccatgcacgcactttttccactgcttgcattcatgaaatccgattgttataataatagaagtatctggaaattgcaagaactttatttcataccaacgataactggagattataataatgaagaaattaaaacaattcctgtttatttttgtcccgctgcttcttgtgattgcgattcagtttctcgcaacctactttgccatgggactttccctgctgatcgagagcggctggtactctgtcaccggcagcgcggggttcctcgatattgtagatgacgccttttccctgtggagttcccagcgcttcaacaccggcgtactgttaatctacaatgccatgtcgatcgccgtgttcggtctgtggtactactgccggtacggcggcaattaccgccccgctctgcgccagacgtttcatcccgctgcaatcgcaggcatcgtcatgctgatgccgggcacacagtatctgacgacctatatcatgagctttgtcgcggcgctctttccgcactggatggatgcatatgaatccctgctcgagacggcaggtctcgatgatcagatctccattctgatggtcgtctgctccgtcatcttcgccccgttctgcgaggagctggtcttccgcggcgtcaccatgcatcaggcaaaaaaatgtctgcctttctgggcagccaatctgctgcaggcgctgctttttggcatcttccacatgaacatgatccagggcatctacgcattctgtctggggcttgttttaggctatgtctgcaaccgcggcggcagcatctattactcgatccttttacacatgctgtttaacttctggggaaccgtgctctccgggctcatcccgttcggcgacacgacgttttctctgatcttctggttcctgttcggcatcgccatgacagtcggcggtctgatcgtctttacctccggcatccgaaagctgcaggcggccggccgctcatcggctatgcctctttcagatattccttcaggaaccgaataaacgtctccatctcttctctcgttccgatgctgatgcgcaggtagttgttgatgcgttccttggtaaaatgacgcacatagatatgctccctgcgcagcgcctcgaacagttctgttgccggcacgcgctcgtgcgaagcaaagataaaattgctcatcgaatccccgaacgtaaaacctaacgcccgcagctcttttttcgtccactctctcgtctcgatgatcttttttctggtctcctcaaaataagcacggtcacggatcgcctccacaccaagtgcaagcgctgtccggttcatcgtataagaattaaacgaatacttcacgtcattgatataacggatcagcttcgcatttcccatcgcatatccgatgcgcattcccgccatggaacgcgatttggaaaatgtctgcacgatcagaagattgtcatatttttcaatcagcggcagcgccgacacccctccaaaatcaatatacgcctcgtccaccacaacgatcacgtcgcggttgtgcgcgatgatgtcctcgatcttatcaagcggcatcagaatgccggtcggtgcattcgggttcgggaatatcactccgccgttttccccgtaataatcctccacccggatctcaaacgcatcatcaagcgctttcgtctcatacggaatgcgcagcatatctgcccacacatcataaaaagaatacgtaatatccgggaagaaaaccggctttccggaattaaagaatgtcagaaaaatcatcgccagcacatcatccgaaccgaccccgacgaatacctgatcgctgcccagtccataatatgacgcaatcgcatccacaagcaccttacaggtcggttccggatacaggcgcagcgtatccgggttaaatccggcaagggccctctgcacccccggcgcgggcggatacggattctcgttggtgttcagcttgatcatccgctccgcctgcggctgctcccccggcacatacggcaccacttttctcacatatgactcccagttctccatcctttttcctcctacttgtccagtccgtacactgccgccagcttcgcaaatgcaggcagggaatgttccacggtctcatgggacacacaatatgcgagacgcacaaaccccggacagccgaaagcacttccctttaccattaaaagattaaatttctttccctcgtttacaaattcttcttcgttttccaccggcgacttcacccacagataaaatgctccctccggcttaatgcaggtaaatccgagctttgtcagtccttcgtagagtctgcttcggttctcatcgtaaaatgcaacatccgtcttctccgcaaggcagcgcgccacggctttctgaatcagggacggtgcattgacaaatccgagcgtccggtttgagatctcaatgccgcggatcagctcttcggcgtccgccgcttcatccggcaccacgacataaccgatacgctctcccggaagggaaagggatttggaaaaagaatatcccaccagggtattgcggtaatattttgtcagaaaatcctccttattcccgtcatacacgagttcccggtacggctcgtccgagatcaggtaaatatcggttccaaattcagcctgctttttctctaaaatcgctccgatctgctccatcgtctgcggcttgtagatcacgccggtcgggttgttcggcgtattcacgataagcgccttcgtccgcgcggtaatctttgactccagatcggcaagatccggctgaaacgtctccagattcggctgtacaatcacaatctttgcatcaaaattcgccgcgtactggcgatactctccgaagaacggcgcaaacacgataacctcatcatccgggtcaagaatcgtcttgaaaataatgttgagcccgcctgcggcgccgactgtcatcaccagattgtgcgccgtaaactttgttccgaaacgttcgttcaaattctctgcgatcgcctggcgtacttcctcatagcccgcatttgccatataaccatgaatgcccagagaacctgccgctccctttgcatccgcctcatccagaaggtcacggatcgcatcgtttaacgccttcggcgccggggttgccggattgccgagtgagaagtcaaacacattctcctccccgtactttgcagccatctccctgccctcattgaacatggcgcggattgccgaattgccctccagcgctttttgtattctctttgataccataatacctatcctcttttctgcggtctgacccgcatcgttttctcattcctttactttaccaaattaccacgtgaaagtaaacggtcatttgcaaaaatttgctccatgcacaagtataacacatttatcgggaattgaaaaaaagaacggacaacttccggggaaaaaatccccgtcccgtaatccgttcttttcctctctctatttctatgcgttcaccgtatccacaaagcacatgaaggctgctctgccctcttccgtgcacttgtagactcctgcgtcggtgagaacctccttaaataccagaccgatctctgtctgaacgatctcatgtaacctctccggtgtgatctcgccctccagaccgctgccggcggtaaagccgtactttggaagaaattcctccacccagtctgcatgcttcgccagcttctcgtccgcacggatgtcaacgccgtccaagatcgcctgctccagatccgccatctcatcctttaagcgtgccggaagaactgccagacccataacctcgatcagaccgatgttctccttcttgatatgatgaagctttgcatgcggatgatatacaccgagcggatgctcctctgtcgtaatgttgttgcgcagtaccagatccagctcatacgcatcgccgcgccgtcttgcgatcggtgtgatcgtattgtgcggctcgccgtctgtctcggcgtagacgaatgccgcctcgtccgtgtagcctctccatgcgaggagaatcttgtctgccagatcgatcagacgatccttgtccgtagcgctgatacggatgacagacatcggccattttacaatgcctgcctttacatcctcatatcctttgaatgtgatctcgcgctccaccggtgcctttgccatggcgaactcataatgaccgccctggaaatgatcgtggcttaagatggatcctccgacgatcggcagatcggcattggaaccgacaaaatagtgcgggaactgctgcacgaaatcaagcagctttccgaaggtagcgcgctcgatcttcatcggggtgtggtttgcgttgaacacaatgcagtgctcgttgtagtaaacgtacggagaatactggaaaaaccagtcgctctggttgatggtcaccggaatgatgcggtggttctgtctcgccggatggttgatacgtcctgcgtatccctcgttttccttgcacagaaggcatttcggatagccgctctgctttgccagcttcgccgccgcaatcgccttcggatccttctccggcttcgacaggttgatcgtgatatccagcgttccaaactctgtgtccgccgtccatttcagatccttcttcacgcggtatctgcggatatagtccgtgtctctggacagcttgtaaaaataatccgtcgccgcctgcggagactccttctcataaagatcatagaaacggcgtaccacctcgctcggtcttggaaccagcatgctcatgatctttgtgtcaaacagatcgcggtatgtaatcgtattgtccggaatcagcatctgctccgccgcgtaatcgagcatctctgcaaggatctgtggcagtgcctcctcggcgctctcctgcgtcatcggcgtgcgcttctcataagccgccgtgacttcatcctccagttcgtcaatgtgaaacagctccagcagacggttgatcgtaaaccgcttatcctgcggctctatgagtcccgtcaccagtccgtattctgtcagttccaatattctttcctgtatcatgatccaacctcgtttctaaatatactctgtcactacgccaattttaccgggccgtcgccgatctctacgacatagaaatctgcggcatagccaatcttgttcttataggcggttccgaccttctcgataaacgcatccaccgcgtcatccttcacgatgctgaccgtgcatccgccaaagcccgcacccgtcatgcgggaaccgatcacaccgtcgatcttccatgcttcctcaaccagggtatccagctcgattcccgttacctcgtaatcatcacgcaaagatacgtgggagtcattcatcagctttccgaacagcgcgacatcgttgttctgcagtgcctccaccgccttgatcgttctctggttctcatatacggcatgttttgcacgcttttggcacaccggacttgtgatggcatcctgatactgctcaaactgcgcttctgtcagatcgccgagcgcgttgatctttaccactttctgcagttcggcaagcgctgtctcacactcactgcgtctctcgttgtatttggaatcaccgagtccgcgctttttgttgctgcaggagatcacaatcttcgcattctcgagcctgatcggcgcatactcatactttaaggtcgccgtatccaggaaaatcgcatgtcctgccttgcccatcgcaatggcgaactgatccataataccgcagttgacgccgttgaacttgttctcggaatactggccgatcaatgccagatcctgattcgtcacatcaaagccgaacatatcacgcaggatgaatccggtcagcacttccaccgatgcggaagaagacaatccggaaccgttcggaatattgccgaacagcacgagatccataccggactccactttcatgcccttctcgccgaacgcccacatcacacccttcgggtagttcgtccagtctgcttccttctccggctttaagccctccacggaagactccagcacaccgagattctcaaaattcatggaataaaagcgaagcttcttgtcgtctctttttctcgccacaccgtaggtaccgatcgtgagcgcacatggaaatacatgtcctccgttgtaatcggtatgctcaccgatcatattcacacgtcccggtgcgaaataaactccgatctctccctcatccccaaataattctttaaactttgcaagtactggttcccagatcatgcgttacctccttatacatcattttttctatgaatggtttctgttaccgtcctgttgtaattctattataacgtctctgtgttcctttgcaatagacctttttcaaactgcaacataatcaaaaaaacatgcaacaaagttgcatgtttttttgatctgtcatttatcatttttcacaatgccatcgatcacaatctccgttcatacggcagccccggttttttatacttccggtttaaaatcacggatcaacgaaagtgtcggcagtgcgttgccatcgtagtcaaacagcgcctgatttgcccactcgtttccacatggtcccggatcgttcatgtattttaaggaggccggtgttgcccagccggagcccggtaccggaatccatgcaggctcccagtagaagaatccctttccttttccgcctttgatgtggctgatgcggttcaagaaatcctccatgaaatcgtactgcccctgctttgtcatcggatattcgatcttctccacaagcgccggtctggtcgcatatcccttgcgctcttcatcggaaagcttctcgtaattcttgtagtcttccatcgtatagcccatggaaacctcggcaatcaccagatccttgccgtagcgctctgcaatgtcattcatgttgtcgtttaacatctgcagtgatccgtgccagaacggataataggaaagtccgataatctcgaaatcctccccccgctttgtaaaattgtcgaaccactcgcggtacagcgcattgtttccgccgttatccagatgaatcatcaccggaatcgtcgcatccgctttccgcaccgcacgaattcctgcattgacaaacgtcgcaatattgtcatagttcgggacttttccctccggccagagcagaccgttggaaagttcatttcccacctgcaccatggtaatattgacgccggcatccaggaatgtctgcatggattccagggtgtaatcatagaccgcctgctccagctccttcacaccgtaatctgcccatgccttcggcttgatctgtttgcccgggtctgcccagaaatcgctatagtgaaaattgagaagcacgccgaaccctgccgccgtcacacgctttgcaatctcaagagaggtctttaaatcattctcccccgcgccataagattcgccggtctccgaccacggatcattccacagacggatacggatggtgtcgacgtcatagctcttcatgattgcaagaagatcccgctcctccccgttatcgtaatactttgctccgcaccgctccagttcgagcagtgtggacagatccattcctttcacaaacttcatatgcctattcgcgggcacaggttacattccatgcccgctctcctttctgtttttctatattccgcggaaaccgaaccgcagtgtcagaggctttgtcacatcaatgtgatattccggatgaaccggtgccccccagctgtcgtctccgccaatgcccatctgcgccagcgccacacgtacaaccgtgtaatgcacctcaggcagttcatacgcatgcattgcattttccagttcatgcggtgtgtaaggcagcgcggaaaatgacagttcgtctccggtaaagagcatgccccttcctctctcatccgtcaccttcgcatagcgcacgcctactttgttgccgcactcctgcggtaccagatactgcgccatattatccgccacgcagttcctgtatacaccaagcttcgcgccgcatctgcggtccatatacgtctcctgcggtccgagaccataccactccagtctgtcgtaatccgcattcagcttaaagagcattccaaattccggcatatcgcccagctcctccaccgggtcataggtcagttcagtctgcacatacgcatccggcgtcacagtgtacgtcacgcggcattttgcctgcggcgtggtcggaagcaggtaggtataggtgatggaaacgccatcctccccctctctcacaaccggttcctcataatcgaacatgcccttgctgctcattccggcatacatactcgcgatcttccactgcgccatccgcccctgcatgcggcttccgcagtcattgtcgatcggcgcgcgccagaaattcggcatcggtatcttctcaatcaattcttttcccatgtagcggtaggacaccagtccacagctgttgtaggaaaacagtacgtcaaaattctcacccttcacgcccaggttccactttccgtggatgacctgaagtcccgccttacggttcgtcacgcactttccttcatattctgccgcggcatcgccgattgtcccaccatttgcaggtgattttgccacaaaaatcttctgtccgaatgcgatctcatgccccggctttgcccagagcagttcttcgcgcagtacaaacgatacggtcagtgcgtattccgccccggcttcctttcccgcatgttccagttcatcggcaagagccatgcagccctccagttccgccagaacaaacgtcttttccgagagcggtgccacagacagcgctatttttctgcggcctgccgccacgccgttcttctccagcagaaggatgcagtcatactctgccgtatcggtaaacaggtttttattttttaccgtaaaaccatcttcggtaaaggatacgctgatgttctggtaattgaattttacttcctgcatcttcggtgactcggcgcgcccctttgcatagcagatgccgttgccgctgaaattatagtccgtcggccgctctaagaagtcaccgccgtacgcctgaaattccttcccgtagcgatcctttttcgtgatggactgatcgatgtaatcccagataaatccgccctgatagcgcggctctatgtcggtcagatcggtgtacttgtgcatcgcgccgcaggaattgcccatcgcgtgcgtgtactcacagcagataaacggcttctctttctgctctgccagatttttcacaatccgctctaccggcgggtacatctggctctccatatcgctgcttccattgtaacgtctgtcgttgtagactccctcgtagtgaaccaggcggtcggaatccagctctctgaatttctcggacatctgataaatcacacttccgccgtaggactcattgccgcaggaccagatcaggatcgccggatggttcttatcgcgctggtaacaggaattcacgcggtcgagcattctcgcctcccacttcggattatcccccggcacaatcgtctgcggatccgcgatcttccgcattgccgctgcatcccagcttccgtgggactccatattattctctgcaatcatgtagagtccgtagatgtcgcagagctcatacagcccgacattgtccggataatggcaggtacggatggaattgatattgttccgcttcatggtcacgacatcggtgagtgtctcctccatgctcaccgcacgtccggtcagggaactgaattcgtggcggttcacgcccttaaacacaatccgctttccgtttaaaagcatcagtccgtccttcatctcgaaccggcggaagccgatctttgatgcgacgacctcctgcaaattgcccgccgcgtcatacacctccatccgaagttcatacagatacggctcctccgcgctccacagcttcacatccgccacttcccgcgagacatgtaaggttccgtccatcttctcctccagagcaaacacctccgtgccctccgatgtctcatagcggctctccgccagatcaagtcttccgcgctccacaagctgtatgcgcacatttccgctgccgcaggagcgaagatccagctccagcgtgccaccagacagactctccgccacctgtggacggatcttaatgtcgcagagatgcgtctttggaatcatgtagagatagacgctgcggaaaataccggaaaaccggaagaaatcctgatcctcgcaccagcttccgatcgtccacttgaatacctgcaccgccagcttgttctccccgtccttaagataaggcgtcagttcaaactcggacggtgtaaaagaatcctcactgtatccgacatatgttccgttcagccagagtgccatgccgctctccgctccctggaacgagataaacacacgctctccggaaaaagactccggcaatgtgaaatatttcacataacttgcgaccggattgaacttcgtcggcatctcgtccgtccagacgtcttcccttccgtcccacggatactgcgtgttcgcgtactgcgggctgtcatagccttccatctggatatgtgccggcacgcggatgtcatcccatcccctgcaatcatattccggcttttcaaatccgcggatcgtctgctcatagtttttcgcatagtggaacttccatgatccgtccaaaaacaggcggaaactgctctttcttccgagcggatccagccacacgtccgcctcatcccagttccggtacgccacatggtcggagtgcgccgccacgcggttctcctcgtaatattccggatcacttaatctctcaaacaaaaattctcccatactgttcatcccccaatttatgattgctgttattgcgtttgttaagttcattataacgaaaaaatgcgcattttgtacttatttttcggcacaaaacacgcattttctaccatcattcattaccatccttttcgcgcggaaatattgtaattcaaaagctttgtctcgtaattttccggattgattttccactgatagggggatgtgtttaaaaactttttaaaattccggttaaatgtggatgttgtcgtaaagcctaccttctgtgccacaatgtccatcgaatccgtcgtctttttcaacagatcgcatgccttctgaatccggacaagattgatgtaatccaccggagacatgttcatacaggactcaaacagccttctgaaatgcgtctcactcatatgacattcctgcgccagctcctccacccggatcatgtgcatatattccatgcgcacatagtcgagtgccgccgcaatctgcgtcactcccgaatgtttctgcatttccacaccctgcacttcctgctttgcctcctgctcctcattcagccggataatctctatcacaagagaatacaacagacctctcacgctgtccgtataatggctacgccgtccccgcatctcctccatgatctgccggacaagaaacgcgagattgtgattctcccattcatggagaaacagcgctctccggttgactttccggatcagttcccggcagaacagctcgttcttcggatacatttccgcaataatctgcgccggatcaaaaaacagatattcccagtagcttggtccttcttttgtattgctgatcgtcacatgaggatagttgttcggtataatactcaccatggcaggctgataggggcgctgttcttcgtccagaatcagtttccccgtaccgtttctgcacactccgatctccatcagattgtgaaaatgaagatgtacctcatcatgaccataatcccggatccagttttctccaagaagtgccagaacatattcattttgcggtatctcatagaaccgaagctcgatggtatctttcttctttttccccataattactccattttctccccgctgtggcagcgtaaagctcctcgccgtgacagttcgattccgcttcgcttcttctcgctgtgggctgtcgcattcttctgcaaccagctctgcgctcctcgctgtgacagctcgattccgcttcgctccttctcgctgtgggctgtcgccctatagagaaatccagcaacaccctctggaaagcaagctttcctccggtgtcactggatttctctacactgctcgtagcttaatcaaagtcgaacttgtcgaaccgctggtgcattgccttatagcggaagcggatcatttcatttttctccaggacatcttcttctgttcctctgtactggcagcggatacagctgtaaatacctgtttccttattgtaaaacatatcaatgtccagatctcttaaaaagcaggacgggcatctataatttaatttgcctttgccaagttgagccatgttgcaaatacctccttatctgagattgtttttctgtatcccagggtaaacatcggtgagaatgcatatccctcttttacatatccttccgcgtccgcgttggatgcagtcatggatacgcgtgtctcgatctccggaatcacggcgcttacttctgtcgcacccttgacaccctcctcgcggcacttgtactcataatggatcgtcttctcttccggtccgtcgatctttaaggtgatatgggacatatcctcggaatactcggttgtgccgtagcatgcaaccatatactcgtttaaggtaacctctgcactcgggtcactcatctcaaggatggtacgctcgatcttgatgttggaggagccttcctcaaagtattcttttgtctgaagcttcacagtcaggtctctgaactcgatcgttaccggatccagtgtcaggattcgtgtttttccttcctgtgaaaaatgtgcgtgtgtcgggcagaggcagagatctacttcctcacccttgtaggaaagcttcgcacttcttactgttccctctcctgcgtaatgtgtgaaataacctgcacggtacttctcctggatcaggaacggataagatgcatcctgtacgtgctttgtgccgataccaaccggccactccagcttcgctgcatacggacgaaggtcaacgattgcgccgccctgatccatattgacgcaggctctcatgtacggatcgcagtaccagaacagctgcttgtctgatccgtagaggatatctctccagagcgcacactccggctcattgtagttgccggcatccacgcccttcttctcgcggtagtaatctgcgaactcggacatcgtcatatcgactaacttgccctcttttttcagcttaccgtaatatgcacagccgtcgctgtaagacttgtagagaagctcatacggctgctcccagcgtcccatcttgttcatccagcccgggcctacaaacatcatgttgtatgcataaccgttgttgtattttcctaacgaacgatactgatcgatcaggttgtacagatacgggtactcccaggtctttgtatcgtagatcattccgcgaagtacattctgcggatgcgttccgaagttggaaccgttaccgtcatagcatgcgatcaggtcgcgggacagatgcgggattgcaacgataccgctgtcctcagccgcattggctgccggtgcatgtgtattctgcttggacgggatccacggtgcccatgggccgccgtcgaataacgtgtaccaggagttgttgcaggtatggtaagctttcgggccttcctcccagcaggtggcaaccgcacactttacggtcggataagttgccttgatatagttggtcagatcggcatccatgtagtaggaaccggttgactccggatagaatccgaatctgtcatggaacttctcaaacacatcgttgacgatggcttttttgtcctccatggagaacatccagatacagaagtccttggtcttgtatttctcacggaactcctcacacggaagtccgagtaaggataacgcgatctcgtctccgtatacgtcatggtcatgcttcgcaatctccactgcctcgtcattgaaaagagatgcgtatgtcatctgaatggttacttttaatccattctcatgtgcgagtctctgctgtgtcttgaaaatatccagagattctgtcaaaagagccttatctccgatgtcctcttcctttccctgtcctgtgacagttgcggaatactccggaaccatctctggtctgtgaatcagatttaaaataaattgatccattttcttcctcctcaatttctatatttctttcatttttatggaaaagatgcctggtgcatcctcacccgcctacctaaaaaacttgtattgcactttgaaaaatgccgcttttgcatttttctaatgcgaagttggaaatactcaggcattgcagccaatgctgcaatgcctgcaatagtattttccttcgctatttatcccttcaccgaaccaccggtaattccttctacatagaacttctgcatgataataaacagaataccgatcgggataccgaccataacgccgcccgcgcagaatctcgagaagtatgtcgggatcagagtacgattcagcatgttgtaaagtccgatcgcaacggtccagtctgtcgagataccggagtttaagatgatctttgcaaaaacgaaatctgtccacggtaccaggaaagaactgataacagtgtacacaatgatcggcttggaaagcggaagcacgatcgtgaagaatgttcttgcctcggaagcaccctccagatacgcagcctcacgcagggatgtcggaatcgtatcaaagaatcccttcgccacaaggtaacccagtccggatgcaccggagtacactagaatcataccgatatggctgttggttaagttgacggacttcaaaataaagtaaatagcgatcatggacaaaaagcccgggaacagctgcagcataactgcgatattcatgagagcttttcttcctttgaaacgcatgcagctcattgcatagctgaccatcaatacaaaagaagttgaaatcagacatacaaaaatggcaataaccaacgtattcttaaaccagatcgggaactgtgataccgtgtccggttcaaagagcatacgggtataattgcggatcgaccatgtctccgggaagaagcggctcgtgttcatgccatcatatccactgaacgaggttacaatcagccacacgatcggcgtgatccagatcactgcaagcacagcaagcactacgtgaagcaaaacggaattaacaatttttctctttcccatcatctgaatgtatcctccttatctcctttaatcaggaagttaaaggcaaataatgtaatgactgcacatacgacaaagacgcagataccgatgacggatgccatcttatagttgtactgctcactggtcagacgatacagccaggtaaccagaagatcaatctccttaccccaggaagccgccagtttctgattggtcgttgtgtaaatatcctgtgtcagcaggtaaattacattaaagttattgatgtttgccgtaaactgtgttacgaggtaaggtcctgtgataaacagcatataaggcattgtgatctttcggaaaatctggaacgagtttgctccgtcaatcttcgcactctcttttaactcttccggaatgttcataagtacaccggttgcaatcagcatcagataaggaacacctacccagatattgatgacaacgatcgtgattttcgcccagaccggatcgctcagaaacggaatataatttgctttgatccagccaagattctgtaacagatcaaccagaccgatgttcttgcagaatgaattgacaattcctgtatttgcgaaaaagttacgcagcaacagcaatgttacaaactgtggaacggaaatagctgcaacaaaaagcgttctccacatcttttttaattttgtgttcttgttgttgatcagaagggcgagaataattcctccaaaataggtcgtaaatgtggcaagcactgcccagagcagcgtccatcccagaattctccagaatgtatatccgaatgtggaggtaatgctcgtggtaaacagggacttaaagtttgccagtcccacccaggtaaacaatgcatttggcggcatatgactcttatcatagttcgtaaatgcaatgcagatcataacgaccaacggcatgatattaaagataatcacacccagaaccggaagcgccagcaacgtaaaatgaaacttatcattcagcatctcattgcagtcttccttaaatgtattgatgtgctttcccgcttcagcgcgaagctgtaagcggtatgtatttctcacgtttgccatccaaagcaggattcccacaatgagaaaactcagactgatgacaccgaagagcagaatcagaagggagttatcataatcattgacctcattcttcatcgttgccgggttgtacaccatcgcacgctctaccgtacctaaggtattcagctggctgatatatggcaccccgatcaataccgtatatagaattaacccgatttccagtaatgttaccagaaatcccttgatgatttgttttcttttccaataaccggcacccgctacgagcagcgatgctttcactgcaccgtcccctttggcggcagcctcaccaaattccttaaagaattttccgattgctccgaagaatgcagccaccggattctttttactttccttactattcatgcaagcacccatgcctttccataaccgccattttctgtaaaatggcgttctccttgtatctttgctgcacgcagtgtatacctgttctgcgtgttctttgggttctgttgatattcagatgaagaaaaagacccactcacgattcccatcttcgtatgcgggcctttttctcttcatacactcttataaaatcgtgttactgcttattctgtcggctgtgatgcagactctaccagattatccagcaatgtctgtacatctgttccgtccgggttaccctgagcaatgatctcaccaaatgctttggacggatcccagtaaccgctgcctactatctgaacaacaccgttagcaccattctgtgcggtaactgcagcgattgctacatttgctttaacctcatcagactcgccagctgcaatgttggacggtccgatctgtctctcagcaaaacgtgtctcctggctctgctcgttggttaagaactttgctaattccatagcccagccaacctgtgcagagtttgcattaacaccgatcatcttgtaaccagctgcagaacccatcggaacctggttgccagcgcatgtataagtcggaagtgcgcatgccgcatatccatcaccgaatgcttcctgtactgctgctgcatcccatgtaccggaaacgatagcaccaagctcaccagttgcaatctggtttgctgtatcaccgtctgtgattggtaagaatgccgggtttgttgcgattgcaagcataccgtctacaacatcggtacctttgataccgtcagcagatgttccgttccagtccattgctgtgcttccgtcatcatttaatactgttgtaaatcctgctccgtagaagaaacctgcattgtaccagccacttgcaagcaccattccggctttcttgcctgctgctgcacagtctgtaaggattgcatcccagttggtcggatctgttacaacattgctgtcataatataagaagtatccgttatcagcagacatcgggtaagcatataatgtaccgtctacggtagctgcctcaacagcacctgctacattctggctggagacagtatcaacatcctgtactgcctgtaatacacctgcatctacaagatcaatcagctgatcacttgcgaatgcgaatacatcagctgctgctgtcgggtcaactaagatatcatccttagcatttgcctcagactctacaccaactgtaatgtcaaatgtctgatccgaatttgcttccttaaactgctcaataagctcgttggttaatgtctggtcttcctcagcggcccatactcttaaagcaatggtgtctccgcttgctgcaggagctgctgcttcctcagtacctgctgctgcgctgttgtctgctgcgctgttgtctgctgctgcattgctgtctgttgtctcgctgctgcttccgccgcatccagctaccatggttgctaccatgctcgcacataataatgcgctcaaaacttttttcttcattttgaaaatcctcccttttctttttcaaaactttttcagaacgccgcatgcccaattccgtatcgtacctgcggtactgcgcatctattgcgcaatcggttgttctatgattaaagtatattacgtgcctgttttgatgtcaatgtttatattttataataaatttgctttttttttggcacaaatgcacaagttttaaaaaaatatcagcttttcgtggaatcattcattatttttgtgcaaccgataaacccgaatattccaagcatattccactgttttctttatattttccaacatttcaggcgcatattgagcgattttgctgatttttccgctctctacactgtttccggcgtgtcagacaccgtattccgacacaatccgcactgcccggtgtgcactatttcgtggattccttgagtacgacctcatatggaagtaatgtcttctgctttacctccagtccctccacaagatctaaaagcgtccggcacgccacttttccaagttccttggcatcgaaagcaagcgaagtgatcgacggcacatggttctcgagaatcgtgctgtcataaaaagatgccacccgcacatcctgcggcaccctgacgtgctgttcccgcagtacctttaaaaccctgctggtcaccgcatcgtccatgcacaggatgcagtccacgttctgctccatgatttccttcactgttctatcgacgcgcacccggttttccgggcttaagtacagcaggctttcatccagtatttccccctgctgctcataggcatcccggaatccaagcagacggctgtgcgttaccatgtatccctcgtcctcgccgatcagtgcaatccgctttaaattcttcattaaaataatggacgtcagttcccggcaggcacttctgtggttgtggtcgatctggattacaccctcataattcgtacttcctgccgtcacaaacggaatatttttctgctgcaggaattcaatctgcgcgtcctccagaaaggtacgcatcagaatcacaccgtccaccttatgatttgcaacaatccgctccagcgaagaaatatcattcatctgacacatcgtaagcagaatgtcatatccgaccgtctccgccatctcctgaataccgaacaggcagcgctggaagaaattccagtccaccacttcataatcgcgcggcatcaccacacagatattgtacgttttcgactgtgccagtcccttggcgatggcgttcggcttataatcgtgctcctctatgtattccagaaccctcttgcgggtctctttcccgattcttccctttccggatattgcgcgggaaaccgttgtctttgaaacccctaacgcctccgctacatccgcaatggtaatatcttttttctcttccttctccatagtaacctccaaccccggatcatcgtccggagttcccctttattttgcgcttgttgcgcaatctttttttattatcaaacacaattccggaaaaatcaatccccttttttaccaaaaataagttctcattttttgcagtatttacggtactttctgttgtttacagtccatttttgtgatggtataatgaaaaagcgcaaacggttgcacgtttttgtgtgccgaaatgcgcaaaacagctacttcttatagaaaattttagaaaagattggagatcacccgatatgagaacagatcacctgctctttggagcagcctactatctggaatatttgccgtatgaccgtctggagacagatatggaaatgatggagcgtgccggcatgaataccatccgcatcgccgaatccacctggagcaccttagaaccatccgacggcgtctttgactttacctgcatcgcccgcatggtacaggccgccgcaaagcatcatttttccgtcatcatcggaaccccgacttacgcgataccaacctggctggcgcgcaaatacccggatattctcgccgtcacagcaaacgggcaggagctctacggtcaccgtcagaacatggacatcacgcaccccggctaccgttatcacgccgagcgcatcatccgcgccatgatggagcacttaaaggacgttccgaacatcatcggcttccagctggacaacgagaccaagagctacggaacggccggtccgcgggttcagcagatgttcgtcgcttccctgaagaaaaaatacccggacattttggatttcaaccgtgaattcggtctggattactggagcaaccgcgtgaacgactgggcggattttccggatgtacgcggcacgatcaaccagagtcttgccgcagaatttcagcgttttcagcgctccctcgtcacagagttcctctcctggcaatcggacattatcaaagagtacaaacgtgacgaccagttcatcacgcagaattttgattttgactggaccgatcactcttacggctatcagccggaggtcgaccagtatgacgccgcccgctgcatgaccgtggcaggcgccgatatttaccatccttcgcaggacgacctgaccggagctgagatcactgtatgcggaaatattgcgcgcagcttaaagaaggacaattatctgatcttagagacagaggcgcagggtctgaccccgtggctcccctatccggggcagctgcgcctgcaggcgtacagccaccttgcaaatggctccaacagcgtgatgtactggcactggcactcgatccacaatgcgatcgaaagctactggaaaggcgtgctttcccacgatttttccgaaaatgccacctaccgggaagccagcgaaatcggcgcggagtggaagcgcatcggcacacacctcatgaatctgaaaaaggaaaaccgcgtcgccatcctgctggacaatctctccctggcggggctgcgccagtttccgcttgagaccaccggtgaccacagctacaatgccgtgatgcgctggcttgccgacgccctgtaccgcagaaacatcgagtttgacatggtctcttccggcgagcgcgatttttccgcctatgattttctcgttgtcccggcgctctatgccgcatccgacgatcttctcggtgcgctcgaccgctatgtggcagaaggcggacacctgatcgccactttccgcacgggcttcgccgacgaacagttgaaaatccgccacgatgtacagccgcatcttctttgcaggtgcctcggtattcactacgatcagttcacctacccgaagaatgtccgcatcaccaccgcagacggcagaagcgccctcgcacacgactggatggagcttgtcacctgcgacaccgcgacgtcgctcgcgcattatgaccatccgttctggggcagttatgccgccgtgaccgagaacgcctatcaaaagggctccgccctctacctcggcgctttcttcgatgatgaactgttggagccgctgctcgtatcctacctctccagacacgggtatgaaggtctttccgaagacactccgcagtttccgctgatcgtaaagcgcggcacaaacgattttggcaaaaatctgtgctactacttcaactattcggacgaaccgcggacagtgacccacaccggaaatgcgggcaccgatcttttaaccgacaccccggttgccgccggtgccgtcctgacactggctccctgggggctggcggtcgtcgaatcatagatgcctaaaaacccggtgtatcccggggacacggcggagaaaagcagggacaggtaaaaacagaatggtaaaatgttccgggtggaacttgccggcggcggttctttggagcaaaatctgagcatttcttccgcatcgcgcctggcatcggattccgtgtctttgccacgctttgacaatccacggatgtgtccggcaaaccgcagacaatgagcggattccctagtgcctctaatggcactgcttcacagacaatataaaaccgcgcgaaccgaaactcgttgccatctgctattaaaaacagggcagatggcaattcaaacatcggcttcgcgcggttatgtttttttcagcagtgccataagaggcacacgagaatcctaaaattgtctgcaggttgcggacacatccgtggagtgttcaaagcttggaaagacatggatcatcggggatgccaggcgcggtgtggattagaaatgccggattttgtgatcagaactgctgccggcaattccagccggaacattttatcattctgttcttaacctgtcccggctttcctcttccgtacccccgagatgcgctgaggggtttttgcacaccggatattctacaccgcccgccccaggaaccgcgtcagttcctcgatcggtatcggtttggaatacttgtagccctgcagatacagtgcattcatctgcttgcactgatcctcgtctttttcgttctccacaccctcaaacagaatctcatagtgcgaattcttgaaaatatcggaaaagcttccaaccatatagcgggattctgcatttttccctgccaaaatagtcagcgaacggtcgaacttgatcacatcgatcggcaggccgataatgcgctcgaaattcgagtagcccgttccaaagtcatccagatagaatttgattcccagcttctgaagactggtaatcgtattcttaatgttgtcaaattccgtctcattccagctctctgtcagttcaatcgcaactttttcatacgggatttcattctggcggatgatgtccatgacatccttgcagaattcctttctgcggaattccagaatagaaaaattaacggaaacacggtcgatctgatacccctcctgctccaggcgtttgatctggcggcaggttttatttaagatgattttgctgagcgtatgaatataatcgtgccgctctgccatcggtatgaactgatccggatataccattcctgtttccggcagctccagccgcatcagcgcctccgccgaggcaaaccggttggtacgtgtatttagcaccggctggcagtacactttaacgcgctcatcctccaagtcgcagtgtgcattgatgtcctttaattcgcctaatatgtaagatgccttccgatattctatgatgtccttattctgacactcatataccgcgccgaccggtattttctcttccataaactcattcaacgccagatactcacctgcctcacgcagcctgtcatctgcatgtgcaatcagcacccggtagcccagtccatgttctttacacacacgctcaaacgttttttgtatgttatattttccgtttttctccgctttattactcagtctctgatacaccagtgcaagcttatcatcctgcagacggaacaggcagaatgttttgaaataattctccgcaaacgtcagaatcgtacgcggaagttctggtatctttttgagattggtttccgggaatcccatgaagattacagaaaaatcatcgtcccccacatctctcagatagctgtcaaacgcaccagcatcaagtgttcctgtctccctgtcgtaagatgtataatgaaacaaaaacagcactcccatatagggaagtaatagtgccatgcagctataagatgtagatacatattctgcctccagtgcaatcatgccaaacgaaaacagtaaaatataggcaaggcagcgcagcattttcagcacgaacttcttccggtacgtaaaaagcacaacgacaagaacgatacagtaataaatataggcaaaacgaaacggatcaaaatagaaattctgatgaaccatcagatctgcatcgatataaaaacccagatgcgtaaacggtgatccgatctcaagaaaagcaaacaccgcatagccgccccaggataccgcgcccaagagtcttgccggtctctcttccagcttaagaagtgtaccgaagtaattgcagagcagcacaaacgtgagaatcagtaaaagatatatcccatcctgtaacacataaataagaatcttccgggattctgtaatccgtgtgattgctgtatggaaactgatactgcagaccgtcgccatcatcaggcaaaccgttcccgctttgaagataatcaggctcttctctcttaccgtataggaagaatgcagcagcagccagcagatgatgcagagcacaatcgcgctgatatcggctacataagtataattctgatagaacaaaacatccgtcataaactcattctccccttcgatcattttccctttatattatcattatacatttattgacagcagatttcaattttttcacgcaaaatgacagcaaaggggcagagaagcggtaaagcttctctgcccctttttctgtcatctttggctgcacacgcctattcgtagcggagtgcatcgataacttccatctttgacgccttgttcgccggataataaccgaagaacactcctgtcagcatcgagaagaacagtgacagtaaaattgcagttgccgatggatgcacctgcataataatgtaattggaatactcggaatacatattggcaatcacaaacttcgctgcctggccgagcagtgctccgacaccaacaccgatcagaataccgataatgccgccgattaagcagagcatgatcgcctcaatgacaaactgcatacggatcgtccgccgctttgcgccgagtgccatacgcacaccgatctccctcgtccgctccgtgatcgacacaagcatgatattcatgacaccgacaccgccgacgatcagcgagattgctgcgattccggatactgcaatcgtgatgacattgagcaccgtgttgatcatgcccatgctggactgcatgttgctcgctgtcacatggaaattcgtattgttctgatatacctcatcaaaataattctggatatcttccgttgcctggttgacatccgcaaggggcgtcaggagcagatcaaagtattcataaccagtcttatctgccccctgcagcttgaagctggtctggatcggaatcatcatataagtggaacgatccttttctctgacagatgtatccacttttccaaacagtgccgcattgtatttgtaaacacctacaacaacaaaatcatagatcgatccgtcgtccattgttaccgataccgtctcgccaatcgggtctttgtctccaaaataattctttgccatcgtatccgcaacaacgcagactcttttcttccccagattgtctgccctggtaagattacgtcccgcctgcatctcaagcttcatatactcgaactgttctggtgtcatgccatccacactgacattggcataattgtcggaatccgcctcatccttgatctgcccgcctccaagataattctcggcagcgataccctgaatttcatccggatactgcgcaaccagttcatcgatcatctcctgtgacacataatcactctgtgtcatatccggataaatccaggtatcccagtctgcatcgtcctccggatagcgcgcctccacatagccggaaactgtgttgccgccgagggaattcattgtcgcggtcagggtgctctgtatggaaccgccgatcgtcgtgatgatgataacggaactgataccgataataataccgagcatcgtgagcagtgaacgcatcttgttcgacagaatactgatgattgcctcttttatgttttcaaaaaacatcagtgctcacctcccctgttgtcccccacgatctcaccgtctaagagggtaacaatacgctgtgtctccgtcgcaagctcctgggagtgtgtgatgagtacaatcgttttcccctgctcttcatgtaaccgatgaaacagatccatgaccatatgtccggtcttggaatccagcgctccggtcggctcatccgccagaatgattgcaggatcattgatcatcgcgcgggcgatcgccacacgctgtttctgtccgccggagagctcatttggtctgtgatctgcacgcccgtccattcccaccatcgccagcatctccatcgcacgctccttcgcattcttcgtcttttcctcaccatatataagcggcaccatgacatttttcaatgcattggctctcggcagcagattaaagttctgaaacacaaagccgattctgcggttgcggaccgcactccgcacctcgtccgtcatgccgttgacgtcctgtccttccagataatagctgccggaggtctgtctatccaatactccaatgatattcatcaatgtactttttccggaacccgactcaccgacgatggaaacgaactctccctggttcacggtaagatcgattccgtgcaggatttccagttcattgggcttacctacataatatgtctttacaattttttccattcggattactggttcactcactattcgctaacctccgtacctgtaccgtctgtcagtcccatatcctgttcagaatacatctgctccggtgtaaatgtctgtccctcggctatcgaaaatgtcgtgtcgtagatcagcatatctccctctgcgagatcaccgccggtcacttctgtataataatccacctcatcgccgaccgtgatattcctgcgcactgcggttgcgtttccgccatcgtccgcctcagccacaagaacatacgcctgcccgttgtcatcatactggatcagatcatacggaactgccagcacttctccctttgcctggatcatgacttttgccttcacagccattccgattaaaagttcctgattgtcgagcgcgatctcaatggaataaccaccggcagaagtcgtgctgccgtcgcttcccgtcgtgccctgactcttcacacggaccactctggtcacggttcccttgatctgctcatcacccgtcgcatctgcggtcacagttgcctccatgccttcctgaagctttaatacatccgcctcctgcacggttgcaaccatctttaaggagctcgtatcctcaatcgtcatgatgacgttcttctctgcattgatgtctccgaccttggaattcaccgctgttaccacaccgccgcacggcgctgtgatctcgcagtctgccagctgttctttcagattgctgagtgtgtccttggatgtcgtgtcggtgtctttgtacttgttcagctcctgtgcctcctgtgctgtctcaatcgcacggttggtggtctctactgccgtatcataagcagtctgcgcatcctccaccgcctgcttggcagcgagcagtgcagcgaaatccgcctgtccctgatcgtagagcatctgtgcgccgttgtagctgtcctttgcgcggtcgagtgtcttctgcgccgccgcaagcgtcgttgtctggtcatccttcgcctgctgcagggcgtccgccgcctgctgtgtattgatgctgctcaccgcattcgcattcgacatggacttctctaagtctgcgatcttctcctcgatcgacgtggagtccagtgtgcataagacgtcaccctctttcacgatatcgccgacctgcacattcatggaagtgatctcggacgccgcctttgatgtcacattcgtgctgctggctccggcaaccgttcccttaaccgaaatcgtatcggacagatccctcttctgtaccggctccacttccacggtattcaccgccatcgccacctgcttggtcgcgttatgtatggatataccgatccagaccaccagaactgccacaataaccagcacaacgatcagtaccttctttttcttctttggctttgctgctatcgcgcctgcattctgctcgtttttttgcttcttgtctttcattctcgtctctcccttacctgtattttacaaatttatggtgattgtatcattatcacccctcaaaaaaaatgggtttaagtaaaacttaagaattcttaggaaatcctaccatttttttaaagtttctttgtactattgtaataatacagtatgttcatttgactgtcaagacattttctcagacgtaaaatttttctggaatacagacatcatctctctggtcagcgacagcccctctggatcttccggcacatccgaataatgcacccactccgctgtcgcaagctctcccgtgtccagcacaatatcccgctctccgtccagttcacagaaataaccaagaagaaggttctggtcaaatccccacggctggctcttataatagtggatattcttcaccttaagaccgacttcctcctgcacttcccgcatgaccgtctcctccgccgtctccccgatctccgtaaatccagcgatgagcgcgtaccgtttgtactccctgttggcgtaggttgtcatcagaatatactctccgtccgtcaccccgacaatcaccgccggtgcgatctttgggaacacctggttgccgcatgcgggacagaataacatccgcagcgttccgttgtgcatgagtttctgtccgcatcttccgcagaaccggttatcccgataccactcgtacagatgccatgccgtggcagccgcaaggatgtgctccttcggctttcccgaccgcaccgcaaacattttttcaaaacagtatccttccggtgtgagatgctccggcagttccgtcagaaaatacgtctcctccccaacggaaaacagatagatgctctgcggcgccatttctcccgccgtctcacagatctcccggagttcccggtaagtaaggaaggcaagcgtctctccctcccttacaaggatcttgttctccctgtagatcatcatatagctggtatcgtccggctgttttttttcgtactgattctgcagatgcagtggtaaaatatcctgtatcatctcgtctctccttatctaacataattttccatgaagcaaaaaggaactgccgcaataagcatatcatgctttgcgttgataagtaatattatgggaaatagatacttaaaagttccagataaacatgcggcggcaaattctaaccgcaaaatccggtatttctaaccatgccgcagctggcatcttcgatgatccgtgtctttccaagtttggagcactccgcgggtcatgtccgcatcccggaagacaatttgtaggacttttgtgtgtgtcccttatggcacctctgaacaaaacataaccgcgcgaagccgctgtttgagtcggcatctgccctattttcaatagcagatgccggcgagttcggttcgcgcggttttatattgtctgtgaagaggtgccattagggacaccagaaagtccgcccattgtctccggtgtgtcggacatgcacccgtcggattgtccaaacgtggaagagacacggaatctgatgtcagccacggcatggaagaaatacacgaattttgctccaaagaatttgccgccgtctgtttattctggaacttttttgttctctggtattcctgtaatattacttatccccccaaagaggtctatgcttattgcgacaattccatgcggcagacagactacattcccgtctgctctcccgccgctttgatctgtgccaatgccgcctcggctgccacgagcacatcgtaatttgtcacattcgcctttgtagaatccggcagagcatcatactggctgcgcgctgacgcgatgaccgtctcactgtccgccgttacctcaccgatggaattgatcagatcaatcacggtctgcacatcctgctgcagctgtgcggcgctctctgttcccggaagcgtgtacaccagtaccggccagcccttctcgatcgtattgtagatcgtctttgccacggatgtcggcagattgatgcatccgtgcgatccgtttgtcttataaatattcccgccgaagctttttctccagctcgcgtcatgcatgccgacgtctcccgcaaacggcatccagtattttaccggcgtcgcgtagtcctctccgcgcagcacggcatccgtggtcgtataggtcacgctgaacgctccggtcggagaaccgtgtccctttgacagatttcccgatacaaaatcgctgtccacaaccagacttccgttcttgtatacaaacagatgctgcgatgtcaggttgatctccacgtaggaattgccgtagtcattctcgccatggctgttcgctgtctgggaatagaccggctcacgctccacgctcttgccggacttgatgtcctcaagcaactgcgcctcctctccttctgtgtcaatcttccagccgtaagcgccgtttgagatcgttacttccggtccataagacgtctttaacgtcttcggtttgtacgcggtattgtaggtctttgcaagtcccttgacatagtcgagcaccgcctcctcgtcgacctccagttcaccatccagaaccgagagccactcgctgatcgtactgccatccacaacttctgtctgatccccgaaatcgtaggtaaccgtcgatgcgacgtactggtttaattcgtcgatcaccgcgagaagatctttgtcatcgtctcccaccgccgggtccacataacagccgctcttctccaggtcgagtgtgtcctccagcccttccacagcttctgccaccgcattttttaacgctgtctcatcgatcgtcgttccgtaatccgccgggacaagcgtataaccgtccgctttagaatagccggagcaggacgcatccaccggctttctctgattctcctcctgcatgcaggaaagtgcttcaatcgtctcagaaaattttgtatcgtcaaaggttactgttttttccagttccagcgcgctctttccaaacagaatggcaggccatgtgaaggcattctggtccgccagcagctgctcgatctccccgtggaaaaccggcgccgcgccgatctgtgatgccgtgatggtctccgtctgatcctcgcgttccaccagagtcagctcatatcctccgatctcctcctctatgagctgctccacctttacggtgctgcatcctcccactttaatgccatctatcgtagtgccaaagcagaagtggctctggaaaaacaccgcgaatccgatatagcagactgcgagtattcccagaatgactgccgcggtaatcccgattttctttttcattttctgtttcctttcctcttatcgtaaacatttatatgcctgttctttcagtgaaaacacatggtttattataaatgaccctttttgtttgtcaacaacttcccccaatcgtaacaattatgtaaaatcttcgttttatttcttattgtataaatgcacaaacgatctttcgatgtatgaacgttttcttaaattttaaataatctttcttaaaaaaagagaaagccgattgtttcgcagaaatgcgtgtgctataatcgcaaacgtgaagaaattggatatactgctatttattatagaaaggatggatattatgaaaccagaacttcgtcagagaatcagtggctttattgatcgaaacaaggctctgtttcttttatcttattttgcaatctatcttccatggtttggtcatctcgagaagaccgtcaccacacattttcatgtcattcacaccgcgctggatgattacattccgttctgtgaatattttatcatcccctacctgttatggttcggctacgtcggctggggcatcggttatttctatttaaaagaccgttccgaatatttccggctgtgcgcaatgctgtttaccggaatgacaattttcctgattatgtccaccatttatccgaacggacattacttaagaccgacaacctttgcgcgggataatatttttgtacatatcgtcaagtggctgtacgcttccgacaccgcgacgaacctgtttccaagcattcatgtatacaactcgattgcggtcaatattgcggtatggcgttctgatgcgttcaagcacaagcacgcaatgcgctgcggttccgccatcctcatggtgagcatcattctctcaaccatgtttttaaaacagcactccgtcttcgacgttgtgacaggtatgattacggcagccggcatgtacatgatcgtctatgtcaacaatccgttccgtcttccggttcgtcaggaaaaatatgagcagaagctgcatcggatctgaccctgagtaaagccggacggcgactgattgtaccattttcttttaaaaagataagtaatattattagaagatcacaccgcgggatttcagatggaaatgcaggtggaaattcggatcaaaaaatgtggcatttctaaccagccggatgtttgcatcttcgatgatccgtgtctttccaagtttggagcactccgcgggtcatgtccgcatcccggaagacaatttgtaggactttcgtgcagcacttaccagcaccaaacaacggatggcataaatcagccatccttatgttgcagtaaaacataaccgcgcgaagcagatgtctgagttgtcacctgccttaatttcaatagcaggtggcaacgagtttctgttcgcgcggttttatcatgtctacgagggagtgcagttagtgctgccagaaagtccgcccattgtctccggtgtgtcggacatgccccgtcggattgtccaaacgtggaagagacacggaatcagatgcaaacattccgtcggaagaaatgctcacatttttctccaacgaattcccagttgcatttccacatgaaatcctcaagtgtgtttcttataatattacttagcgcgtattcttttcataaagcggttgacttccgagaagacagatgataatatagtattcatataagattactatgaaaaaagatctggagatagggtataaagggaggaactgatatgaagatttccacgaaaggacgctatgggatccgtgcgctgattgatctggcggtgaattccaccaatggtcatgtgtcgctggtaaatattgcaaacaggaatcagatttctgtgcactatctggagcatgtgttttccagcttaaagcgcggtggtattgtcaagagcgtcaaaggcgcgcagggcggctacgtccttgcggataagccggaaaatattacgtttgcacagatgatcctcgcgctggagggcagctacagtatcgagccggaatcggtgaacgaggatgcactctgcgagacggtgtcaaaggtgatggacacgctgttgtgggatcgcgtgaacgaggagacgaagcggatcttagagagcattacgctggcggatctggtgaatgaatttgtgcgtgagtacgagaccgagcagaatatgtattatatctaatcggaaggaaagtacacatttcttttataagtgataagtaatattataggaagtatgtcctgcgatttcgggtggaactgcatgtggaacattcgttgaaaaaaatgtgtgtatttcttccagccggatgggctgcatctgattccgtgtctcttccacgtttgaacactcccggagggtgtccggcaagccacagacaatgagcggacttcctggtgtccctaatggcaccacttcacagacaatataaaaccgcgcgaaccgaaactcgttggcatctgctattgaaaacatggcagatgccaattcagacatcggcttcgcgcggttatgttttgttcagtggtgccaataagggacacgcacaaaagtcctaaaattgtctgcggcttgcggacaccctccgtggagtgctccaaacttggaaagacacggatcatcacagatgcagtcaccggctggttagaaatgccgcattttttgaacagaatgtttcataggcattccaccagaaatctgcatgtaatgcttcctatcatattacttattgcaaaaggtccgatacttatacgttattctacgcttcgaccgtgcgctctcccgacttgatctcgtccaggatttccgctacggcttcgcgctcgtcaaaatgatattttacacccttgatctcctgataatcctcatgccccttgccgagcagcacgatcatatcccccggctttgcatgcgtcatgcagtaggcaatcgcctccttgcggtcgtcaatctcgatgtattttccgttgctttttgccagaccgaccttgatgtcggcattgatgtcgcggatttcttcatcgcgcggattatcgcaggtcagaacgcacagatctgcaagttctccggtcacctcgcccatatcgtagcgtcttaacttggagcggttgccgccgcctccatagacacaaatcaggcgcttcggatggtactctaagagtgtcgtcagaacgcttctcgtgctcacctcattgtgcgcataatcgataatcatcgaataatccttcgaaaccggaaggatctccacacgccctttgacctgaaccttctcaagtccgtcgagcactgcccggtccggaataccggcaaggttgcacaccagcatcgtcaccatcgcattgtacacagaaaacctgcccggaatatgcacttttaccttgcagtccatgcagccgctcacggtaaaatgcatgccgagtctgccgccctcgttgatataaccgatgtccgacgcaaacagatccaccacctggtctttcacatcatttccctctgcggaaaatgtgcgcacctgacaggtgtgtccctttaaaatctcctcccagtgaggatcatccgcattgacgatgccgacacggcactgccggaacagaagactcttgcagtacagatactcctcgaacgactcatgttccgccggtccgatgtgatccggggaaaggttggtaaatacgccgtaatcaaacaagatgcccgccgtgcggtccagcttcaatccctgtgaggacacctccataaccacatactcgcatccggcttccaccatagccgcaaacatccggtgaagttcataggactccggcgtcgtatttttcgatgggatgtgctcatcaccgatcatcgcgccgatcgttccgatcagtccgaccttcttccccgccatctcaagcacgctcttgatcatgtaagtcgtcgtcgtttttccctttgtacctgtaatgccgatcgtgaccagcttacggtccggatgtccgaacaacgccgccgacatgtaggcaagcgcacgtctggctgattccacttgaatgaccgtgatttgatccggaatctgctgcgcctcatcggcacgctcgacaacgatcgccgacgcaccctttttcaccgcatccgggatgtatttatgtccgtccgtcacagctcccaccatgcagacaaacaccgttccttctgtaatcttccgggaatcatagatgacatcccgcacatcgacatccatgcttcccgagagacactcgtatttgaattcactgcaaagttcccttaacttcattttatctccattcctgcgccacaatcgcgcatcttatgcactgctgcttatctgcgcctcttatccgatgatgtgtgacgcgtcgatttccgactcgaataccgtgtgggaaggtcccgtcatgaacagatgattcgtcttctcatcccactcgatgaaaagcggtccgccgatctgctcgaccgtcactttccggtctgtccgtccggtgaggacgcctgccacaaccgccgtcgcacagcctgtcccgcatccgatcgtctcgccggttcctctctcccactcgcggatcttgatgtaatccttccgcacaaattccacgaatgtcacattcgtcttattcgggaaaatggatgtcatatgttcaatcgtctttccatagccttccacatccagatctgccacagaatccacatacatggcgcagtgcggattcccccaggataccgccgtgatgtggaatgtccggtcaagcacctgcaccggctgctccacgaactcgggcagctccgtgactaccggaatcactgcggtggacagtctcggctcaccgatgtccgcgcggatattcgataccagcccgtcggtcacggtgagggtcagatgctgcattccgccaagtgtctcgatcacaagatctgtcttgtccgtcaacctgtgatcgtatacatattttccgacgctgcgcagagcgttgccgcacatttccccctccgtgccatccgggttgaacatccgcatacggaagtcccctttctcggacggacagatcagtaccattccgtccgaaccgattgcaaaatgacggtcactgacaaaccgcgccaactccggcagattctttaattcctgatgaatcgcatcaatatacacatagtcattgccaaatgcctgcatctttgtaaatcgcatcttctcaccaatctcctttatcagccgttcattgcgcgatccagatcggcaatgatatcctctacgttctcaattcccactgacatgcgaaggaagcagtcggtgataccgagcttctccttgatgtctgccggcgtgtcctcatgtgtctgtgtcgtcggatatgtgatgagagtctccgttccgccgagactctccgcgaacataatcatgtctacgccctttaagatcttcttcactgtctcaaaactgtccacggtgaaggaaatcataccgccgaatcccgtggtctgctttctcgtcacctcataatccttgtgatccgcaaagccgacatagtagacttttttcaccttcggctgtgtgcggagccactcggcaaccttcatcgcattttcattgtgacgatccatgcggactgccagcgtcttgattccgcgcagcaccagccagctgtccagcggcgcgagctgacttccgtgggacttcatatgaatatggatctgatcggcgatctcctcgttgtcttttattaccacaatgccagagatggtgtcgttgtgtcctcccagatattttgtggagctgtgtgtgacaatatccgcgccaagcgtgagcggcttctggaaatacggagtcagaaacgtgttatccaccaccgtgagtgcattcacgctctttgcgatctcagagactgcgtggatgtccgccaccttcatcatcgggttcgtcggtgtctcaatgaaaaacatcttcgtattcggccggatcgccgccttcacctcatccagatccgacatgtctacataggtatgctcaataccgtattttccaaaaacgtccccaataatgcggaaggttccgccgtaaatatcatccgataaaatgacgtgctcgcccggattcaacagggaaaagacagccatgtttgccgcctgtccgctggaaaatgcgaatcccttgattccgccctcaagaattgccatcgtgcgctccaattcctgtctggtcggattctcgagacggctgtatgcaaagcctgtcgactcgccaagctccggatggcggaatgtcgccgcctggaaaatcggcatgctgactgctccggtaagcggttccgttcccagtgcgccgtgcacggccttggactcaaagtgcagattttcctttgtatcaaaatcggtataattactgaaatttttcatgttatttccctccatctgtttggacatgcgtttcctcatatacaactattatacaaaacactttttataatatatagtctcaaagtgctttttatattgcaaaaagtgcttttttataatacagtaatagaaaaaggaggacgcacgcgatgccggaatacaaaaaggtcggatacttaaccaccagctttaagatgtttcatttaaaagatacttcccgccgggagtttcactaccactatcacgattttcacaagatcctaattcttctcggcggtgacgtgacctactgtattgaggggcgcacctaccagcttgccccgggcgatattgtcctggtcaatgccggggaagtacacaaacccgagatccactcggatcttccctacgagcgcatcattttatatgtctccccggattttcttacggagtacgccggggaagactgcgatctctccttctgctttaagcaggcgtaccgcgagcaggcacacatcctccgtctgcaggattccaagggcggcaggctcggcgcctccatccgcgcgctggacgcctccttaaacgacgacgactatgcggcggcgctgcaccaccggcttttattcctggaatttatgattcagctcaaccgcgccgccctgcaccaccacattgaattcgtgggagactccgcttccaacgagaagattctctcgattctcacctatctaaacgctcatctgaccgaggatctctcgatcgatgacctggcctcccgcttttacttaagccgctcctacctgatgcacacgttcaaggcgcagaccggctacaccatcggcggctatctgctcaccaagcggctgtttctcgccaaagagctgatcgccgccggcacgccgatcacggaagtatgctattcctgcggctttcagaattactcgaccttctcgagagcatacaaaaaaagctttggggaatccccgagggattaccgccaaagcctttaagctatgttcacagagcgagctacgctcgctctgacatctcattcatgagtgtaggtatcatctgtttcttacgtgagataatgccgtccaacaggatgccatccgcatcctcctgcttcttgaacgcatgcgccagaatttttccagcatcctcccccgcaaatataatcttggaagattcctccaaaatatccgtcagcatgacatataccatatttaaacgcttctcgccgagcacctgcggcaggaacgggcggagctgttctccgatctgttctaattcctctccgctcatggcgctgatctgggcaacaccgaaatcacagtcttccgtgtggaaaatcttaaaatcctgatagaaaatctcttcggtcgtcttgttcttgaaatcacttccggcgcggaacattttctttgcatgatcctcaatatccacgtccgcaatctctgcgagccgctttgcaacgcccttgtcaaacggtgtacaggttggcgagcggaacatcagcgtgtcggaaatgatcgctgagagcagaagtcccgcgatctccttcggaatctccaccctctgctcctgatacatctgatagataatcgtcgacgtacagccgagcggctgattccggaaataaaccggcgatacggtctctaagcttcccagtctgtgatggtcgatgatctctaagatctccgcctctccgattccgtccaccgcctgtgacttctcgttgtggtcgacaagaatgatctgttttttctgcatattcatgaggttacgtctggaaatcattccgacgtagttgccgtttgagccgagcaccgggaaatctctgtggcgcacccgcgacatgacatccttgacgtcgtccacataatcgtcaatgtcaaacgtgacgagctcccgtctggtcatgtactgcttgatcggcatactctgattgatcagacgcgccacggaaaatgtgtcgaacggcgttgtgataatcacgcagtcccgcttctccgcaagctttttgacttcttccgccacctcgagaccgccgccgatgatgatgcagctcgcgttcgaccggatcgcctgcatctgcgcctcctcgcggtcgcctaagatcaccagatcgtcgtcctcgatataatccgccatgtattccgggttggaggttgcaatcacaacttttccgcgcacaaaatgtgcatgctcattcccggcgtagacctcaccgtcgatcgtctccgcaatcgtcttgtactgtgtgcgcgcttttgagagcacgcagttgtccagcacgtccatgtaggacgtcgcaatatccttggtgacgatcacaccttccagcttgccgaactgattggtgaccggaagcgttacaacctccagctttttcatcagctcccatgcccgtttcagcgaaatctgattgctgacaccggccgtcttgcggatattgatatccttgatctgtgcaccggcatagctcacaagcggcggttcctccacgccaaagcgctctaatacgtagcgggtctcctcattcaccgcgcccgcacgctttgccacataagtcttcttgtccccgctctggtttttcagatatgcataagaaatcgcggcgcatatcgaatccgtatccggattcttatgccccacgacccacactttctttgattctgtactcatatgatcttctattccttaaagctaaaaattaaacacaccgagagaatacaggatgaatccgatcagaacaacaaagttcagaattgcaaaccaggaaagacatttgacatatcccttcaccgatccgactccctgctccatctcgtccatcttctcgatcttggaatcaaattcgttgaacagatcctgaatgttgcggtagcacttcacgttctccgaatgtaccttctcggagagatctgtcttgatggattccagctgtgctgtcgcattctcaagcagcgccttgacctcggcgatctgtccctcggaaagcttcttgttcgcgattgcctgctcctccaaaaactgcttgtttgtcgcaagctgctcctcggaaagctttttatttgcagcaatctgatcctcattcagcttgcggttcgatgcaagctgctcctcgctcgcacgctttacctccgcaacctgccccgagatgcttgtctcaatctcggtcatcttcgctgtcacacggtctgccagatcatcgaccttcttcgtgaactctgtcacgatcttgtcagcttcctcctggcgctccaccagaatgtgctgccattcctcggccttgccttcccgctcgttgacaatcgactgcagttcctgtactttattctccttcgctgcaagcagatcctgcagctgtttcgccttctcacgaaactcgtcgatctgacttaataagaaatcttccttttccacttctgtctgtatcctttcccgttcctgcgtgctctccccggtctctaaaaccctggtctcccgaaccttattattgctctcgcgcttcgggtgtgtcttatatccctccgcccgttccggctctcctgcaggtcttccttgtctggggtgaatctgcgccagtaaaagctgaaacaggtttgccataaacgcttcctccctttgtgtcttccgaacaaaaaacacctatgggtattctatcattatcatttttctttgtaaagcaggaaaaagcaaccgcctcccgctcactctttccggcggaaaagcaatggtgtctccgccgccagcattgccagccatccgatcaggtaggcaaccggcagtgccacaattccaagtttcatggaaaataccagcggaatggctgccgccacccgcactcccatgttgataaaactgctgctgagcgtcaccttaaggtcgcccattccgcgaaaatatccctgaatcccgtttgtggccgccggcagaaaatacatcaccgcaatcgcatgcagatagatcactcccagggagatcacttcctcatccgtcacaaacagcttcatcagcggacgcgcaaacacaaagcagaccacacagataaagagcgcatagatcatctcgatccacagcccgcagcggaatccctcccggatccgctcctttttgccggcacctttgttctgtgccagcagcgcggtcatcgcatgggcgatattctgctccggagtgtaggcaaaatcatcaatgcggtttacgactgcaaacgccgccatgacagagattcccattgtattgacaatcgcctggattccgatcttgccgagctgtaccgtcgcctgctgcatggcgctcacccagccaaactgcaccgtcttataaaataacctccggtcaaacacgcgccacttgcgccccaggcagagaatctttacctttttcttaatatatagcccgcacagcagacagcagagtgcctcgcttagcaccgtcgaaaaggcacatccgttgctgccccagcctagcaccaccacgaaaaacaggtctcccgccacattgagtgcagcgctgatcatcagaaaataaagcggcgatctgctgtcgccgagtgcccgcaatgtgctcgcataaaagttgtaaataaacgtaaagatcagtccgcagaaaataatgcggaggtaccccgtagcaatcggaagcacttcctcctgcgtccttatcagccgaagcagccacggcgtcagaaaaacgcagacggctgaaagcaggacggaaaacatcagcccgccgatcatggttgaactgatctgccgctccaggacatcataatcctttgcgccgtagtgcattcccatcagaacgcctgctcccatgcacatgccactgataaacagaatcgcaagcgtcatcagcggactgctcgtaccgaccgcggcaagcgccgtctcccccacaaattttccgacaatcatactgtcgaccgcattgtagaaaagctgaaacagatttccgagaacaagtggaattgtaaaacctaccagaagaggcggtatcgctccttccgtcatatcctttgtcattgcagatgcctttctatcttttgttattctgcttcagaatgtgtatgatccttccctcataatacaccgcaatcgctgcaatcaataccacgataatcaggctgtatccctgttttaattctttcccgagcgcatcacagacgctggtgaataaaagtccctccacaaagacaagcttgaccatccgaaccatccgaagcgtatactgtctgatcttaccgctgcatatctcccttgtcaatccgttcacacgttccgggtagacggcaaggagggtcagacccacatataccagaatcataaacacaagattcatcatcaggttcaccggattgacgtggaacgcgatcccgtaatagatctgtaacccgagataggcgatcgccgatacgataccgactgcctcaatgagcatcacctgccatgtcatctcattctttttcatatgtctcacacctccttttccctctctttttcttacagcaaaagttcctgcgcccagcactgtgtcagccgctctaaattccatgcggcattggcaggactcgtagacggcagcttctttacttccggcatctccgcggtcagacaatatttagaaaacaggcggtacgccgtatccccgttggcacagatgcgccggatgtccgccgtctttaagatcacttccatgtcattcgccgtcacattgcggatcgaactgtccgatgatcctgcaatgtcacaggaggcaatgacatcccacagcgcaatatggtgctctaacaaaaacgcctttttctgcggaatcgtctccggcagcgtatcctcaaagaccgctgccagcactttccagaaacggttctgcggatgaccgtaataaaactgctgttctctcgactttacagacggaaaggatcccagaatcagaatccgggatgcatcgtcataaacaggtccaaacgtatgtgtcacatgcgtatattccattctcttacaccaaaacggcatcagtgcagaccgcactgatgccctcttccctctctattactgataatctgccacattggaactgtccaccttctcgaacggtacccagacgtaaagtccgtcgtccgacaggccttccattccctgcgtcgttcctccggaaccgagtgcgattgccgccttgacagccgcctcaccctgtccgcttcccgactggtatacggtaaatgccatatcccccgcctggattgccgcacagccatctgctgtcgcgtcaattccaagaaccggtactcccgatatgccattcttcttgcaggaatcgatgactccaagcgccatggtatcattgttgcataccaccgcatcaaactgcttgcctgtctgcaggaacagatcgaaataatcttctgcaattccctgctcccagtctgcgttatcctcaaacacgacgttgatcttcttgccggatgccttaagcgtatttttgaactcctcggatcttcccttggttgcggaatgattcttcggtccctttaagagtaccacattgatctcgtccttgtcactcatctgatccagaatatattctgcctggtattgtccggcaactccctcatccgatcctacataaatgtatttgtccggctccagcaccgatgcatccgggcagctgttgtaaaagacgatcggaatgccttctgccagcgcctccagttccagcgctgtgtccgcgtctaccggaccgcacatgatcacatcgtaatcttccgcaaccgcctgtttgatctgcgccacctgattctcgatggaattctccgcatcgtacaccgcaatctcagctccgctcgcctcggccgtcttcttcgccgcatcaatcagtgtattacggaatgtatccgcctgtgacagcgagacataaatccggacgcccttgccgtttaccgcggtatctcctccactgctgccggcctggcagcctccgaggcatgtcactcccagagcagctaccagtaccgcactcatcaatctcttcatatctgatacccccttaaatacgaaacagcttaacctgatccgccagctgtatggacgactctgtcaggcttctggattcttttgccacgttctcactgttctctgcaattccttttgcctgcgtcagcatggactctgatgttgcaagaatctcatctgagcttgccgcctgctcctcggaaattgccgccacgttggtcgctacttcatctaccttgttgatcttgtccaccatctggtcgatcagcgcgcttgtctgctgaatgttgtcataaatcttatcaaaggtatcgattgccgtatgaatcaatccgctgctctcattgatattgtcggcgctgtcgcctgcctgacgtactgcatccgccacaagttcattgacctcatggatgagctttgaaatgtgctctaccgatgcggtgctgttgcttgcaagcgttccgatctcagaagcgacgactgcgaatcctcgtcctgcctcgcccgctcttgctgcctcaatggaagcgtttaaggacaggaggttggtctcctccgcaatatttccgatcagctgtacaatctcaacaatctcaccggatgccgtacctactttatttaccgccgcttccagattctggatggaaatgcggatattctcaagcgcctcaccgacatgctccatatcctcgcgtcccttctgggatacttcgacagtctcacgcatcttgttgccgacattcacgctgtcgtccttcgtgtccgcaaccacgccggcaagcttggtcgcattgtctgcaatctcattgacggaaacggacagctgatccaccgtcatattcagttcgctcatggactgggactggacattcgccgccgactgcatctctcgggacacactgtcgctcgcatctgcctgcgttcccagttttccggaaatgtctcccatggacgcaatcatctgcttcatggatgtgatgaagcgctccacactgcggctcataagcgcaatctcatcattgccgctgctcttgaccgatacggtaaagtcgccgtccgtcatcgccctgatgacgttcgtcagcttgcggacaggtgcgatcacaacgtgcgttgtgcgctcaattaccacacacagaatcaaaatggagatcacactgatcagaatcatcagattcctgaggttcgcaaggtctgccagtacaatgctggtcggaatataggaaaccagaatccagttggttccggatacctccttgaacacggtcatattgccgtccaatgtggaaaagctgtaatcacgatccgcaatcttcgctgctacgctctgctcgaatacactgctgccgtcgctgccgagcgtcgtggaaatcttcgcagaatcacggcttgccagaatcgtcgccgtatccttgtccacaaggatagcctccgcattcttcatcttgataaacgcatttacaatgacggaaatgcggtcgagcgtcatatccgctgagatgactttcatcttgccgctgccgtcatttaaaatgccggatgcactgatgacgctgacgccttctgaattaacataggaagatccgatcgccatattgactctggtcagtccctcctgataccagacactgttgacaggatccgactcactcatcgtcgaatccgacgctttccagagctttccggtctcatccgcgatgtaaagtccctccggataattcgagttataattatagtaagaatccagcatggtctgtaattccttatcgtccggcttcgtgttctctatcgttgtcttcactatctggaacgccccgatattctgctccagccagccctcaatctgcgacgcctgattctccaccgatgactccagcagattctcggaatagctctcaatcagtcctgccgacgtgcggtaggcgatcagtacgagcaccagaatgctgacaatgacaaccggaacgatcacacctaaaagcttaactttaatcgatacgattcctttttccttttgcatgtgcctcaactccttttctcttgtaataccacagattctatgataattgcataataatcttgttaatattttctcatttttacatattactgtcaacagctatcgacggattcccgccctgaagttgtatgtttgtaccatttccaaacacgctgccggtctaaattgtatacacgtattatttttcaaatacctgtatcttttcttgaaaatgaactgccctgtgctataattatttaggttaatgtctacgcttttgcgtacacaagagaggagaaccccagatggacaatttaatcattccaaaagattatcattctgaattgaatttgcatgatacacagattgcgatcaagacggtcaaggactttttccagggactgcttgcactgcgcctgaatctgtcccgtgtatccgcccctctgtttgtagacccgctgtccggtctcaacgacaacttaaacggtgtggagcgcccggtcaccttcgatatcaaggagcagaacggcagaaccgccgaggtcgttcagtcgctcgccaaatggaagcgctacgcgctcaaaaaatacggcttttcttacggggagggtctttacaccgacatgaacgccatccggcgtgatgagattaccgacaatatccactccatcttcgtggatcagtgggactgggagaaagtcatcaagcaggaggagcgcacgctcgacaccttgaaggaaacggtgaacatcgtatacaaatgcctgcgcaagaccgaaaaatacatggcgatccagtacgattacatcgaggagatcctgccgcacgacatctttttcgtcacgacggaagagctggcggagatgttcccggacaacacgccgaaggagcgcgaatactacatcaccaagaccaaaggtgccgtgtgcatcttaaagatcggcgatacactggaaaacggcgaaccgcacgatggacgtgcaccggattacgacgactggtcgttaaatgcggacattcttgtatactatccggtacttgacattgcccttgagctttcttccatgggaatccgcgtggacaaaaaagctctgctgtcccagcttaagaaggcaggctgtgaagaccgcgcgaagcttccgttccagaaggcgatcatcgacggcgagcttccttacaccatcggtggcggtatcggtcagtcccgtatctgtatgtttttcctgcgcaaggcgcacatcggcgaggtgcagtcctccctgtggccggatgagatgatgcaggcatgcgaaaagagcggaatccagctgttgtaggcctcgattaaaaaaggaattgccgcgataagcatagacctctttggagggataagtaatattacgggaaatagatacttaaaagttccagataaacatgcggcggcaaattctgaccgcaaaatccggtatttctaaccatgccgtagctggcatccgtgatgatccgtgtctttccaagtttggagcactccacggactgtgtccgcaagccggcagacaattttaggacttttgtgtgtgtcccttatggcacttctgaacaaaacataaccgcgcgaagccgatgtctgagttgccatctgccatatttttaatagcagatggcaacgagtttcggttcgcgcggttttatattgtctgtgaagaggtgccattagggacaccagaaagtccgctcattgtctgcagcttgtcggacacactccgggagtgtccaaacgtggcaaagacacggaatgggatgccagccacggcatggaagaaatacgtgaattttgcttcaaagaatttgccgtcgtctgtttattctggaactttttggttcgctggtattcctgtaatattacttatcaaaccaaagaacgatattcttattgcggcaattcctttttatctcctttattgctccagcagccccagaaagatttctctccgctccacttcttccgcctcctcatttccgtctgcccttgcgtgcagcagcggatattttgaccccgtgcgcagcatctccatcaccgacgcatagttggcatattccggcgacaccagaatcattccttttccacgcggcagttcctgctccatcaggctgcacagatagcggaggtttgctccgtgaaccagcggaaacttttcccggatctcctgtaagcgttcgtccggctgcttccagctgccgtagacgccgcggtaaatctgcataaattcatgcagctgttctgtaaaatgctccggaatctttcgccccgactctgtagcaaggaaccacagatattccgagagcggcatatacaccggaacaaaggcatgtttcctcaccgcttcctccatattctgattcagataagcgctatgcagcacaatcggatcgccggccagcagcagctgtctgtcctccgtcacatataccgcccactcctgtaaaaggcttttggtccactccctgctccaggcatccggcgcggcggtcttctcccggaaagaggcacgcaccttttcccgccactcctcatccaggcagtgccatgcatccccgagtaagagcacctgccacaagatatccgcttcttccgcaaaaagcagctgttccagaaacggtgtcacaagatgcgccctctttccgtccgcatctaagatcgcacgcaggatttccggaaccattccgtccgcctccgcaccctcggtctggaataccagaaactgtttttcctccccgtccgtctcctgcagccggtttgcaatctgtcctgccgcagccgagaatgtacagtattcttttgcggtgctgtacgcttttcccgcatgaagatcctgcgccgtgtaatccggcagcactgccgtgcgttttcctttctggttcaggtaaagtgccatccactctgtatacacggacagcggcggcagatacaccgtctcctgctgcggttctttcatatctttcgtatctttcgtgtctttcttcccgtcccgaagccgcccggacaatacggctgcctccggcagtatggcgcgctccgtgcagttctctacatgggataagctgtttaaaaacgcctcgattctcgttatcactcccaccttggactgatgctcgtccacctctattttcaggtacggcttgtcccccataatttccgcaaaaaggtgggagatcatgccgtccggtccgcagccgtggttcgtcagatagacggcatacagattcggatgctccttaatgatcttcgctcccgacagaatgtgctgcgcaaatggccagtacaaatttggataatgaccggacaaatccacatcatgtcctttcagatgggaaagtgtcaacactctgcaccctctctttaacatttctccgggaattcccatatttaaaaccgggtctgacacgccgtagtttcttgtaatcagaacgagcaccttgtcctccggtttcaactcgtccaggatctgcgcgcccagtttttcagaattcttctcacagcgcaccatcgccgccgcgcccttcgcgagcgccgccgcacaccgtgccttgtcgcatcccagttcctgacccgctttgatcatcgctcccgcgagctgcggttttcccatatccagatccagaaccgggcagatcagctccacgccgcgttccgaaagccccagcacacttgcgacaatccgcggcgctgtctgcatatagacacagccgtaattgtgcgcaacgccggaagtctcatgccggatcgtatggatacacgggataaaaatgtagtccaccttttttctcgcaagccattccatgtgcccgtgcagtaattttaccggataacaggtctcctccgccgccatctcctgtccgagcgcaatgatcttatcgtccgtctccggcgacagcaagacattaaagccgagagtcttaaaatactggtacgccatcgggaaaaatttataaatcatgagcgcacgcgggattcccacagtctttttccccggcagcagcgttccgtcatagcctgccagaaaccatttctggctcttctggtaattctcctcattccggatgctctccttttgggatgtgccaccctgctcttttgccgcgagcgccgctccgtatgccccggtcacatcgtaaaacggcgtgatgtgaagccgttctccaaacacttcatagaaagccgcaacgattccctcgttatgcacgactccgccctgaaggcagatatgttctcccttgcgcttattgccgactaccctgtttaaatagtttctgacaatcgagcggcacagccctgcacagatatcctccttgtccgtgcctgccgcaagctccgctgcaatcttggattccatcaacacggtgcagcgctctcccagatcgatcggcacatttgccttcaaggcactgtttccgatctcctccagcgatacttccatgcggttcgcctgttcctcgacgaaggagcccgtacccgccgcacacactttgttcatctcgaaatcgacgacctgaccgtcccggatactgatgtatttggagtcctgaccgccgatctcaaacacggtatccacctccgggcacagatgggcagccgcgcgcgcctgcgccgtgatctcatccaacaccgtgcctgcaccggtcttctccgcgatatagtaccgccccgatcccgtgacaccaatgccttcccacgtgagtgcttccccgtatttctgctttaactgtgccattccctgctgcaccgcgccgagaggattgccgcgcgttctaagatacagatcgtcaatgacggctccgtcctcccccgtcagcacaaggtttgtgctcgtggatcccacgtcaatcccgagccagagcttttccccgccacgtaacggtctggtccggtgaagtgcctccttctcgtagtcatatcgcggcagcgcctttcttttttgctcctcatccgccacctccctgcggaccgggtgtttccagtcgaaggccagcttcccgtgacatgcacaggctgcgattccggcagcagacaccacagctccctcttccccgcaaagcagttcttcctcttttaatccgaagatatcacagatggcgaggcgcacgccttcattatagacaacgcctcccgtcacaagcaccggcggctgtaccggaagcttccgcacgaccgcagatttaaaattacggatcacggcataggaaagtccgagcagaatatcttccaccggcacaccttcctgctgtctgtggatcaggtctgtcttggcgaacacgctgcaccgtcccgcaagccgcggcacacttttcgcccgtctgacatactccgagtaggcggacagcggaagtccgagccggtacatctgatcctcgaaaaatgctcccgttccggcggcacattccccgttcatggcgtaggagagcgtctctccctcacggattccggtaaggaagcaggaattctgtgctcccatctctacgatgcttcccgcgtccggatagagcattctctgtccttccagaaggctgctgatgcggttgatctgcacttccttttggatccccggatacaaacagactgcaccgggattgaccgctgcatacaaaatcctgtcgccgcacgatgtctccacctgcccaagcatgtccacaagattctgatacagttctccgcgatgcagtctgtaatctttatatatgatgttttcgccttcgacaacaacgatggaaatacttccatttccgatgtcgattccaagtcctgcttttctcattgctttcctccgaaattgcctcttacgcatagttagaatattctaactaaatgtatcacattgcaagagccgtttcggttgcaaaagcaacggaatcagtcttctattagagaaagattctcaaatagtttgatcagtctaacttcaatcctgccagaagcgagccaaggctggttcctgtggatgtgtggtctgtatatgcctccagatcttccacgccttcggtatctaccatctcctctgccagcgccttcatggacaggctgatcttattgtcgttggtattcaatacctttgccttgactttctctccgaccttaagcacttcggacggctttccgattctgcgctcacagatctgtgagatgtgtaccagtccgctcagtccgttgcccagatcaataaatgcgccgtacggcatcaggctctcgacagttccctcaagcacggttcccggcacgatcatagagatcttgtgattgcgctcctccgcctctgcctcgagtgcgaccgcctttccggaaagcacgagcttttcgcgctcctcatccaccgtgatgacccggaccggaatctcttttcctacccagctctccgtatcctccacataagcggatgtgatctgggatgccggaatgaacgcgcggatcccctcaagatatgccacaacgcctgccttcacgctctccttgatgcggacggttgccgttgtaccctcctccatcatctctttgagcttctcccatgcctgctcttcattggcttccctgcgggagagaagaatgttgcctgcgccgtcgtctacccggatcacggtcgcctcgatcgtatcccccacatgcacagcctccgccagtgagaaatccggatcgctgctcatctcctccgcactgataaatcccggtgcataatatttcaggtcaagcgtaacgccctcctcgttgacatcgatcaccgtgccggttaaaatatctccctctctgattctgcggaaagaagcttctaactcctccttgtaatcatccattgattccatgtgtcttaaacctccatctctttttctacctgtagtgtaccacatttcagtctgattacaaccttgaataaatcaccgtccacctcgattgacagttttccgccctgcgcctcggtaaaacttctggcaatcgcaagtcccagacccgagccctccgtgccgcgcgaagtatcgccgcgcacgaagcgctccgtgatctcctccggatcaaaattcagttccgtcgccgacatatttttgatcgtgatctccacgaactcctccggtgcctccccggatgtgtgcacctgcacgtacacgcggctctgcggcatcgcatatttctgaatattgacaaacagattttcaaagatgcggaatgtcttctgattgtcgagcaccacgatcactttttcctccggcacatcccagcgcagcgtaagtcccatcgccgcaaagcgctccgtatgctccaccgcaacctgctttaacagattcaccacatcgacttccatcggatgcagcacaatattgttgctggtcgccttgctgacctcaaaaagatcctcgatcaatatttttaaccgctggctctttttatcgagcgtctcaatgtatgacctgcgctcctcctccgtgatgtcctccttctttaacagttccacgtaggttgtgatcgccgtgagcggtgtttttaaatcatgggaaacgttcgtgatgagatccgttttcatgcgctggcttttcacttcctcatccaccgccttcttaaatccgtcacgcaccctggaaagttccaccttcatcggctcatatattcccagatcctcggtgatctccgtgtccagatctccgtccgccatccggcttacactgcgcagcagcgcctgatagtctctgccgatcctgtcataatattttttgataaaacagaacacaaagatggagtacacgatcagcgcgccgatgccgaaaaaccacatcatcgagcagagcgacagcaccgcaaagttgatcagcacgattttccagatcgtctttgtggatttttctgaaaaatccacatgcgccacctcatagcggaacgtgttccacaattttttcaaccccggaaagatctgataaatcaggctgtactgtctgatatattccctgactcccaggaaaaataccggacgcagtacgcgaagcgccgcgtaccagatgccatacaaaaacaggagcgggaccatcatctgtccaagctgtaagatggctctccaggcattgtttccaagtaaaacatccactccttcgctataataggaatagcttcttatgatatcgtagaagttttcctccatacatgccatgcagcagacggcaatcaccgccacctccatgagataccatttccccgggcgttgcattggtatgtcttcgttccagatgcgcctgctcgtcataagaaacatccatcccgccaccgcagcaaggctcaccagaaacaggatgcttcccccagacgcgcggtacactaacaccacctgcacccagtaatttgtcataccctcatacggatctcccaaggaaatcgtgtcgctcgttgataccggaagtccgaagatcaccttaaagtccttcggtccctgcaactgacccgcttccacatatccgcccagcgactgtcccaaaagattttcccggtctacattctgaaacgccttgatcagaacgctgccgctgatattttcgtcgtacagcggtgtcacttccagcgcgccctctttgtcaaaggataagcatacgatgtccgtataatactgctttatcttctccgtcacagttccatccacgcatgtctcgagcggctgatccgtatttttcacgcagtcggcactgcttttgtatacacaataatcgatgttccagctgtcactctcaaactggcttttccattcgtcaaacgtagaggttaccgtgtcctttacatactggtaatcttcatcatccgtcggcagattcaaaaacagtccgcctgcatctgcctgcccgctccgctccatctgctctacatacaggacatagctgccctgatagagtgtctgtaccgtatcgttgtccacgctgtccgaggactcgcgcatcatctccgctttctgctgctctttctgtctctcagccgtccggtacaccaccgggaaaaaacacatggtaatgatcgtgatgaaaatgattcccgcgatcgctatgataatccgcttgctgctgtttacggcattgctgttgctgccgccgttatttctgctattgctgttgccggcattgctgtcggcaccgctattttttccagtattgctgttgacatcgctattgctgccgccgttgtttctattgctactgttgccgtcggcaccgttacttgcgctgacattgttattgccggcaccgttgtttctattgttgtttttcaattttatatccaacaccccacaccacctttaagtattttggatctttcggattgatctcaatcttgtcccggatatttctcacatgcaccataatcgtatcggtattgatcgccttttcattccacacgcgctcatagatctcgtccgccgaatatacacgccccggtgtccggattaagagcgcaagtatcttgaactcaatcggcgtcatcttcaccggttttccatccacaaacacctccacggtgtcctcattcagttccagtcctccgatcacatgaatccggtcgttcttttcctccttcggactcctgtttgcaaactgcgtataccggcggagctgggaattgacacgcgccatcagttccaacggtgtaaacggcttggtcacataatcatccgccccgatatttaacccgatcaccttgtcggtctcctctgacttcgccgagagcataatgaccggaaagtcatatttttcccgcagcttcatggtcattgtaacgccgtccatgcgtggcatcatgatgtcgacgatcgccagcgagatcttcttccgctccatcacctcaagtccttccacgccgtctgccgccttgaatacgttgtaattctgactctttaaaaagatttcaattccgtccctgatttctttatcatcctcaacaattaaaatgttatattgttccatttttctgctcctgctcctgttctcttttctgctatcataacacatccaccgcagaatcacacgcctccccgtgcattgattacattttacctgatccgccgcaaaattccccgcagaaatacccgaagaatttctaaagaattatttagaattattatcttgacaactgccacttcgtagtgtatagtagtacaagtgctgaggcaactcacacagatgctgctgtggctcagtcggtagagcgtcgcattggtagtgcggaggtcacgggtccgattcccgtcagcagctttattgagaagaagcgcaaatccttgaatgaaagggtttgcgctttttgtgctatgatattacagtgttatggtattatgacaaatgtattgtgatggaagtctggatgaggagggggatatacggttgaggcgttaatgctatctcgtgtccaaggggaaagtaggaaaactttttcttgtcctgcgggtctcagcgatactttttctactcttggacccgatttttgcttctatgcgggtctggttcgcactttttctcttctcagacccggattgctctttccttccgtcattatgtcaacctttttccattctttccgggtctggcacgcactttttctgctctgggacccaatttttgcttctatacgggtctggttcgcactttttctcttctcagacccggggtgctcttctcttctggcattatgtcaacctttttcccattctctacgggtctggcacgcgatttttctcctctggaacttcgccttttccttctatcagccccggattccaatttgtttgacgattcttcacacatttttcaacactgcttcatacctttttcacatttatccggtatcttaatcattgtcaagaggaaatccccattgacacaatttctttttcataatatggccggtaagtcccccacatcttacctgcttctccttctttttataaaatgataaacgtacaaaacgcctcaccatccggtgaggcgttttgcgtattcctgttgaatacccagattctgtcaacttctcctttactacatgcgattcatcatcttaatgtgtgacttgaacaaggaataatatttcattcccttgtctttgccatagtgcccctgcaatgctgcgcggagagaattgagattctttcgctttccgtttgcctgatagaggaatcccgaaaaatcttccggcggttcctttgcatattcactgtggtcaaaaaccattttgcagtacatgtcaaacttttcttttaagccataagccggaagttctgaccagtaagacgcatactctgcattcgtcttcagttcctgatacagccgcttgccttcttcctcgccgagaagcgcaaccagcgcattgtgaaaatccaccagattttccttgctgatgcaggcacacaatgtctttaaaattgctctctctgcattcagatccagtccaaacttcactggcgcttcactctggtccgtggcatttgacacactctgtggattctctgacatttcttctttcaaatccatcatttctgtcatctgtccggattgttcctccgtcagatccggcttctcattccctgcgttctgcgtctttgctttgtcactcttctgtgacttttccgaacgatccggttctgacatacgctcagacttttctgctttgactgctttcgctgactttcttgaccgttttgccctgccagtcttctctgccggctcagccttcccggatttctctgccaacccagctttttctgccgattccgacttctcggatgtctctgcatcctcagccttcccggtcacttccggcttcccggatgtctccgcatcctcagcctttccggtcacttcagccttcccggatgtctctgcatcctcagccttcccgatcacttccggcttcccggattctcctgccaacccagctttttctgtcggttcagccttcccggatttctctgcatcctcagctttcccgatcacttctgccttcccggatgtctctgcatttccagccttcccggacgcttccggcttcccggattctcctgccttaccgccggctttcgacggttctgacttcttggatgaccgtggcttctttgactgctctctgccacgctctgcttccgcttccgggccaatctcccgaacctgctctgcttccacttccgggccagccgctctggtctgttcctgttccggctctgctgctgccccggattcctttgccacgcgctgctttttctctgtcagcattctgtgacattcctttccgcttaaacggctcaccggcattttccgcgttgaccagtagcgcaccacagcgtcaaatcccgtatcatttgatacaatgacatactccctgtccgcgttctggctcaggcgatagccaagttccgataccagctggaaatccagcgcattgcttccctcaaaacacttaataaagtctgcttccttttccgtctccttgagcatcctcacattttcgtaattcatatgcgggctctttgtcgtataaaatacaagaacctcgtcatcttcctgcgaggataccagaagcggcacccatatatctcctacattctcactgtcaaccaaataaatttttcccattcattctcctgctgacagaatccttttttattataccacattccgcttttatactgcaatgttgtttttccgctgacgcttcttcactttcccgtgttctgttttataaaatatcgatgtactcacccgcaagcgccttgttcatgctgcgcaccgcacagaattttccgcacatggaacaggtgtcctcgtgctccggtttgcggtcctcgcggatttgttttgcggtctcgggatcaatcgcacattcccactgtgcatcccagtccagcacacggcgtgcgtctgccatcttgtcgtcaatctctcttgcaccccgcacgcccttggcaatgtctgccgcatgcgccgcaattttcgatgcaatgataccctgcttgacatcctccacattcggaagcgccagatgctccgccggtgtcacatagcacaaaaatgcagctccattctgcgcggcgatcgctcctccgatcgcggaagtgatatggtcgtaccccggggcaatgtccgttacaagcggtcccagtacataaaacggtgctcccatgcagatcgtctgctgaatcttcatattcgctgcaatctgatccatcggcatgtgccccggtccctctaccatgacctgcacatctcttgcccaggcgcgctttgtaagctcgcccagccgcaccagttcctcaatctgacacacatcggacgcatccgccagacagcccggtctgcaggcatcgcccagagagatcgtcacatcatgctcccggcagatctcaagaatctcatcgtaatactcgtaaaacggattctcctctccggtcatacacatccacgcaaacaccagcgaaccgcctctggatacaatattcatttttctcttgtgcttcctgatctgctcgatcgtcttgcgcgtgattccgcagtgcagcgtcacaaaatccacgccatcctcggcatgcaggcgtaccacatcaataaaatcctttgcggtcagtgtcgcaagatccctctgatagtgaattacagaatcatataccggcacggttccgatcatagccggacattccgccgtcagttttctccgaaacggaatggtgttcccgtgcgaggagagatccatgatcgcatgcgctcccatgtcaactgccgccatcactttttccatctccacgtcataatccttacagtctctggagattccgagatttacattgatcttcgtccgcagcatcgagccgacaccctccgggtcaatgcatttgtgatgcctgttcgcgcagatgaccacctttccctccgcaacgagcggcatcagctcctctgtggtcatgcgctccttcgccgcaaccttctttaactcctctgtcacaattcccttgcgtgctgcttccatctgtgttgcatactgttccatatttttctgctccatttctgcagagggtgtacgaaaaaatccggcgtcgcagtgacgccggattccacaaactatctgatccatcattcgctccctacgacagtattaactgacaggttccaagagtcaggttttaaccttctcaaccgtttacgcatgcgcacagtccctctgcgatatattctttttcctctaacaccttatctcaattctatgcttctgtcaatctccctttcctcagaactgctcttttccataacaaaaaaagaacagccatcactggctgcccttttaggagaaggtatttttactatggggtatagcaaaaactatatataatgtattggggggtttttacggttattatagtaccatgactgcgcaaagaagtgtgcacaaacttcacaaaacttctgttccatttctatacattttgtacagtaccttaggactagtatttttatttccgcaaaattttgcacaaccggttgttcatttcccgctcttttttgcaaaatgccattttttgccttccctctatctctgccggatctttcccttgatacgcgagagcgcattgtcgattgtcttgggactttttccgagttcctccgctatctggcggtaattttttccttccagatatgcgtctaaaacctggcgctcgagcgcgcttaactgttcccgcagctgctcccagaaagcggtaaaattctcctgctcaatcaccagctgttccggatcgtccatctggtcggtgagaagcgtctccgccagagatttcccttcctccgtggtctgggaataaaaggacacgtaagtattcagaggtacatgttttttccggttggatgcctccaccgcactgtagagctgtctgttgatgcacaattccgcaaaatggaaaaaggatgtctccctgtcggaccggtaatcccggattgccttaaacagtccgatcatcccctcctgaatcaggtcatccgtatctccgccaatcaaaaacatcgcatttgccttgcgaagcaccaacggcttgtacttttccaggatataatccatgatccgctcgtcgccttcgcgcagtttctggatgagttcttcatccgccagcttctgatattcgtccacgtcttcctccgtcttccctctctgccctgctatgccgcccaaacgttccgcgcacggctgtattttccgcagcataaaaatctgtccgcctatgcctgctctgtcatcttacatcatccgctgtctgacgatctcataggcaagcacaccggctgctacggaagcattcagagaatcaatgtcacccttcatcggaatggaagccacataatcacagttttcgcgcaccagcttgctgacaccctcaccctcgcttccgattacaagaccgatcggtcccttcagatccaggtcatacatctgcgtgccgcccatatccgcgcagacaaaccagatgccctgctcctttaactccttgatcgtcgccgtgagattcgtcaccttggcaaccggcgtatagtttaacgcgccggcggacgtctttgccacagtcgcggtcagtcccaccgccctgcgctttggaataatgaccccgtgtgctccgcagagattcgcggtacggatgatcgccccgagattgtgcgggtcctcaatattatccagcagaaaaaggaacggcggctctcccttttctcttgcgatctccagaatgtcatccacttccgcatattcatatgctgccgccaccgcgatcacgccctggtgcttcttcgtctccgagagctgatccagacgctctttttccacaaaatggataatggtatcgtgcttttttgcttctcttacgatcgtgcgcaccggtccgtcctgacatccgtccagcacaaaaagcttgtcgattgtcttgccggaacgaaacgcctcaagcaccgcattgcgtccctctatttttaattcctcgtatcccatgtattctccttttctttctgcttccggcaggcgctttctgctgcctgcagcatcctctgccaccggcagacgctctatgctttcgccctctgattcctcttcccgcggcagacgttctataacttcaaatgcagcccgtccacaccggtcttcaccagttccaccagacgctcaaactcatcctgcaagtacagccatcccatcagcgtctcaaacccggtggccttgcggtagtcggacatcgtcgcattctttgccatcgtcggcgacttggcatttctgccgcgccggtaaatgtccgcttcctcctctgtcagaagcggcagaagcacctccatcatctcggcctgcgtgtgcgccttgacaatctggctggtccgtttgtgcagttctcccgctctggtattcccttttcccacgacaacagaacggatgacgagatcatagatcccgtcaccgatataagccagtgtcagcggtgagtaggtgcggatatcgacttccgcaatcccgaactgttccttaatataagaatcgattcctcttcccataccagcttcctctccgactcacgctttatgccagatcacaccctcgcgtgtgtcctttaacacaattccttttgccagaagatcatcccggatcgcgtccgcctttgcaaaatccttctctttcttggcagctttgcgctcctcaatcttctctaaaatatatgcctcaagctctgcatccacctctgtgtcttccgccggattctccaccttcgccgtcgtcaggttcaaggagagcacgccgtcaaaatcctccgccagcgcacgcttggttgcatcgtttaaggtatcatccttgagcaggtcatagacgattgtaatcgccatggaagtgttcaggtcattggaaatggcatcacagaatttttccttgtactctgcaaatttaccctcatccactgtgccgtccgccttcagatccgcgattctcttcacaagcttcttgtaggcaacgctcatgttgtccagcacctcgtaggaaaactcaagcggctttctgtagtgggactgcaggcagaacatacggtacacgatcggatcgtatcctttttcctgcagaagcgacaccgtaaggaaatcccccttcgacttgctcatcttgcccgacttgtcgttcaggtggttcacatgaaaccagtaaccgcaccacttgtgtcccagatagctctcggactgtgcgatctcgttggtgtgatgcggaaaaatattgtccacgccgccgcagtggatatccatatattcacccagatgcttgatgctgatgcaggagcactcgatatgccatcccgggtatcccacgccccacggactatcccatttgagcgcctgatcctcgaatttggactttgtaaaccacagaacgaaatcatttttgttccgcttattgacgtcctcctccacatcgtcgcgcacaccgactaacagttctttctcgctctgggaagaaaaaacataatagtcgtccagcctggaagtgtcaaaatagacatttccgcctgccacataagcgtagcccttctccagcagcacctcgatcatgtgaataaactccgggatgcagttggttgccggctccacaacgtccggacgcttgatatttaactttttgcagtcatcgaaaaacgcgtccgtgtaaaacttcgcaatctccatcaccgtcttgtgctcgcgcttcgcaccttttaacatcttatcctcaccggtatccgcatcggaggaaaggtgtcccacgtccgtgatattcatgacacgctttacatcgtagcccacataacgcagtgctttttccagcacgtcctccatgatgtagctgcgcagattgccgatatgcgcgtaatgatataccgtcggtccacaggtatacatggcaatctttccatcctcatgcggaatcaccgtatcgatatttcttgtcagtgtattgtaaaatttgaacttattctccactttggtattctccgtttctttttattcttattattcctgtgacgctccggctcccgtgcttaaaatacgcacttctttttccagatccagcacacggttcaccagttcggcattctcatgctgcagcacggtgatatcctccttcacagggtccggaagatgcacctgatccatgtcatcctgcggtgtcctgatattgtcgcgctttacaacgcgtcccggcactccgaccacggtgcagttcggcggcacttcctcgatgacgacgcttccggcgccgatcttggaattatccccgaccgtaaaagaaccgataatcttcgccccggcactgatcatgacattgttcccgatcgtcggatgacgctttccggtctccttgccggtaccgccaagtgtcacgccctgatacagcgtcacgttatctccgatgatcgacgtctcgccgatgatgacgccgcttccgtgatcgataaaaaatcccttgccgatcgtcgctcccggatggatctcaatgcctgttttcctggctgcgcgctgcgaaataaaccgcgcccagaaataatgccctttgagataaagcttatgcgcccttctgtagcttagcataacatgaaatgtcggataaagcaaaacttccatcggacttttgatcgccggatcgcgttccttgattacctgaaactcttccttcatataccttaggatacccatctcttcccattcctttccacatacaaaccagaacaaagtttcctattacaaaaaaaaggatcatccgtctcctagagacgaaatgatccgcggttccactctactaaaatcatatgatttcacttgacgcatgtaacgtatgccagacgtacccggctacggcatccctacatcctgcggtgcagatgactctcgccggatcagctcacggaggcacttggggactctctcttccaagactgctttcagccggtgacagtctctctctgacgaatgtccgaatccttactctttccgatcttcgcttttccaattcatctttttatcggcagaagatacctctcctgcctactatagtttatgcacttcctgtgtttttgtcaatcttttttcactgcatgtttcgtctgcagccgcctgaattcttcttagctcattgtacgcttcgtccgcagccgccgcagcccgcgcagcctgccgcagagtccgccacagtaaaacttccctcataaaaactggaaagcgcgcagatcgcctgtgaggaaatcccttcctccgttccggtgaagccaagtccctcctccgtggtcgccttgacattgacctgatccgtactgatgccgagcgctcccgcgatgttttcctccatctgcgggatatgcgggcgcatcttcggcttctgcgcaatgatcgtcgcatcaatgttctccaccacgtaacccctctcccggatcagctccgccacatgggagagcagcttcatactggaaattcccttatactgcggatcagtgtccggaaaatgctttccaatgtcgcctaatcccgccgcgcccaaaagcgcatccataatcgcatgaagcagcacatccgcatccgaatgtccgagcagaccaagcgtatgcgggatcttgacaccgccgatgatcagatctctgccctcaaccagtttatgcacgtcgtaacccattcctactctcatgataccctcactttcaagccttttcctatgaaagaacaaaaatccccggacacacaactgcttgtattcccgaggactctctagtagcggaagggagatttgaactctcgacaccacgggtatgaaccgtgtgctctagccaactgagctattccgccatattatattgatatctatgggacctatagggctcgaacctatgaccctctgcttgtaaggcagatgctctcccagctgagctaagatcccatattcatcggtcgctaccgcaaccgacttgattagtatactatccgtattgcaaaaagtcaacactttttttctatttttttgcatctattttcccggggcagtttgaaggcggaaaagaccgcttttcgccttctactcttcctccaacagacgatccaccagtttcacacattccgccgcatccttggaatagccgtccgcaccgatctcctccgcaaagctttccgtgatcgccgcaccgccgatgacaaccttcgccgtacatccgcgctctttgacaagctccaccacgtccttcatgcgcatcatcgtcgtcgtcatcagcgcggagagccctatcacccttgcgttttctttcatcgcagtatctacaatcagatctgccggaacgtcttttcccagatcaatcacatgatacccgtaatttttcagcatcagcaccacaagattcttcccgatgtcatggatatcaccctccacggtcgccacgacgagcgttgccttcggctccttgtccgagcgtgctaacatcggctctaaatattcgatcgccaccttcatcgtattcgcagacgaaatcagctgcggcagaaaatacttctgcttgtcgaacagctcgccgacctcgttgatcgcgggaatcagatgtccgttgatgatgtcatccggcgtctccccggcgtctaacgcgtgtttgacctcgtctaaaatatgattcttattgccctttaagaccgcggtaaaaaccgcactgcgcgcctcattcgcgttcccggaatccttcgccccgcctgcgtttcccgcctgtcccgcggcagtgcctttcacggcagcgcccttcgccgtcccgacaggtacccacacatgttccatgccctcatgcttctcggacagataattcatgcgcccgatatagcggatgccgctctcctccttgttcagaagcatgtccgatgcaaatgccgcattcatcagaagttcctgggaaggatttgcaatcgccatcgtaaggccgtttccgatcgccattgtgagaaatgccgtgttgacataggagcgctccggaagtccgaacgaaatgttggacagtccgcagaccgtcggcagttccatctcatttttgcagaaagaaaatgtctcaaaacactccagcgccgccttcggattggcaccgatcgtcgccaccagtccgtccaccacaatgtcctcttttcccatgccgatcgcttccgcgcgtcttaagatctcacggatgatcccgtgcttttccgcagaatccttcggcagcccctcgtccgagagcggcagcaagataaacatggcaccgtacttctttgcgatcggcagcagatactcgatcttttctttttccagagaaatggaattgacaagcgcacgtcccggatagatgcgcagcgccgcctcgatgatatccacatggctggaatcgatgcagagcggcagatctaccgtggaagtcacttcatagatggcgtctaacatcatctgcttttcgtcaattccgttcattcccatattgatgtccagaatctgtgcgccgttctcctcctgctccgtcgccatggtccgcaccatactaagacttccctcttttaactccgcctgcagctttttctttcctgtcggattgatccgctctccgatcaccatgaacttaccgtcaagccggatctccacatgcatccgctccgaggcgagcatacgtcttttctttgtgagaggcatatgcaccggcatggaacccaccgcctgctttaatgcacggatatgcgccggtgtcgtgccgcaacatccaccgataatcgccgcgcccgcctccacaagcttcgcgccgactgacgcaaactcctccggcgtggtacgatacacggtcacgccgtcacagagctccggcataccggcattcggctttgccagaagcggaatcgtcgcatactccaccatctgctgtaccggatcaatcatcgcctccggtccggtggagcagttcagtcccacagcatccgctccgaggctctgcagcacaatcaccgcagttgccggatcagttccgtagagcgtccgcccatcctcattgtaggtcagcgacaccataatcgggagatcacacacctcgcggatagcaataaccgcagcacggcattcctgaagactcatcatggtctccacgacaaaaagatccgctcccgcctcgcagatcaccttcgcctgctccttatacacttccaccagatcttcaaacatcagatcgccgagcggataaagctgccgtcccgtcatcgtcagatcgcccgccacatatgccctgccgcctgccgcgcgctttgagagcgccaccagctcacggttcatctgcaccagagaattctccagtccgtactcctccagcttgatccggcttgccgtaaaggtgggcgcgaacaaaatatcggtgcccgcctccacatagcgctcctgcaattctatcagaacccccgggttctccagaatccactgctccgggcagaccccgaccggcattcctgctttctgcagattcgttcctgtcgcgccgtccaatatcaccggtctgcttcccacaagtgtcgcaaattcctctctggtcattcccgtatcctctctatcatccgttcttgcttatcaagccacatcttaccatttccccatgccgggtgcaagtattttccaatgtttcctgcaatccgcgccacggcaccgccgtttcttgattgttttcccgttttattgtatcattctgtagatacatttacagaaaggatactcgactatgaaacagcctgtcagtctgattgccctcgatatggacggcactctttttaacggacaaagtgagatctcaaaggaggatcaggacgccattcgcgaagcttcctcccgcggaattcacgttgccatatcgaccggacgcccttacgccgggcttcccgtcacacttttatccggtctcggcgtctcctatgccatcacctccaacggtgctgccgtctatcatctgccggaccgcctctgcatccatgaatctgcgatggagcctgcgcttgtatgccccatcatcgaagaactgcaaaaaaagagcatccatatggatgcttttatcaatggcgacggcttcagccagcgttcctgtgagggaaagatcgactgcctggacatgcccacatcaatcaaacgctacattcaccggaccagaaccttcaccgatgatctcgctgcctatatccgcgtccacaatctgaacgtccagaagatgacgctgaatttttatccgcaggaggacggcacttttctctaccgcgacgaagtgatgcagatcctgtcagagcaccccgagatcacctttctctccggcggctaccacaatctggaattcaccagagcgggcgtcaccaaaggaaacggtctcaccctgctctgttcgcacctcggcgtcgatatcgaagagacgcttgcctgcggcgacacccagaacgacatcgacattttaaaaaccgcagcgatcggcgtcgccatggaaaatgccctgccggaagtgaaggagatcgcagactttgtgacgcgctccaatgaaaacagcggcgtcgcgcatgcaatccacacgtttgccctgtgatgcaggcgcttaagcgtgtgtgatcacgccgcctcccgcgacatagtctccgtcgtacagcaccactgcctgtcccggtgtcacggcgcgcaccggctcttcaaattcacagcagatctcatccgcaccggtgcgccgcacggtgcagcagcttcccgcatgcgagtaccggatctttgccttcaggcgaaccggctcctcaatgtcggagagcgccataaagttcagctgattcgcatacagccggtttgtatacacatctttatcacttccgagaactacctcatttgtctccgggcgtatctctgtcacaaacaccggatatccaaacgcaatcccgagtcctttgcgctgtccgatcgtataatgtgtaattcccttgtgccgccctaaaatctctccgtccaccgacacaaagttgcccggcggcggaaccatttccccgcactctctgtctataaatccggcataatcattgtccggtataaaacagatctcctggctgtcctttttatgtgcaaccatcagtccgatgtcttccgcaatcgcacggatctcatcctttgtgtaatctcctaccggcatgagggtatgggagagctgcttctgcgtgagattaaacagcgcgtaggtctgatcctttgccgccgtcacggagttgcggatagcatatcttccgttggaaagctgttccacgcgcgcgtagtggccggtcgcaatgtaatcggctccgatctccaaactcctttgaagcagggattcccatttcacatagcggttgcatgcaatacacggattcggcgtgcgcccttttaaatactccgctgtaaaataatccatgacattcttcttgaactcgcgcttgaaattcatcacataatacggaatctccagacgatccgccaccctgcgtgcgtcatccaccgccgagagtccacagcatccgccgctctccgcctgtgtaaactgatcctcatcctgccagatctgcattgtgactccgatcacatcatatccctgctgttttaacaaatatgccgccacggaagaatccactccgcccgacataccgactactactttttttcctgccatgcccgctcctgccaacaaacatatgaggttgccacaccttacggtatggcagcctcatctcttcgtgtcttccaatgttaaattccggaattgtaaagatctccggtgctgtaattataagtatacataccattcttgctgtaggtattcgccttcgccgcttcactcttcgcgttggatgcgatcttcaggagatccacattcgtctgcgtcgcataagatccgtgcgttgtaaacagtgacttcagcttgtccatatccgccttctcaaagctcttctcgtccacggaaagtctgccgtcggcatccacggtaatgcccgctttctccaacgtcttctcattcgctctggcattgctcttcaaagagttcgccgcacgcagaatgctcttcgtcttagaatcgtccgcccgatccagcagtgaattgtaatcatccacatacgacttcaccgccttatagatggcatcacggtcatactcctgcgtcttcgtgccgtcctccgcggtcttctccactttgttgaacacagaatcctttccggttgctgtcagcttggaaagcgacttctccgtactctccgccgcactctcaatccgggtcagtgtcttcgcgtcatccttcgcggttgaaatcgacgggctgaccttcgtggcgctgtccgtggaatccgacttgctgtaataggcactcaaaagcttgaaatagcttccgttgcggatcgtcgcataatcggaataattgattccgagcagatcgcttccgcctcccagcagagaggaagttgtattgttccggttcagactggaaaataacacgcccagtgacgatgaatcatatcctgaaatacttgccatactctatcactcctttgaaaaaaagcatctgacctccgtgtcagaatgttgatccggctgttgcatttgtgcacaataccttcttgttacctcatgttctatatcgtcattttagcccgaaaccttagatttttcaagcattttctggtgattgtccttattaaaatgtttaactattgttcatagtttattcatatcttattgctacaataaaattatcaaaaaacaagacaattcgttacaatatatttgataattttttcataatagcccaggcgcgcaagtgtctgggcactcctcatttcagggggtttttctcccttttacgcagacagagaggggcgccgcacatgcgcggcacccctctcttctattccagatctatacggcctgtattatttctgatcattatacttcacatcacgcacatcataaccgtggcgctctaacgcgcgtaccacacgctcaaaatccggtgcttccacccgaaggaagatctctgccagatccataacatccgtcggaatcaccatcatgttgcagatgtctccgccctccttagcaatcagctcacagatcttgccgagcacaccgcggatatcatacgtgtagattgccatggaattgtgtttgttaccaaagatcttctgatattccttgaataccgcctgctgcgtcacgattccaagcagcttgttctgctcgttcgtgatcggaataaaacgaactttggaggtgataaacattgctgccgcttcctcaatccgtgtattctcaccgatggtctcaattcttgtcttcatgaactccatcacttttcgctgtgcaaattcttctctggtccctgtatagttccggaaaaattcctcaaacaaaaactgtttggacaaaacacccacaaactgctgtccgtccactaccggaagcgagagaagtccctgctcgtcgataatcttcattgcctcttctaccgtattctccacgctgatacacgccagcttactgaaaggcatcataattgcttttacacgcataaccaatacctcctgtctgcttttattgtaagtatattatacactaaatattctcaatttgccagtctatcggtgcgattccatgctcctcaagaaacgcatttgccttgctgaaatgccggcacccgaaaaatccccggtatgccgagagagggctcggatgcggtgccgttaagatcagatgcttcggattcgtaagcatcggtattttggactgcgccggtctgccccagaggaggtacacaatcggacgatcctgggcatttactgcctgaatgaccgcatcggtgaactgctcccagcctcttccctgatgggaatttgcctggtgcgcgcgcacggtgaggacggtgttgagcagaagcactccctgatctgcccattttttcagataaccgttattcggaatgtaacagcccagatcatcatgcagttccttataaatgttctgcagggaaggcgggatctccttttgctccggcagcacggaaaacgaaagaccatgtgcctgatttacattgtgataggggtcctgtcccagcaggagcaccttcacctcactaagcggcgtaaaatgaaaggcattaaagatatcctccgccggcgggtagaccactgttctgctgtattcctcccgcacaaatgtgtataattcccggtaatacggctttcggaattccccctggattgccggaagccagtcattgtcaatcatcgacatatcccactactccttttttcacagacagcagtgtgggcgcaccgtgctatcgccgcacagatacgcccctcgctgccagatcgttcttcagatccataatctcaagttctttatagtgaaacagggatgccgcaagaaccgcatccgcttttccctttgtcagggcatcataaaaatgatccttcgtcccggcgccgccggaagcaatcacaggaatcgatacattttccgctacctgtctggtcagttcaatgtcatatcccgctttcgtgccatcgcagtccatgcttgtcagaagaatctcccctgcgccaagccggtctgccttcatcgcccactcgacggcatccagacccacatcaatccgtccgccgttcttatagatattccacccggagccgtccgcgcgtctccttgcgtcaatcgcaaccaccacgcattggctgccgaatttgtctgccgcctccgagatcagttccggccggttgatcgcggaagaattgatcgcaatcttgtctgcgccctcgcggagcagtgccttaaaatcatccaccgtccttatgccgcctccgaccgtaaacggaatgaacactctctccgccacgcggcgcaccatatcgaccacggtatttctggcgtccgaggtagcggtaatgtccagaaataccagttcgtccgcacctgccttatcgtaagctgccgcaatctccaccggatctccggcatccctcagattcacaaaattaacaccctttaccacacgcccgccattcacatccagacagggaatcactctctttgtaaacatcgcatgcctccgctatatttccgcaaaattcttcaatatctgaagtcccactgtgctgctcttctccgggtgaaactggcacgcaaacaggttgcccttctccacggaagcatgaatcgtcacgccgtactctgtggtcgccttcacaatcgacggatctttcgctttcaggtagtaggaatgtacaaaatagacatacggctgttccttcaatccggcaaacaatcttccttcatgcgggaaatccagtgaattccagccgatgtgcgggatcttaagtcccggcgcctccggaatcttcacgatctctccgtccagcagatgaagtccctccacgccgtcactctcctcgctgccctcaaacagcagctgcagacccagacagatgccgagaaacggcttgtcttcctgcacaacctcgcggatcacctgatccagctcatattttttcagctgctgcattgccgttccaaaagaaccgacacccggcagtaccactctgtctgcccggcgtatgctgtcatgatctctcgtgaccacacattcctcacccagcgcgaggaacgccttttccacactttttaaattgcctgcgtcatagtctataattgctatcattctctcactccgtcgatgtcatccaagtcctgctgccgccaatatcgaatacagttcctgcgagtaagtatcccgctctctctccgcgtacagttcctgtgcgcgctcctgcgtaagtccaaatccggacagtcctgccaccgcctggtctctgatcttcgcgagttctgtggagcagccgtaagccgcagcctcctcgctgtacttatcgcatcttccgaccgcgcggatgagggaatccagtgccatgtcataaataccgttttccataaaggtctggtatgcctgatattctccggctgcattcgccatgatgctgtacttctggtaggtctcctgatctgcctccttgaccgtaagtccgctcacatccgcgaacgctgcctgatagtcgcccagttcatacgcctgcttggcattgttgaagctcagggtatatccgaacagattcgttcccaccagcacaagtgcgaggaaagacgccgccatgaccataatcagcaccaccggctttttcggaagcggcggtgtattgtccggctccttcggcttcttcggcttcttggctttctgtgcttttttctctgccttcgccttcttcgcctgtgccttcttctccgccttctctttcttctcctgcgccttcttctctgctttttccttctttgcctgcgctttcttctcttcttctgaaatctccggttccgcctctgtctccggctcggctgcccccgttccttccagttcctgtaagagctttaaattctcatcggaaagatcatccagctccggtgcctgttctaaaccttccggctgtaattccccggtgtccgctggtgcctcctccgtctcttcctcctcaccaaacagtgcgtcgccgattctcttgatcaggctctttttctcctttgcaggagcctcatccccggcatctggctcatcttttttcttctttttgcggcgctttttctttttcccgtcgtcctcgtcctgcacctcatccgcagtctccggcattgccgtcacgtccggcatttctgcgtctgtgtctgcggacggagcagtgggatccgccatctggctcatatccgggaaatcgccctccgactgcagcagatccatcagatctgaatcgtcgtcctggaaatcaccgatggtatcgaccataagatctccgtcctccgacgcatgggcagtctccgccgcttctgcaccgccggtgctctcatccgcatcccttgcgctgtctaaaatgccatccagatccttgaagaactgattgttctcctccgtcgtcttctgtgttctttcctctctaggcgcctgatccagctcatcctcgaactgtctgataaatgtgtccgcatctccttccagatctgtatccgcctcaaaggactttaaaaaatcgtcttcctcactcataccagctttttttgtctcctgttctttttctgcataaagcccgtctgccgtatcgcctggctccgtctcacgggctgtgtcggcaggacttcctccctctacggagtgcagcagcccatccagatattcctctgctccgctcatacgatacctccatcgacctataacttaagcgggggatgtgatcctgctccatcacatcccctcttcatttcattctcagtccatgctcttgtcaatcaagtcgtcaatcgccgaaacaagactgccaatctccggctttgtcagctgggcatccgctccaagctgttctcccttgatgcgcatctcctcatttacaagagatgagaaaataatcaatggaatcttcttcatattgtcatttgtcttaaccagcttcgtaaggcggtgtccgtccatcaacggcatctcaatatctgtgataatgcagtgtactttctcacgcacattgcctgctttttcaaactcctgcagcttatcccatgcctcctgaccgttcattgtcacaatcaggttcgtgtagcctgccttcttcaggcagtctgtgatcagtctgctaagaagcggggaatcctctgcgatcaaaatcggagattcacagcgctcacgctgtcccatgtcgtccatatcggacatcttcagtcctgtctccgggctgatgtccgtcacaatcttctcaaagtcaaggatgatgatcagcttgtcatccatcttgatgacaccggtcgaggcgctgttctgctcggtattgatcgtggcatccggcttgatgatcgcctcccaggaaacacggtggataccaagcacggcatctacgtgaaatgcaatgtttaacttgttaaagttcgtaatgataaaaagtccctctgtcttcgcatcatccggcattcccagacagcgcttcagatttaccacagagatcatcgtatcacgcggcatgaagattccttcgatactcggatgtgaatttgggacaggcgtaaccggctgataggttaaaatctccctgatctttgcaacattgattccgtaatgattgtttcccaaggtaaattccagaacttccagttcgtttgttcccgattccaataatatatttgtatccattcgtctctctcctctcgcgtaataccgcaacgtatctatctgacagcattatagcacattggtacctgaaatgcattgtttttcatgcgttttacagaataatttgtatcatttgatccatttgcacatacagttccacactgtctgccgacgccacatcatccggcacctggaatacaagtaccaggcgggtgctccctcccgcaggaatcgtaccctgataggtggaaaaatccgtatccagcaatgtggtctccgccgtgctcttgaccgactggttcaatacaaccgtgaacttcgggctgacactcaaaacatcaagacccactccgtccgccccggtgttggtcacatctatggacagcaccagatactgttttccggcatccggggtcatctcataataatcaccttccatgtaccccggtgcaagctgcgcgcccgcataggtcatctgaatgccgtcggctccgaacagttgatccagagatgccgatccggctgccgccaccgacacagcaggtgccgcagcttccgcagatgcggctgttcccgtctctgacgcgtcctgtgtctccggcgtctgcggcaccgtgacatcctcctgcgtctcctccggttcttccggactcacatacgtcagaccttcccgctgatatgtgttgtacttcgtgacgatatgcgccgcataattgacaatgacgttctcctcgtcgtctgtcaggtcatagagtgcatcaccacacccgcccaacagcatcgttgcagccatcaccgctgccatcatcttgattcttgttcttctcataggactccattcctcacgcaaagtataaactaacattatgttagcattttaaaggaaatatagcaacaaaaaaaattttttgctgcatcatgactgttttcctttttccagttcaaaccagaattccacgccatcctcatggttgatcacgccgcactgctgatggaacgagtccatgatcgccttcacaatggaaagaccgattccgctgccgccgtactctctcgtgcgtgccttatcgactttgtagaacttggaccagattttgtcgatatcctcctccggaatcgggtctccggtattgaagacgcggatgcggacgttcttctcctgctccctgcagcggatggaaatctccttttttcctcccgcataatgaatggcattgctcaggtagttcgtcacgacctcctccgtcataaattcatccgcccacacataaatgggctctgcgggacattccgtcaccgtaatgccgctctgcccgatgaggatatccaccgagtgcagcacgccccggatgagctctgttacgtcgaagcgctccatcgtgatcgtctcgtttccggattccagctggtttaatgtcagaagctttttcaccatctgattcatcttatccgcctcgtccatgatgacctcacagtaaaaatcccggctctgtgcgtcatcgttgatacattccttcaagccctccgcatatccctggatcagggcaagcggcgtctttaattcatgcgatacattcgagagaaattccttgcgctggcggtctatctgcgtctttttctcaatgtctaaaaggagctggttgtttgcgcttttcaattccgagatcgtatgctcgagcgcctgcgacatctcgttcatgtgcgtgccgagttcatcgatctcattgcgccgctttcctttcggcgtatagcagacctcaaattccagctgggtcatatgcttggaaatctcggtcagttccaggatcggatcggtgattctcttagagatgaagaccgacacaaccgtgctcaccgcaatcgccaggatcccgacgtacagcaggaactggttcgacgtcttggcgctctcccttatgctctctaacgccgaccgcatcagcaccagattgccgtttgagagggttccgtacagtaccagatattccgcatccagcctggtgtccgttcttctctggatcacatagtcctccgcctgcgccagcaccgtggtctcattctgcgtaccaccgaaaataatgtccgtaaactcgattaacatacgctgtgtatcgttcacggaggatctgacaatcgtgcggtccgggctgatcaccatgaccgtgatattgccgtttgcgcagagattgtcaaatgtcacatcaaacgagctgtcgtcaaggcttccatcctcgcttgccgcgtcaatcgtagtaaatccggacagcagtacattttctttgttcatcacatagtagcgctccagaaataccgtgttaagcacccagcagagcgccacggttcccgccaccagaccgatgataattccggcgatttccctggtcagtccgccctctttcggatgtctgccgcgcccctgtctctttttatcaaaaagtcccttcattccgcgtcacttccattattcttccgtcacttcaaatttgtagcccatgccccagaccgtcgtgatatattttcccttatctcccatcttggcacgcagcttcttgacatgcgtatcaatcgttctcgcatcgccaaagtaatcgtaattccagacgctgttcaatatcttctcgcgtgagagcgcaatccccgcattttccataaagtatgccagcagttcaaactccttgtagcttaaatcgatccgctctccgtcaaccgtcaccatgtgggctgccttgtccagaacgattcctcccatggagaccgccgcttcttcatcctgcgtctttccgctccggcgcagaatggctccgacacgcgcaaccagtatcttcggagaaaaaggtttggaaatatattcgtccacaccgagttcaaatccgttcagctcgtcgctctcctcgcccttcgccgtcagcataataatcggaactttcgatgtctcccggatctcccggcacacttcaaatccgttgcgcttgggcatcatgacgtctaaaataatcagcgctatgtctttttcccggtaaaataaatcgagggcttcctcgccgtctcccgcctcaagcacctcgtatccctctctcacaaggaaatcccgcaccagcttgcgcattctgctctcatcatccaccaccagaattctgatcttatccatgttcccgtatcctttccgctttttatcgtcattctaacagctacttatgaaaaatctgtgtattttccgctctattccggcatgattccaagctctttttccttcgcctcgatcgcttcctgcctctggtcgagccgctcctcccacgcctcgtatttgttgatcagctgattctcgtagtttaacaccgtcgtattattggtcgtcgccgtaattgcaaacatcgccacaacacatactgccagaataaaggcgatccagcgcacaatgcggtagcgtctcctgtagtccgcattttttaccacggtctgcgtcttcggctttggtgccggcgcgcgcttcgccttgcggagactctcctccacctgcggatgctgcaccggaatcgggaaaatatcttccttccggataaacggaatcgactgcagatactcctgcagatccttcagataagaatagccgactgccgtgtcaaacagccgctgctgtatcattttattataaatgcggagtaccatctcagggtcgtccatctgggctttctccttgacgtatttcacgccctccgcctcttttctcgcctgcgcggcttccgcctcatttgcaaataaaaatccctccacgaccatggaggtcttttcctgttctttttgtctcttttctacagacattcttcgatcctcatctcttccgtttctgctgtgattttgctcttattataggaaatagcagtgtgaattgcaagtcagggagatgtaaagattccgcattttcccataaaaaaaagcgccctgcatggcgctttttaagatggaccagacgggaatcgaacccgtgtccgaagaataatcccctgtccttctacgagcttagtctgtcctttgacattccctctgccgtccgggaacagacacccttacggttttggtagcttcatggtacgcccgcaggctcaaagctttgcctgtgtcgtttctcacatcgtcgaagcctgggtcctaaagtgtgagtgctctaggtcagactgctgccattaggcagcgtatgctaaattatcttcagcgtttaaatttaattgtggaatttgacgcatcccgtgcggctcgcttctccagcttcatattccccgtcgaaacctttactggcccctgttatttataaaaaatctaatacagattctttaccttgaaatcacgctctgcctcgcggcgcatgtctttcttcgcaatgtcctgccgcttgtcgtagagcttcttacctttggcaagtgcaatctccaccttcacgaggcttcccttcagatatacctccaccggaaccagcgtgtagccctgctctgcaagctttcccgtcagcttccggatctctgacttgtgcatcagaagcttcttggggcggagcggatctttgttgaaaatgttgcccttctcataagggctgacgtgcatgccgtaaacgatgacttcaccgttctcgatgcgcacaaacgcctccttgatcgagcacttgcccatgcgcatggacttcacttccgtcccgtgcagttcaatgcccgcctcaaaccgctcctccaggaaatagtcatggtaggcttttttgttattcgcgattaacttcttctcggtctttgccatcccgactatcctccttcgcttactgtctgcactgccgcttttcatctgcactgctgttacagtataccccacaaatttttattctgcaataaacttctggtttaatttttcattttcttcgtcttctgttccgataacgacacgaaagtcgatcgttcgcataaatggatctgtcgctgccacgacaatctttaccttctggccaagcttgtagcgctttgcggtagtctccccgatcagctcataggtgctctcgctgtagtggaaatagtcgtctgtcagcgtcgtcacatgcacaagtccctccacggtatttggcagttcgacatagaatccccactcggtcacgcccgaaatgacaccccagaactcttcacccagatgtccggacatgtactgtactttctttaacttgtcacattcgcgctctgcctcatccgcccggcgctccatctcgctggaatgctttgccacctccggcagaatcttctcataatgctcgatgcgcttcgcattcattcttccgcgcagattgtccttgatgatccgatgaatctgcagatccggataacggcggatcggcgaggtgaaatggcagtaataggacgttgccagtccgaaatgcccggtgtttacggtgctgtactttgcctgcttcatcgagcggagtgtcagccggctgattaacgcctcctccggcgtcccgtcaatccgaagcagcagcttctggagttccttcgggtgtacttcatcctgcccgatatgaatcgaatagccaaaattattgataaacgttgccagcttgtggatcttctccgtatccgggttctcgtgggtacggtacacaaacggcagttcctgccagaaatagtcctgtgccaccgtctcgttggcaagcagcataaaatcttcgataatcttggtcgcaacattgcgctcgtacggcttgatctccacagggcgtccctgcgcgtccagaatgatcttcgtctccgggaaatcaaaatcaatcgatccgcgcttcatccgttttttgcggagaatcgccgccagatcccgcatcctctcaaacattggcacaagctcctcatactcacggatctccacctcatcgtgatcctccaggatctttttgacactggtgtaactcatgcggcggtcgaccttaatgactgtctccgcaatcacgtgatcgatcacatttcccttcgcatccacggtcatgatacagcttaatgccaaccggttctccccggcgttcagcgaacagatgccgttggaaagcgcatgtggaagcatcggaatcacacggtcgacaagatagaccgatgtgccacgctttagagcctccacgtcaagggcgctgcgctcctgcacataattcgtgacatccgcaatatgaacgcccaggcggtagacatccccctccttcgtcagggtgatggcatcgtccaaatccttggcatcctctccgtcgatcgtcaccgtctgccagtcccgcagatccatgcggcctgccatatcggccgtgctgacctcacctgccacgcgctccacctgattcatgatcttctccgggaactcggtcggcagatcgtaacctcgcacgatcgagagaatatccgtccccgggtcgttcacatgtcccagaatctctacgacctttccctccggcttttttccattgccgccgaaatccgtcagttccaccacgaccttatgtccgctcaccgcacctttggagcgctcctgcgggataaaaatatcctgtccgaatctcggattatccggcactgcgaacccgaatgtcttgcttttttcataggtacagacgatccggctgaccccgcgggtcaaaatctttgtgatctgcccctctctgcgccgtccgtgcccctcggcgcgtgtcaacgccacctgcacggtatcgccgtgaaaagcaccgtttacctgggattctggaataaaaatatcctcattctccccctcgaccgtcacaaagccaaatcctctcggatgcgcggtaaaaacgcctgtcaggaattttccttccgacttcatgtacttgcctttcgatgacacttccacttttccctccgccacaagtgcatccagcacttccgcgaggtctcttctgtcactctttggcacatttaatactgccgcgatctccttcgccttcatcggcacataaagctcatcgcagatcagtccgtaaattgctttttttcgttcctgtaaaagttcttctctcatatccttcctctccacagcaaaaaagctgccgcagatgcgacagcctcatttctaaaagattcccagattcaatacagcggcaatgatgatgaacagcgcaaccagaatcttggttcccgtcaccagccggccttccatggaacgtcccttgtttcttccccaatacgtatctgccgctccggcgatcgctccgagtcctgcggactttccttcctgtaataagataatgactgtcaacgccaaacaaatcagtatgaaaacaacggttaaaatcgtctttaaaattgccaaaataattccctcctacggtaatcaactcacaactttagctattatagcatactccccccgcgttttcaactgttttttacgctctcccgaaaggctccgccggagaaaactgcgccgtctcgccaagctcctcctcaatccgcagaagccggttatactttgcggtgcgctccgccctgcacggcgcaccggttttgatctgccccgcattcaccgcgaccgcaagatccgcgataaacgcatcctccgtctccccggaacggtgggagatcaccgtgtgataaccggcacactgcgccatctcgatggcatccagcgcttccgtcagcgtgccgatctgattcacctttatcagcaccgcatttcccgcatttaatttgatgccgcacttgatccgcttgggatttgtgacaaacagatcatcgccgacaagctgcatgccatctcccagacgtccggtcagactctgccagccctcccagtcgtcttcctgcagaccgtcctcgatagacaccagtggaaaacgctttgccagatcttcgtagagcgcgatcatctcctttgcatccctgcagattccattctcccccgggaaatggtacattcccgtctcttcattatataattcactcgccgcagcatccatcgcgtagaccacatcttttccgaccgtatagcccgccttttccaccgcttttcccagataccggaacacctcaccggcatccgcaagatccggcgcaaagccgccttcatcgccgaccgccgtagcatatccctcctcgtttaaaatctggcgcaggaaatgatatacctccgcgcccatgcgcagcgcttcccgatagcttttggcgctaatgggcaggatcataaattcctgaaaatccagtgaattcttcgcatggactccgccgtttatgacattcatcatgggaaccggcagccgcttggcgttgcctccgccaatatagcggtaaagcggcatatcgagtgccgctgccgccgtcttcgcgcaggcgagcgacacgcctaagatcgcattcgccccaagatttcctttgttgtctgtcccgtccagctcgaccattctgcggtcgataagtgcctgatccaaaacattcattccaagaagcgcttcccggatctttgtattgacgtgatccaccaccttcttcgtgcccagtccgaaatactccctgtcgccgtcccgaagctccactgcctcaaatcttccggtgctcgctcccgacggaaccgactcccgcgctgtagtctttctccccgttgtctccgtctcggcggtcacctccacctccacggtcggattgccgcgggaatccaggatctcccgcgcgtgtacctctgtaattttcatagtaagtgccataaaaaatcccctttcgcgtaacatacttctgcatcatagtatgtcccgcaaaaggggaaagtattactcgagaattcttccgtccgtagagataatgtctacctgccacggaatcatcttaccgcttgccgcgagtgcatttttcaccgcctgctcgattcctccgcagcacggcacttccatgcgaaccacggtaatgctcttaatatcgttctgcgcaatgatctgggtcagcttctccgaataatccacatcgtctaacttcggacatccgatcagcgtgatgtgattgcggatatattttttgtggaaattcgcatacgcatacgctgtacagtctgcagccaccagaagctttgctccgtcaaaatacggggcgcgcaccggaaccagcttgatctgcaccggccactgtgtcagctccgacgtaagttctgccgcactctcttctgcggcggtcggacagactgcctgctgctcatggcggatcgtcttcgcctgggttcccggacatccgcacggaagcggctgtgacgctatcgcctgctgcgctgctttctttctcttattctcctcaactgccgcagcatcataagccgccgcctcacgctccacaaaatgaatcgcatccatcggacaggtcggcagacagtcgccaagtccgtcgcagtaatcgtcccgcatcagcttggccttgccgtttacaatactgatggctccctcgtggcaggcgtttgcacatgctccgcagccgttgcacttttcttcctcaatctcaatgactcttcgtaacatcatatcctccattctaactccggcacgcatgccggaaattctctcttgacttttcttccacaggatactacaatagcgtcaacatttctgttgtttttacaacaaaaagtcgaaaggacgaaaaataatgcaaactttccaaggatacgatgccctcttgcaggcctctcccgttttttatgatattgcacccgaagaaatccatgccatgctcgactgtctgtcggcaaagaccctctcctatccaaagggcagctttctctttcactacggcgaccatctggattctctcggtcttgtggtagaaggatgtgtggatgtcatgaaggaggatttctggggcaacacaaatctgatgacccgctgccgccccggagacatcttcggagaatcttatgccatccgtacaaactgtgcgctggaagtcagcctctacgccgagcagaattccactgtgctctacttaaacgtctcaaaaatgatgacgctctgctcccgcgcatgtgaattccacaaccagctcacaagaaatctgctctccgttctcgccgagcgcaatttccagctcggacagaaattagagcacatgaccaagcggaccacccgtgaaaagcttctctcctatctgtcgagcgaggcgcgcagatccggaagttcgtcttttgatattccctttaacagacaacagctcgccgactatctctccgtagaccggagcgccatgtcgaacgagctgtgtcatctaagagacgagggtctcatttcttttcagaagaaccacttcacggtgcaattcccttcgtcttgaggaaatccacccagattccgtatttcgagccgtacagatgcagattgtcaaacgtgagatccgctcttaagtttccgtctgcatcacatacgacatcattcacatcaatgtaaaaaatagtctgattatccgcaagttccgcaattctcatattgcgttcattgattccctgattgttaaaaattttgtccgagtcggacttgacctttgcaacccgcatgatgccctgcacatagatgatcgcatcgggctgaagctctctaaatttctgaaccgactgcgcgtactgctccataaaaccgtccagggttcctcttcccatctcattgatgccgatctggaaataaattttgccaaactgccgtctggaaagcgcatcctcaagcgtggtcttctccccgtccacctcacagaacttttccgtccacatatcgtagattccaagccctgtggatgcgtaaaaggtcgcattgtccagcccgccgtaatcgcgcagccccacagttctcgaatccccgataaagaccgcgtcgtcgaaccagtcgtcatccaccatacagaattcccgcgtgtgcggcgcctcttccgtctctgtctctccgaccgtctccgtcccgccggcaagctcagtatcagagacactctcccccggcagcaggatggacggcagctttccgttctctcctatgccgcccggcgcacccacatgactccacggaaaaattccgtcatgcagtccgtcaaacaccaggacgaagtatggtgtcgttcgtatatcaaccgtataattcttatatattgtatctttccccagatagccgacaaccgacagcgccgcccacaagataagcagtgcgaccgttaccggacatttcaaaagctttctcaaatccatccaccacacatttaaaaattaaagtacaaaaacggattgtttgccgacaccgccagatagtacatgcaaagcccgaaaatgccgagcagtatcaccctgccgatccatttgcgctcgatcagccgatagcaggtctccggaagcggcgttgcaaagagcacgcccagaagaaacagcggtgcatagtcattcagatattttaaataatccagatgattgatgacccctgccgcatgccccgcaaacgggaacagccgcgtcatataaacgccaagctccgacagatcggtgaccgcaaacgccacccagctgagcggaacaacaaacaatacataaagatgaccgatcaccctgcttttatccagcaggcgcagcagaaagagcttttctaccaacaggcagcaaagcagaatcccgccccagatcaggaagttataattcgccccgtgccacaacgcggtaaggctccacaccacaaacagattgaaaaaggtgcgcgcctttcccttccggttgcctcccagcggaatgtatacatattccctgaaccatctgccgagcgtaatatgccatctgcgccagaattccgtgactgattttgaaatgtagggatagcggaagttcaccgggagctcaaatcccagcatctttccgattcctctcgccatcatcgaatatcccgcgaagtcaaaatacagctgcagtgagtaagcgaacgctcccatccatgcaagctttgttgagatgctgtcgaacccgatcatccggatgctgttccagagtgtgccgatccggtccgcaatcacgacttttgctgcaagtccgataatcaagagcttcattccctcttccagctgacgtgccttgatcgtgcgctctcttcccaatgctacacgcacatccgcataatttgtgatcggtcccgatatcagctgcggaaacatggtcagatacgttcccagccgaagcagcgactgttctgccggaattcttccgcggtacacatcaatcacgtacgccataatctgaaacgtgtaaaaactgattccaagcggaagtccggatgccagaccactgtacttgaagaaaaacagcacgcccagatcatacccgagcgcaagaagcaataagcgtttctgtctgattccccgcccgtccgtattcttccggtacatcaaacgggtcagcgtgtaattgaccagaacacacgcaaggagaatcgtaatataacccgcctcgccaattgtataaaagacaatacttccccccagcaatgtgacattgcggaactttttcggtgtaagataatatatcactaaaaaaaccggcaaaaaccgaaataaaaactcaaaactgctaaataacattccacagactctttctatctgacttctatctactgtatccctatttactatacctcattataggcaaaatattacaaaatggtgaactattactgaaagtttgtgaaattgtatcatttttgtcataaacgctctattctgtaatcttttcgtaactattttgcctcaaatagcgcctcaatctcaccgatgaaatagagcgaaccaaacgcaaccgtgcgatgtgtttcatcgagccgccctctctgaaaacaggacgcaaaatcatcagctgatgcagctgtaattcctttccgccggatgcaatccgccagggcgtccgcctgcagcgcccgctcgcactccaccgtgcaagttgtaaaatcaatggcaagcggcagcaattccccgatcattgtctcataatccttatccgccatcacgcccatgataaaatgaaacttttctcccgggaaaagcgccacgaggctctctcttaacgcttccacgccgttgctgttgtgtgcgccgtccaccagcagaaacggtttttttgagaggatttccatcctgcccttccatacggtcttagcgatcccctgacagactgcgcgccttacgccctcttcccgctcttttgtcccgccgcagatccactctgtatgtctcctgaaaaatgcctctgcaccaagaagcgccgcgatggcattttcatactgatgaacgccaagcatgcgcatggacagatcacggtaggcaccaaacgaaaaatactgtctgccgtcgcggtaagtctgctcttttatctccaaagggtcgatcagccggaaatctgtaattccttcctccctgaccttcgcctcaaacaccgtcatgacttctgcctcctggctctcaagcacaagcgaggtgccttttttgatgatgcccgtcttttccgcagcaatctcagcaagcgtatttccaagcaccgccatgtggtcatagccgatctttgtgatcacggttacatccggcacacctacggcattggttgcgtccagcctcccgccaagtccggtctctaagatcatgacatcgcatcgttgttccttaaaatagaggattgccatggcaagtgtaacgtcaaacatcgtcggctgcacgccaaaatccatcgcaagaagctgcacgccgatcctctgcgtatcccccttagagatcattttcccgtttatctggatgcgttcccgaaagtccacaaggtgcggggaggtaaacatcccgacgcgaagtcccgcctcccttaaaattgcgcagagaaaagcagagacagaaccttttccgttcgtccctgctatgtgtatcaacggaatccccgcctgcggactgccaagcgcctttaacatgcgcccggcaacctccactccggcaagattcccgaatcttctgatctgattgatctgatctactacttcttcatatgtcatctgtgtcccgcgttcctctccgggcagcagcgacacacccgcgtgtcttacactgccatgattacgccgccatcatttgcatacatactgctgacaccggcagtatttatgataatgattttcttgaaatttgcaagcttttctatgcgggcttttaccgctgcggcgcgctccgggcagttgcagtgcgcgatggcaagcacacgctgttcgcagtccttcgtgcgcccgatcatatcctgcaccattttctcaagtgccttgttcattccgcgcgcctgaccgagctggcagatcatgccctcctttgtggaacccatcaccggcttgatattgagcgtattggcaatcagcgctttcagattggtcagtcttccgttcttgcgcagagtctctaacgtctctaagacaaaataagtattcatggaattgatatactcctccgttctggcaacgacctcctcaaacggaagacctgcctcctcgaactcctgaaccttaagaccgataatcgtctccccgatcgatgcagacctggagttaaatacatagatctgcttgttctctcccggatgttcctcctcgtagaggttcctgccaagctctgcactgttgtaggaaccgctcagcttcccggaaagcgtcaccacatatacatgctccgcctctccctcatacgcctgcatatactgctccggtgacgggcaggaggacttcggtcccgcgatgctcttcttcacccggcgcagaaaatcaagctggttaaatgtctcatcatccttaatgcggtaaccgtccacctcaagttctaaggacaccgtctcaaaatgtccgtccttcttcagttcctccggtaattccccgcagctgtccacaacaatcttatacatggcaatccctccacctgttctatggcatgtgtttaatgttatcaataaaccgttaatatatttttcgtttctatcgcatgtagtattcaatactatgttacattaacacaaaaaccattctttgtatagaggtaatttctaaactttatctaaattatatcttacgaagcattctttctcacgaagcgagtgtaaaatatgcggtcacaagatcctttaacgcctgctggtcagcgctgcccatcagctccctcgcggaatgcatggcaagaagcgggattccgatgtccacggtcttcaccggaagaagcgcggaagcgatcgatccaagcgtacttccccccggcatatccgagcgattcacaaacttctggtacgcgatcttctctttctcacagatctgctggatgatggcaatcgcctcgcagtccgtcgcataagactgcgaacttgcctccttgatacagaatccccttccgagcacgggcttgttggtgagatccattttccctgcctggttcggatggatgccgtgtgccacatccacggacagcagcatgctgcggtagagatcctgctccgccgtctgttcccgtcccagctcttttaagatgcggcgcagcatgtcatgcagcagaatcgaaccagcgccctgcttcgtatggcttccaatctcctcgtggtcaaacagtgcgatcaggttgattccctccatccgcctggcatcaatcagaccggagatgagcgccgcgcaggaagtcaggttatccaggcgcggacttgagataaaatcatcgttgagaccgatgaattccggattttccttacagtatacggtcagttcaaaatccagaatgtcagtcttctccacagacagctcgtctgccaggaatgtaaggaagtagtccgcctttttctcctcctccggcagcagcgcaaagaccggcagcatatccgtctggcggttcagctccacacccttgttgacctcgcggttcatgtggatcgccagattcggaatggtcagaagatttttttccaatacaaactccacaatcttcggggcaaacgcgtcctgtgtgcgcactgccacacggccggcaataccgagcggacgatccagccaggtatttaagatcgcgcccccgtatacttccacattcacctgcgcgtaaccgcatgccgtcacatccgccgacggcttgatgcgcaggcacggaaaatccgtatgcgctgccgccatccgaatctgtggcgtctttgtctcctgccagccttctcccaccgtaaacgcgaacagtgtggtgtcatgatgatttacataatatcttccgtttttctgcagcttccacggctcatcatagggcagttccagaaatcccgcgctctccaggcgctctttgcaggcgcggactgcctgtaccggcgacacaccttttttcagcaaatcaaataaaagttctgtctctttcatgtctatgtcctcttttcttctttatctgtgaccccttccggggctgttctctcagcttcctatcataccagaaatcatattgtgaagcaaaccttcccaatcgactttctatttgtccccaatctgtgttatactacacaaaggcaatgcgccccaatactatatgacacggagaagactatgattgcactttccctaccggaaattaaagattttatgaataaactgctgtgtacggacacgttcgggcactttcttctaaaggaagccgtcatcttgggcagcgtcacctggagcttagacggcacgatccagcccgatttttattcatcagatgaagccgatgcgctcggactgacgggactttcttttctcccgtttgaacaggtacggccgcagtgttttgacctgatcaagggcaaacgcactccttcttattttaaatttgtctttctgctctccccgaagaatctggaacggacactgctttcgacccacagttcttttaccccggaggacattacgggaatgtttatcaatctgaaattccagcagaaaaaactgctccttaccacgggcatttcgtaccggattttctccgtggacaagagcctcgatcaggagtgggattcccttgtaaagcgctttctcactgcgcatgaaattagttttgaagaactttaatttattactttacttttataaattcttatgatattgtactaatagctgtaagttacagttagtattatttttggaggtactttttgatgaaaggtacagtaaaatggttcaacaaccagaagggttacggattcatttctgacgagtcaggcaacgatgtattcgtacattactcaggacttaacatggaaggtttcaagtctcttgaagagggcgcttccgtagagttcgacgttgtagaaggatccaagggaccgcaggcaaccaacgtaactgtagtaaaataattactgcaggcggtaagcttaccgcgttaaatcactagtttcatgtacctttttcttaaaatagacttgttttatttgttagattaagatattgtaaacaatggatttaaaaagagtctgtcacaagttttcttgtggcagactctttttgtatatgaacttagcagatcaggttaggattatcctgttttttcaggcatttcaccacattgacaataccgctctccgccatgctttttaccgcttcctctgtataaaacgcaatgtgctgcgtcatcgtcacattcgggaactgtctcagatacgccatattccggtttgcaagaatatccgaccggcggtccatatggtagattccctcctcatgctcgatcacatccagtcccagcgcaccgatcttccgcgtctcgattccctcgatgatgtcatccacgcgcatcaactctcctctcgcgcagttgatcagaatgacgccgtccttcatctggtcgatcgcctttttatcaatcatataacgtgtctgattggacagtggcgtgtgcagtgagataatatcactcttcgcgtacagttcctccagagaacagtattcgattccaagcgccggatcggcattctgacgtctgctgtatgccagaatcctgcagccgaatccctgcagattctgtgccaccttctgtccgatttttcccgttccgatgataccgacggtaagattacgaagctcccttccgatcagcccgccaagcgaataatcgttggcattcccgcggaacagtgcctgcttataattgcgaagcgacattaaaatcagcatgaccgtatactcggcaacgccgtccggatcgtaatagccgttgcagacgtgaacgccattgctcttcgccgcattcaggtcaatatggtcatacccgatggtacgtgtcgcaacgacgcggatacgccgctttgcagtctcctcaatcaatgcggcgtccatctttgtatctccaagaatcgtaatgccgtccgctccctcagcacgatcgatgttgtcctgtgtcatcggcccctgcaccagtgtgatctctatctgctcctgctgtgctgcggcaagcaggtaatctttttcatccggtctcacttcataagctgtgattttcatgggtatcctctctttcaagcattctgcactattttctaaaatgtgttcaccgtgaacacgttgttatagaattatcataaattgctccggtctgcaagccgatgctttaaagggatgaataatccttgtcatttttttgtttttccttgcataacagaaaatattgtgccaaaatcaaaacaacagacactgacccggacaggaggttcttgatggaacagccgattttatcttttcttaccgcatatttttctgacctgcatatccagtgcagactgaccgaccgcaaacagttagaactggcggatctggatctcggactgcgcaacagtatcctgatgcaggaagccgatgcgcaaaaacaggcgccatttccatttgtgcagaacaccatctattttattgtagattattacgagtgtaattattcttttttccgtctgccggataaaagtgccttcctgttcgtcgggccttttctctggaaagaatttgagcgctcccagattctgtcgcttataaaccggctggatattccggctgaactttttccacagctgcaggaatattatcacgccctgccgctgatcgcggacaaagcctccatgaccgccctgctgcgccacgtctatcagacgctggatgccgacgcggatgtatccgtacagaccctgcatttgaaagatctcgagaccagagagtcctttttggaaaagcaccagtttgtcgtaccggaggacccggtcttaagcatgcaccttcttgaagagcgctaccatatagaggatgagctgctcgacgccatctctcacggcaacagcgcccgtgccctctccttcatggaggctctcgggaacctgcgctttgtcccccgcacggaggacgcactccgcaaccgcaagaacctgattctgacactcaacacgctgttgcggagaaaagcgtacgaaacgggcgtccacccgttttatatcgacgccgtctccggcaactttgcgcgcatgattgagagcatccaatccgtggaagaaatcaacgatctcatatcctacatggttcaaagttactgtcagctcgtggaacagcgaagcatgagttcgtattccgatccgatccgccagattctcgtcaccatagacgcctcactgaccggggacttaagcctgaaacgttttgccagcgaactgtttttgaatacaagctacctgtccacgctgttcaaaaaggaagtcggcatgaccctgacggactacgtcaacgccaaccgtatcgaatacgccaagaagctgctgcgcagtacccttctgccggtgcaggatgttgcggcagcctgcggcatccccgacgtccactatttcacacggctcttccgccgcatcacgggcatgacgccccgcgagtggagacgctaaaagaccgggcatggaatgtggcaggcatggattttgcaaatatactgtatctgcctgttccggactgccaaccggcggcgggaatctgaaacgcaaaatggggtatttctaatctataccgcgtttggtatctccgatgatccgtgtttttccaagctttgaacactccgcggagagtgtccgcaatccgcagacaattttaggacttttgtgcagcgcttgtctgcgcttctgaataaaacataaccgcgcgaagccgatgtttgaattggcatctgccttattttcaatagcagatgccaacgagtttcggttcgcgcggttttatattgtctgtgaagaagcgttgctagcgctgctaaaaagtccgcccattgtctgcggttgtcggacatctttcgcggattgtcaaaacgtggaaagacacggaatccgataccaaacgcggcatagaagaaatgctcccattttgcttcaaaggattcccgccgccggttggcagtccggaaccgtgcaggtacagatttttttaaatctctgcccaccacattccatgccccggtcttttaagcttctatcttagtctactctcttaatcttattgagctgtgcgttgagtccgagaagatcttctttcttccactcaaccttcggtcctgccgcacccatcaggttgatcatacggatgaccgtaaatccgcccagcatttccagcatcttcgggttcgccattgcttctgctgcaggatttccgtcatttttttcattaccctgactcattcccgctgcaacttttgacatcagtcccatgaagagtgcttttccctcttcggacttcatgatatcagaaagtctgtcattcagtgaataatatccttccggctctgtgatgtcgaaccagttgaggattgcgccgctctctttcaggctgtactcctcgttgaaggtatccaccttgcggatgtggctctcatccttatactctccggcaacagccaccagggtggattctccgacattcggtacctcaaagtggaagaaatgatcctccgcctgaagctttcctgcactcttgccgttgacaaacagctctacctccggaagattggaatatacagttaccttcgtggtatcttccacgcggtctacatagcgttttccgcacagatgtacaaacggctcatcagacagccatgccttgtatgcatagaaggaatctttcttgtacttgcggtcgaaagttaccagtcccttgtggttctgaccgttctcaccgccctcgtttctcgcatctgcaccgaaatcgaacatgttccatacatgcgttgcccagatatactttctggtgaagagctgcttgatcatctcctcatgatagtatgcctgatactcctcggtgtaatcgccctgcttcggatcagaggtatgccagttcagcgcctcacatccgtactcgctcattccaagcgggatattcgggaactctttgtggaagttgtccatccacggtccgttcatggatacgtctccgccgtaccatccgaagtaatggttgtaagagatcacatccggaatctggatgtacggatcgtgaatatcacacatggataccaccgcgatcgtggtcagtctcgtgtgatccatctcatgaaccatgtcatttaagattctgtggttctcaagcagatcctcatccgagcttcctgccatcgtgatctcgttggaaagcccccaaaccacgatactcgggtgattgtaattctgaacaaccagctctttcatctgggaaatggtattctcacgtccgttcggcatgtgagaggaaatgtacggaatctcagcccagattacaagacctctctcatcgcacagatcgtaaaaatactgatcgtgctggtagtgagccaggcggatcgttgtagcaccgagctcgcagattaagtcaatatcctctctgtgatgctccggaagcagcgcattaccgattccccatctgtcctgatgacgggatacaccgcgcagcggatattcctctccgtttaagataaatcctctctccggatcaatctcaaaggtacggcatccgaaacgtgtgcttaccgcatcaacggtctcctctccggatacaagcgccacctctgcggtgtacagatacggatctttctttccgttccacagatgaactgccgggattgtaagtacagcctttgtctcgccggctgcggtctctgtctttgcaacctctttgccctctgcatcttttacggtatatacaagcttctggtctgcagctgcattcgtcaggaatacctctacctccacgctggcatccgcgcccttgatctccggtgtcaccttaatgccaggtccgccgtagtagtccagatcaaaatgggacttatttaccgcaatgatattgacgtcacggtaaagtccgccgtagaatgtgaaatctgcattctgcggatatactctgtcgtttacgccattctccacagcgatcacaatcaggttctcttcttctgtgagctcttttgtgatgtctacacgccaggtggaatatcctccgtcgtgatgtgccactgccttgccgttcacatagacgtctgcagaagcgtttgctcctcttaactccagataatagcagtctgcctccggcagttcgctcttctttaactgttttgcataataacaggttccgcggtaataatcgttgccgccgtcctgtccgtcaatctcattccaggaatgtggaagtgttacccagtaccacttctctggcatctccttcggcacttctgtggcttccttggtaaatgcccatttcgtattaaaattgattacttctctcatgtgtcgcatccctccataaaaagtatcgtcaacattcatctgtctgcatcgtaacacagaaccgcacttttttctttagatagtttttggcaaaaatggcacaatatttagcattctacctttattttgaaaaacaagttcaattctttgcctgatatttcaggatcaatacggaaaaaaccagaatgcccacgcacggaatcagattgcagaacattccggtcacaagccccacacgatcagcaatcacaccgatcagccacggcatcacgatcgcgccaatccctgccaccggcagcatcacaccgagactcgttgcattcatctccctgccggctcccgccacggcgatcggattgacccctgccatggcgaatgcaaaggcgaacagcatggcgatggctcccgccggatgctgcatgtatacaagcccgcagtacagcacgctgcagcagccgcccatccacgcaagcgtgcggaaaatatgatgcaccggaaaaacgaacgcgatcagaagtctggcgatcagagtcgccccccacatcaccgttaccgtgtatgccgcaaaggaacccgagagaattcccatgtctttatagtatgtcacgagccatcccgtcacactcgtctccgccgcattctggcagaataaaagcccggtaatcagccagaatttcggatccttcaaaaatgcaaacgagacctttccccgttcgccgttcttctctttgaccgcgcccggaagtcccgccgtcaaaaatatcatccacaaaagcagccccgtcaccgccactcccaccatcggcagagtgtcgttgatttcaagaagcgacgccgcaagaaacggacacagcagcgcaccactcgcatagcaggcatgtagtatgttcatgccgcgtgtgcgatcggcactattgtcttttacaaggattgtgcaattattgagtgcccctccctttgcaaatccgaccaacagaaatgccgccatcaacacggccggcattccagtcaccgccatcagaaagtaccccaggaaataaccgctgcagagaagaagcactgtattcttcactccgattttctgcggcagaatacccgccgcaaaggacgccgccatatttccaatgctcatcagtccgagcatcgtacccgtcatgccatagtcaaattcatattttccctgcagaatacttacaataatcccgctcgatattgcgcagataccgctcaaaaagaatgtaatatagccggtgttgcgccatcttctgccccagtccgttgtatgattcatctgtaccttctcccctataaccacttacagagagccgcaatacggctctctgtaacaatacttcctgtgttcctgctaaatgtttatctgtttttacccgcaccgaacttgtcgagaatcgaaccgtccgaaaacttacggatgtatccaatcagctcgtccgatacgctgacgatgtgcgcttttacgccatcgcactccttcaccacgccgcggagacgtcccatattatctgtggtgacctctgcgctcttcgcattctcatctgccgaagccgtaagggaagtgaccccgttctcaatgacgctcttgtgattctcaagatcgccgacctccgtgccgattccgccgatagcatctccgacctgttcgatttctcggttcaatgatttgaagatctcctccgtgtcatgaatcttctcattctgtctggaaaatgcctccgatacctgctcggtaatctgaacgctgttgcttgaattatccagcaggacattcacgacatggttaatctgctctgtggactctctggactgatccgccagtgtccggatctcctccgcgaccacagcgaatcccttaccgtgctcccctgctctggcagcctcgatgctcgcattaagggccagaaggttggtctggcttgaaattcccgcaatgatctcagtcgccgtccggatctgctgcgcggactgattcgtcagatctgtctgctttctgacattctcgatcgcaacgccgctctcctcactgatggcaatcagctcctgcataatctgctccgccgaacggttatattcacgcatggcctgcgcactcttcgtcagatcctcaatattggaagaaatatgatcgatcgacacgctgatcgcgtccaccttttccttcatatccgccgtctcagacgcctgggacaccgtattgccggtgatcgtatcgacagcatctgccgtctgatccatcgactccgacatttccgagaaaatctgctggaaatcaccggataccccttcgagctcatccacagccttgcggattcctccaagcaccagctcaatcgatgaaacggacgtctcgatggaacgcaccatctccccgatgccgtcttcacggtctgccagctttttcgccttttccgcaacttttgtattctccgatacctttccgttaatcacggatcggatctgatccagaatcgacttgatcaccatgaagattccgccgaacacggcagccacgatcacgcagatcagaatcatcgccatgactgttccgatcactccgctttccaataattttaaaatgatcagaaacgccaccagcacaatggcaagaaagccggcaagcggtgccatcactttcccccacatctcatttttcttcgtatcttccacgcaaatccctccgctttcgtatggtaatgtataacacttgccttcattgtaccataattaccgcaaaatacaaacagcttttacggctgccccatggcaagctttgccttcacgatacgcgtcacggattcattgatccgctcctcggtgatcgttccgtcattcaccgcattcagaattcctgtataggcggtattgtagtccgccggcatcaaaatcatgtctgccccggctgtaactgccagaaccgccgccttgtccgaattgtagaatccggtgatcgcttccatattcatggcgtccgtaatgacaattccgttatatcccatctgtccgcgaagcacatcggtaatcagcaccttcgacagcgtagccggcgcattgtctccagtcacattcggagccgagatatgtccgaccatcacaaaattcacgccgccgtcaatcgcactctggaacgggacgagttcttccgccatcagttcctccagggtcttgtccgtggacaccgccccgtcatgagaatctccggaagtgccgccgtgtcccgggaaatgcttgaccgtaccgtacactcccgccgcggaaagtccctgcagttcagacgtcaccattcccgcgaccgtctgcgcgtccgacccgaacgagcgctgtccgagcacctgattgtccgggttggtaaggacatccgccaccggcgcgaaatccacattgaatccgagtgccgcaagatagctgccgatcgtgcttcccgcattgtatgcattctgcacatccccgctcgctccgatatcgctcatattgccgacgtccgtcaccccgaaggcatcattgccggcgatgcgcgcgacactgccgccctcttcgtccacacataaaaataccggaagtccggtgcgctcccttgcaatctcctgcatattggagagcatggtggtcgtctgctccgggtcggtgaggttgtctgccatatacacaattccccccaccggacggctctggtaagcttcctttgtggtgtcccccgcagccgtcacaccgcttgcatatccggtcagcgcattcggcgtaatcacaaacatctgcgcgatcttatcctcaagcgtcatctgggacacaagctgcgccgcctgctcctccaccggatcggtctgtacttccgtctgcggctgctccgttacttcctccgtcgccgcgacattctctcccggcagctcggttccgtcggtaccttcattctgtccgcctccctttggcaacaggcgtcccacaagaaatactcctcccgcgaccaacacgagcaggatcagcacgactatcacacacacaatgaccgcacttttcgtatctttctgtcttctctgacgtctctcttcctgattcatatgcttcctctttccaggtgttctctttttctatggtctgattatagcaaatcttttccggaaccgaaagagctatttttcccttaagcctgcgccggcaccgtggataccaccagactcatctctccctgcatctccacctcgccgaatccgcacggtaaaataaagtgatctccctttttcaccggctggccgttgacgataccgctaccttccagcacagacatcagcaggaacggatgattctgtgcaaaactgcatgttccgttgacatccagcttgtaaatctgatagtatccgcaggcgtacagctcgttcagccggttctccggcagtccgagtgcagacgttacactgtcctcgacggatttcgccggaacggtgatcacgtcgatgctcttctcaatgtgaagctctctcggcctgccgttctgcagtctgtcataatcgtacacacggtaggtaatatcgctgttctgctgtgtctccaggatcagaagcccgcccttgatggcgtggacggttcccggatcaatctggataaaatctccctttttcaccggaatctcgcggataaattcgctccagcgtccctcgtggatcatggaggcaagctcctctttcgtcttcgcattgtgaccgatcacgagcgtggcgttctcgggcgcatccataatgtaccagcactccgtcttgccgaaagaaccgttttcatgttcctttgcataggcgtcatccgggtgtacctgaatactcagatccgccttcgcatcgatgatctttgtcagaagcgggaagcggtcgtaggcgaggttcccaaatacctccgggtgctcctcccacacttttgacagcttcatgccggcgtacacaccgttcctgatgctgccgtcgccgttcggatgtgcggagatgccccagcactcgccgatgtcgtcaccctccaccggatagccgaactccgttctaagccgggtaccgccccagatattgtgcgtgcacaccggatctaaaaataagatttcttttgttgtctgattcattgtcaacatccttccattcgtctcgattattttctgataccagaaagcggaatccttcacaatccgcctctggcttgcaaaatccacataaacaatgccaaaccgctgcttgtatccgtccgcccactcgaaattatccaggaaggtccagaggaaatagccggctacattggcgccctcatcatatgccttctgcatcgccccgatataggaatccaggaaggtaatgcggttcgggtcatgtaccctgccgtcactgctcaccatatcatggcaggacataccgttctccgtaatgtagagcggcagcggatagcgctccgtcaaaaacttaatgccgtagtaaaacgcctccggcgtcaccggccagtccgatcccgtcttcgggaaccccggcgcacggtctacaaattccggctcgccgtctgcgccggcgcggacgtagtacccattatatatattctgtcccataaaatcaagcggctgatagatcagctccatatcctcctgtgtgatctccggaagatacggcgcaaattttttcagcccctcctcggggtaatgtccaaggaataccggatcggaaaaccacgatacattccaggtccagttatcgatcggattgtaaaatccgaaatacacctttttcgccgcctcaatgtcctccggccggtcggtgtacggatatgccacgccgccggtcggagcgaaaccgatcttgaccggtcggaccgcatatctgcgcaggttgatgaccgcctgcccgtgcgccatcagaagatgatgcgccaccagaaacgtctgcgccacgggaagtttcacgcccggagcatggacaccgctcagatgtccgaggccgaccacgcactgcggctcgttgatcgtaataaaatattcgcagatatcactgaaattctcggcaaccaccttcgcatattctccgaaccactgtactacgtccggattctgccagccgccccgctcataaagcgcctgcgggaattcccagtgaaacagtgtcagatacggtgtgatgccgttctccttcatcgtgagaatcatatcacggtacatggcgatcgctttctcattcacgcgcccggttccctccggcagaatccgcgcccagttcagtgaaaaacggtacgcccggatccccagatgcttcatcagcgcaatatcttctttataatgatgcatatgatcgcagcttgtgtctgcattctgatgttcaaacaccctgccgtccgccgcaaacatatcccagacgcacgcgcctctgccgtccgccgcgtccgttccctctacctgataggcgctgctcgcaacaccccacacaaaatcctctcgaaacattcttataacctcctgctcctgcaatcgcagtgtctctctctatcttccaacattttttctgattttgcaatgcttttgcacgcatattctgcaaaataggctgtctcttgccgtcagtctcttcctcttctccccgtcgcaatcacggacaccagataaaacggaaccgcatcgtcctcatgcgtctctgcgaggcggatcgtgacgatgtgccgcccctcttttccgtgctctaaaagtgtcgcaagctccagtttatctccccaggtctcatcaaaatttgcatccagacgcaccgcatgctccgtatcgtcatccacgaccgccagtgcaaccggcgcgggaagctttaccgacttccggtactggacggcaatgcagctgccctccaccaaaaaggtgatggcatcccccgtctttttcgccgtccagccatagcggaagcagtccgtgatttcattctgcgcggtctcatcgggcgtaaatccatccagcgtgggctgctgcaatcctgccatatccggcgccgcggcattgcggatgcggacagaatcctcgtaggcattttttgtaagcggaaccggaagctttgcccccggtgcaaaactggcattgctgccggtcagttttctgcttcgtacctgctccagaaaataagtaatcaccgacgccaccagcgcatgtccctcatcgttcgggtgcagatcatccggtgtgatcgcgcggttttcaatccgccctgccaccacctccgggtaaatagagttctgcatgctgaccgacggcagatcataatgtctgccgattgccgcgtgcatcacctgcgcgttggctccgttgtggtaaaacacgttgtgtaccagaagaaccgccggattccacgcggcgccaaggattttccgcaccagtccctcataggtctccttaaaatgctccgtgctctcatcattgacggaaaattccacaatcacaaagtccggtctctccgccagaagatccgtccccacacgcgccgcgccgaactccgatgtcgtgccgccgatcccagcattgcagtagacaaactccgcctgcggaaaggtctctttccaccatgtatacacacggtaggcatagcacgtctgcggtgtcgaggaaaggcttccctgcgtgatcgaaccgccgataaaaccgattaccagacgctccccgcgttttgcgcgcgccatgacctccttcattctgctcacatctcccacatttgcaattcccttttccagatcaatctgcatattcatatttctgctccttctctctttcttttccctttattgtctctcaaacatcccagatttcatctccgagcgaacggatataggaagccagctcctccgacatctcctccgcctccggaatccggatgtgtccgggcgttccggagccgtttctccggtacaaaaagtggtgcacgcgctcacttgcaatctgcccacacaccgtctcaatcgccgcatcccagttcgggtgatgttttaagatggttgtcgcaagaatgatctgcgcctttggatagtgcttcatcagtatctcaatgaattcccggtagcgcttccgccagtgctctgccgcactgccctctggatccgctgccatatagtccaccggatgattgtcattctgcccgatggcaaccacaaccacctgcggcgtatagcgtgaaaaatcccatttctttacctctccaagatccggattatactctagcttgtcgtaacaggactccacaccgtagtatgccggcgcaccgaaccatcccgtcccgtcaagcagcgcaatgccgccctgtgaggtatcgtgaagttctgccccaagctttcgcgctgtcatccaggcataggaataccagctgttggaatactgtccgtcgtgcaccggatcctcttttccgacatagtcgaccgcctccgacacctcgccgcacgagacactgtcaccaaacacttccatccggcgggcgggctttggctccggcggcaggagatctgcgccgtcatccacggtaaatccgtagaacgtcaccgtatggcaggcatccatgcgcttgaacagcatcagttcatgccgcgcatccggcaactgctccgcaatctcataggttttcttttttccgtcattcaaaaggcggatgcgcccctgcaccccgtctaagagatagcccatctcatttgtccagtacgcatgatggttggcaagcgtgactgccaccgatgttccggtaaaaatcattttcacccagcttgccgcatagataagcaccggcgccttcggatcgtcgtcatcgattcttccgctgtactgtaacatcggatcgtccggctcgatattcctgaccattttttttgctgtcatttcttttccccctctgccttccggcttcccgccggatacgcagcagggctgcgaaagccccgaggtgttacgcacacaatgcgtccttctctttccggctgccgcagccccatcattccagttctctgttatctttttccgatctcggtatcggttgtcgtcaccacactgtgctccttgatgtaatcgatgatgtcatccagttccgtgaacgccagtcctacatagctgtctgccgctccgtaatagatcgcaatctttccgctctccgaatcgtggatcgttgcacacgggaagcatacgttcggcacgaatccgcgctcctcataccactcttcaggagtcagaagaaacgtctcacagcggtacttcacgatggaaggattgtcgatgtctaagatcgcaccgccgatcgagtacacatatccgttgcaggtgccgctcacaccgtggtagaacagaagccatccctcggatgtctcgatcggagctgcaccgccgccgatctttaaggactcccaccactcggaacccttgcccatcacatgacggtgttttccccagtaggtgagatccggactctcactgataaaaatatcgccgaacggtgtgtggccgctgtcggacggtctcgagagcagcatgaaattgccgccgatcttgcgcgggaacagcaccgcattccggttaaacggcaggaacggattctcgattctggtaaatgtcttaaaatccgtcgtcttcgccataccgatcgctgcgccgtagaaatcctgacaccagataatataataggtatcctccaccttcacaagtctcggatcataagcgtagaccggcatgaaggactcaccgttctcgtccacaaagttaatcttgttttcctcaaaattccagtggatggcatccttgcttcttcccagatagatatacggaattccgttcgtctgttctccgcggaagacgccgatgaactcatccccgtacggcattaccgcactgttgaagattctcgccacgcccttcaccggatttctgccgatgatcgggttctccttgtatctccataccggtgctccgtttaactccgccgggcgctcctgccatggcacattcggtactttggggctgatcattttatatttgctcataacttctacctctttctgccgccgccgcggctcatttttctatgatgaccgtatttattcattcgcttttaaaaatgcaagattcttctcgatgagaccgcaccgctgtgccacacactccaccgatcttcccggatcggacggcgtatggaatacatagtccaccagcttctccaccgtcgtggtcgccacatgcatccgtgtatccgaggatgcgtagtaaataaacacctcgtttttctcattgacgaccgctccgttggtgaataccacattgctgacatccccgacgcgctcctctcctctcggtccgatcagaagcccggacggctcggcaatcactttcgacggatcttttaagtccgttgcaaacgcatagataacataacgcagtcccgctgccgtgttgcgcacaccgtgagcgatatgaatccatcccttttccgtcttgatcggcgtcgcaccggctccgttcttcgcctccgtgatcgtgtgatacttgcgcagactcgtcattttttcctcatcgatcacagcgtgtgtgatgtcctcgcagagaccgaatccgatgcctccgccgcttcccgtctcgataaaatcatccatcggtctcgtgtaaaacgcatatttgccgtcgacgaattccggatgcagcaccacgtttctctgctgcggggaacgcagcgtgacgaggttcggcaggcgctcccaggtctttaaatccttcgtgcggacgattccggctgccgccactgccgccgagagatcgctcacactcgtatcctttgactcggagcagaacacgccgtagatataaccgtcctcatgcttcgttaagcgcatatcgtagacattcgtctcctcagggcaggtatccggcagaagaatcgggtaatcccagaaacggaaaccgtcgattccgttgtcgctctccgccacgccgaagaaagactttctgtcattcccctcgatgcgcgccaccagataatatttcccgttcagctcgatcgctccggagttcatcacggcgttgatgccgagacgctccataaagtacggattggtgtccgggtttaaatcgtaccgccaggtcagcggaatatgctctcttgtgagaaccggatactcgtaacggtcaaatacgccgttgtaaaaatccgatttctcgtttttccgtgcaagcagtttttcctgcttttctttttctatataatatctctcatgcagcataaccaattctcctcaattttccttgatgcgtcccagtacctcgatacacatgcgcccgttgtgatacggacatttccacggctccacgatcggccggtctaaaatcgggcttccgtcctcatacacttcccagtaccactcgcttcccctgcgaggatcaatgacgtgttctttgatgaactgccactccgccaacgccgcatcccggtactccgaatgatccggcatctgttcacaggcatttaaaaatccgactactgtctccgcctgcacccaccatacacggtgtgtattgactacgcccctgtcacactcatttgccagggagtgtccgtcaaacgccgtctcataaatatgtgttgcaagcgcctgtgtgatcggaacaattttcgcctcatacgcctcatcgcccagcaccttgacgccgcggtccaaaagccacgctgtctcaatgtcatgcccgtaggaatgcagatctaaaatcgtgtgatacccggcatcgaaaaacacttcctgtctccgcttcgccggattgtatactttctctgcaaacacatccatgatccaacggaggcgctcccccacggtctcatcccgcgacacacggtacagctccgtgtacgcctcaaaaacatgaagcagggtgttcatcgtcttatctgcaagcacgccgttctccgacagcttctcgttggattccggctggaactctctggtaaaagcctccaggtatccgacctcatccgtacacttctcctcgatcagggaaaagagctgcttcgccagtgcaagcgcttcctcgtcgtgcgacgcctcatagtaggaggacaatgcatagatgcaaaacgcctggttgtaggtgtgctttgtcgtatcaagcggtgtcccgtcatagtttaatgaccagtagatgccgccgtactcccggtcgatgcagtgctctttcaaaaagacgtagccgtgttttgcttcctccaagagcgcctctccggtatagcctgcgcttctacagtcttcctccgtaaaaagtccctttcgatatgccgtgtaggcattggagaaaaaccatgtgatgcggctgtttaaaatgcatcctttttccgctttctgatccagtgcaagatcataagacagccagccgtaatagccgccgtaagtgtcgtcacgcagtgcacgccagaagggaatgatatgtgtgagaagttccgttttaacttctcctcgcatgctttctaatgtttccatcgctgttcctcttttcctgtaatcagcccttgactgcgcctgccgtaatgccgctgtagatctgcttctggaatacgataaacacgatgagtgccggcagcagggaaatgataacacctgcacagatcaggttgtactggcttccaagcggtccggtaaaggtatagagggagatcgccatcgtctttaagttttccttggtcagatacaggtttgccgaatagtattcgttgtacacgcccacgccctttaagatgcaggcggtcacaattgccggctttagcagcggaagcatgatcttccagtagatcttccagtaggacgctccgtcgatgattgccgactcatccagcgacaccggaatattttccatgtactggataaagatgtagatggagatgacatccgttcccatcatcatgatgatgtagccgtacagatgattgataaagccaagatcatgcatgatctggtagaccgttacctgcatggcaacacccggaagcagtgccgcgaataaaaacaggttgcggatcagcccgttgcccgggaactggaaacggtttaacacatacgcaagctgtgtaccgatgatgatggctccgatcaggacacagaccataacgatcacggaattcacgaatgcccttcccatgttcgcacgctggaacgcttccacaaagttgtcaaaattgaaccagttctgcggcagtgtcataacattcgtcgtcttatactcttcctccgtcttgaatgcagtgatgacgcaggaaataatgggaatcacggcgacaaaggaaaaaaacacaagcgatacatatttaaaaatgatccagataatggctcctgccgaatactgttttctgcgctttttcatttacatcgccccctttgctgcttttttcgccgctctctgttctttgtgaaactgtttcaaccgctttctctcttccctggtcatgacttcatcgtcctgatccgcattgcggtatacatatttaaagaacagtttctgtaagatcgtacatgcgaaaatgataagaagtaacacaaccgccatcgccgacgcgagtccgaccttctggctggtatgtgcaatattgttcatgttgataaaatacgttgccgttccgttggaacctccggtaattacgaacggctgctcgaatgcgctcagtgctcctgtgatggataaaatcacattcagcgtcacaatcgtcttgatgctcggcagtatgatatgtacaaactgctgaaatttatttgcaccgtccagctccgccgcctcgtacatctcggaatctacagacatgatcgctccgataaaaagcaccatgttgttgccgaaatatctccagacagaagttgcaaccagtgaccagttgttgatcttctgatcgcgcagccagtacggaagactatccagttcaaatccaaaccatccgaggatggaatcgaatacaaatcctcttgtgtaaaaatatttaaagataaatccgatcgcaataccgctgatcagatacgggaaaaacatcagtcccttaaagagattgcctccccttgtcttaaagctcaaaatcgttgcaaggaacagcgcaagcgcaagctgtaccaccgaacctaccatgtagtagaggcttaaccacagggatgcaaaaatatccttgttgcggaatacctcgatataattcttccaacccacaaatacccgtttatctaccggcgtggaatatttcattttgtaaaaactgaacttcaccatttcagcaaatggcacataggtaaatgctgccaacagcacaagcggaattatggtaaatgccagtataatcagtgtctgctgccccttcctgctttttgcccacttcaggaatccacgcctggctgttttattttctactttctttactgatgtcgccgccatatccaacctccatctttttcaccctgtttttaaaataacgggaccggaaacagatctctcattccggtcccgtctgtgcatgatgtcttatttattctgccgtcacgccattgtcttcctgtgcctgtgtccacttctcattccactcagccatgatgtcatcgtaggacatatcaccgttagaagcatgctcaatgatctcctgaaccttctcttttccgcctgcattgatgttcaatccggaatcagcgttcaatgcattgagtaaatcttcctcgccctctaatgcggactcgtcggatacaaatgtcacatcaccgaactctgcgtatgcatccggataatcgttatcgtctgcagcgatcgggataccgccctcgttgtatgcaaaaccggactcttctgtcatccattttacgaataccattgctgctgcctgatgatctgcatccgatgccgcattgataccgaagctgtagtcagcgcctgcggaagcatactgcttgccgtcgatcgtgatcgggaatggcatgtagccgatgtcctcgccgtgagaatcagcgtctaccatctgggaatatgcccaggagccaagtaccatggtcgcgatctcgcctctgttgatcatgcccttggaatcttcccaggaagttgtggtgaagtcatcctctgtcagtccgtctgccactgcatcgtagagcaccttgtacagtgcatatggatgtgtgccatcgccgtaatcctggaacggatcctttgtgtgaagaagcttctggttcatgtaagtagaatcaccggttgtcgtacctgcgatctgtccgtcccactgctccatcggccatccgtctgcgtagttcgtgtagagcggaatgatggaagaatcgtaatccttgatcgcctgcagtgccgcgatgaactcatccggtgtcttcggtgtctctgcgacgccggcctctgtgaagactctcttattgtatacaacaccctgtgcattaccggtagaaggaacaccgtataccagtccgtcgtaatcccaggtatttgcgaacttaatctgtccttccatctcatcgagtgtgccgtacggcaggaaatactcacttaagtctgccttgtcaactgccgggatcatcatgatgtcgccccagtcaccgctctgtaagcgaagcagggaatcatcggaataattggtatccgtctcaacctctacggtgatgttcgggtacatctcattgaaatcagcaatgtaagcttcccagttctttcccggatagctgtcctcggacatatcggttctctggttgaatacatggatggttgtcgtgatgtcggtgtaatcctcgcccaatttgatgcttgcataattcagagcaccatctgtggtctctgctgcatccccactctcagttgtggttgctgccacacttcctgttgtcgcatcatcagatgctgcgctgctgtcagatgaactgccgccgcatgctgccatgctcaaagtcattgctgctgccaggctgactgccagaacttttttcaacttcataataaaaatcctccttttttatagctcattttgtagcttaatttaattatatattttttctatttttagtcatcatatattattgcataatatattattttcttgcgtttttctgcattttccacatgttatacaaattttatatccactttttagtcatttttcatatttttagtctcttattttcctttctttttcctcttattttaattttaattacttaatttttattgttttttagcctgaaattcaagaggcctattgtattgtaaaatagttccgctataatataggatagttatgcagaaaggaccgattcttatggaacccatcacgatcaaggcacgcctgaatcaggcttatcatttctccggggcagccggaaacggcatccgtttttccgatctttcagacgacccggctttcgttttccgcgaggacacatcggctgtacacaaccgttttgtccctgcaggagggcgcatcagctacgcgtcccccgtccgtctgacacgggatgcgctgccatacctcctctttctctatgtcgaatccggaagcggcactttaacgactgccggcgacgctgcgcaggagccggaatcctgccagcttgcaccgggggatctcatgcttcttccggatcagaccgcataccggttttccacgacgcatacccctttctgctaccactgtttttatctgtccacagagtatttttcggaatatcttccgtttttgtgtgcggacgaccgcatttttcatgcgaaccggaccgaggcggatgacatcgtatggcgtattctgccctgcctctcccgcgagctgctctcagatgaaccggtttcctcgcttcatctgaccgccatgctctcgcttatcctgtcctccctcgctgcttcccgccgtgccgcatcgacgccttcccttcccgcgcatgtggcacacatgaaagagattttcgacaccgattacgcacattcccactctctcgccgcgctcgagagtgctctcggagtcagccgctaccggctctgccatgatttttcagactgcatcggtattccgccgatccagtatctgaaccgggtccggctgaaagccgcacgcacgctgctgcgcacgacaaccctcaccatccgtgaagtcagcgccgccgtagggattgaaaacacgacacattttatcaatctgttcaaaaaagatgccggaatcacacctctgcaattccggcagtcttccctgcactaacccatattttttctggcttttacgctgtcctttgtgaccatatgtccctcgacgatacagattccctggcggtacggttcgcccgccattttcttgatcagcgtgtgaaccgtccgtctcgccatctccttcatatccacctcgtaagtggtgattgccacatcacaaagtcccgggaaaagataattgtcatatcccacaaccgatatatcctccggcacacggtatccgtgctcatgcagcctgcggatcagaaaactcgccgtcagatcacagttgcacacaaaagccgtcggcatctcctttggcagctgcaacagccggtccatatcaatcttgcccgtatggatgtcgcggtctgcgatcgtccagtcccccctcaccgcaacgccgtgctccatcagggatttcgtataccccagatagcggtccgtgatggatcccgtcgcaagcagggttcccacataggcaatctccctgtgtcccatgtcgaacagataattcgtcatgcggtaggcgccgtaatagctgtccgaaatcaccgcatccgtatctgccttctcgtcacagaaatccatatacagaagcggaatttttgctttttcattcaaaagcttcagatattctcccgtcaggcgtccgatgataatcagaccgtccgccttctgctcctgcacaagcttcggcatctcgcagtcagtctccatctgtgcgctgaccacttccatcagcgtaaaacattccttcgccaccgcgcgcgtcgccacctgctgatacatctgcagatagaaggaatcatacttatccagccagtgctcggcaatcagcacaccgatattatagctttttaccgcgtgttcgcgccgcctggcagacggctgtttgtatcccatctcatcggcaagtgtttttatcttctcccgcagttcttcgctgacgcctttctgtccggacagcgccttcgatacggtaactgtactcacgccaagctgtcccgcaatatctgccagctttaccgcttttgccatttttccaacctccaactactgttcatcagacacctcggataagtgtatcagtaccgactggaaatctccccacatcgccggaacattcaggcccgcatgcacaagggtatctccgcagtacacttcccccgttgtctcaacacgatattttttcttctcatcaagtcccggtatccggatccgcctgctgtgtacattcggtctgccaagcacctgaacaaaggtgattaacgcttccgactgatcctttgccaccacctcatagcagtcaaacgaatcattctgcgaataggaagcgatccggtaatagtcgccgcttcgtatcagcgcatgatatttgtggtacagtgccacctgccccggaattcttgcacggtcttcctccggaatctttgtcacatccagctcgtagccgaacgtacccgccagcgccacatttcctctggtctcaaacggagttgcgcgtcccactgtgtggttcggacagtcggacacatgcgcgccgatcgcggagagcggatacagcagcgccgtcccctcctgaatctttaaccgctcgatggcatccatgtcgtcggaacaccagatctgtggactgtaatacagcattcccgggtcaaatctcgccccgccgccggagcagttctcgagaagcagctccgggaatccggtgatcagacgctcctgcaattcatagacgcccagcacatatcggtgcagcaattctccctgattttcgaccggaagcgcgctgcttcccagatcggtcagctgccggttcatatcccacttgacataagcgatgttcgcgctgcgcaaaatggatgccacacactcatatgcataatcccgcacttcttttctggagagatcgagcacatactgatttctcgaccggcacggcgttctgcccggaagggcaattgcccagtccggatgcgtccggtacagatccgaatccggcgagatcatctccggctcaaaccagatgccgaattctaatccgatctcattcacctggtcgaccagccgttttaatccacccgtgatcttctgctcgtttacctgccagtcaccgagacttgtgttgtcatcattgcggtgtccgaaccatccgtcatccatgactaacatctcgattccggatttcttcgcctctctcgcaatcgcaagcagcttctccgtgtcaaagtcaaaataggttgcttcccagttgttgatgagcaccgggcgctccctgtccttatacgggctgcggatcagatgcttccggtagagatcatgcagcgttctcgtcatcccgccaagcccggcatccgaataggtcagcacaacctccggtgccgtaaatgtctcaccctgctttaattcccacttaaaatcctgcggatgaattcccatcaccacgcgcagggaatcaaactggttcttctccacctgcgccaggaaattgccggaatacacaaaatggaatccgtacacgcgcccctgctcctgtccggcgtttgcggacaccagcgccacgaacgggtgctcctgatgggaagattcaccgcggcaggagccaacagactgttttccgtagccgatctggcggtattcgatctgtcgctctctcgcccaggaaccatgcaacgtcagcatccggtaatcctccgcgtcaagatccaacgccgtagaaaataccttcgtaagatacaccggttctttggcatggttcgtcacgcgcacgctccgcgtaatgacatccacgtcataaaatgccgtgtagtacaatgtgaccgtaagatccagcacttcatccgccagcacaatctcaagcgtctcacactcttcttcgctgccgaacgtggccggaagtcccggaagtcccggtttgcccgcatagatcttatgctccctgtaaagcggctgcaccgccgtattgccgtttttgtccgctacggaaatcgcactctccctgtaatcgccgacgccgtgccccggatactccatcggaaacgcatccagaaaagagctccggtcgcggttgttctgtgaaggaacaaacggtgcctccccggtgcgcatcagcgcacggacgtcatagtccgtgatctttgcgccgtaatagatatgtcccaaaaacttttcttcatccacgataccgatcagataactggtatgtggtgtatccagtttaaaaacccgttctttttcgtaataatgaattgctcccataccatctcccgcttcttatttcaacagatcttccttcaatgccgcaagctttgcatccgcatccgcaagggaggttccctttacgccaaagtagtatttgatcttcggctccgttccggacgggcgcacacagcaccacgcattgtcggaaagttcataataaagtacgttggatgccggcagtccggtctttgtcacctcgccagtcacaagatcctttctggtgtcctccttgtagtcgcgcaccgccagtacccgatgaccgcccagctccttcggcgggttcgtgcggtactcactcatcatcgactgaatctgtgccgcaccgtcgattccctttaaggtcttcgtctccaatccctctctgtaatagccgtacttctcatacatatccagcattgcatcccacagggtcttgccgtgcttcttgcaccaggaagccacctcgcaaagcatcatgaccgccacgcacgcatccttgtctctcgcgtaggttcctgccaggcagccgtagctctcttccagtccgaatacgtagtgatacgtatgctgctgctcgaagaacttgatctgctctccgatatacttaaatccggtcagcacctcgatcagcttcacgttgtaggctgccgcgatcgcttttgccatatcggtcgtcacgatcgtctccacgagcgccgggttctccggcatggttcccatcgctgtcttctctcttaagatgtactctgcgatcagcataccggacatatttccggtaaatgtcacatatccgccggtctttgtgtccttgcagtacacgccaagacggtctgcatccgggtctgtcgcgagcacgatgtccgcatcgacttcttttgccagctttaacgcaagctcaaatgccttcggggactccgggttcgggtaggataccgtcgggaaattaccgtccggcagctcctgctcttttaccacgtacacctgctcgaatccaagctcctttaacacgcggcgcaccggaaggttgccggttccgtggagcggtgtgtatacaatcttaatgtccttcgccatctccttgatgacttccggatggatcgactgcttcttcagctcctccatgtaacggtcgtcgatctcttttccgatgaccttgtaaagtcctgcggcaacggcatcttcttttttcatcgtcttcacctggtcaaaggatgtcaccttcgccacttccgccaggatattcttgtcgtgcggcggtgtgatctgcgcaccatcctcccagtataccttgtagccgttgtattctctcgggttatggctcgccgtaatcacaattccggaaatacagccgagttcacgcacggcaaaggaaagctccggcgtcggacgcaggctgtcgaacacatacgccttgatgccgtttgcgttcaggcagagcgccgcctcatccgcaaattcggtggacatgattctggaatcgtgggcgatcgcaacacccttctcctgtccgttctgggagagaatgtagttcgccagtccctgtgtcgcctgacgcacggtataaatgttcatgcggttcgttcccgctccgatcacgccgcgcagtccgccggttccaaactctaactgacggtaaaaacgatcctcaatctccgccgcatcgtcccctattgcagcaagttctgcctttgtattctcatcaaaatacgggtttgtgcaccactctttgtaagtctccatgtaactcatatctcttcttctccttttactgatattcttctgccgcacagaaggaagctttcttgcttcaaattataaacttttttaaactgattgtaaactaattttagttaatcttctgtcacggttccatccgatgccacagctgcctccgaaatgccatccagataattcaaaaccgactccgcctgtccgccttcggcaggatatgtcacgccccccgccgcatacaccggcacgaaccggtaggatgcccgccccgcggcgtcgatcgtcacctcaagcatcgccgaccggtcgatactctgcccgaagataaaattgccgagactgtagaataccggcttcccgtcgatataggagaccccctgcagacagtgggtgtgcgatcccacaaccacatccgccccggcatcgatgcacgccttcgcaatctgtgtctggttcgcctccggatatgcctggtactccacgccccagtgcggatagaccgccacatagtcgcaggtctccctcgcttccttaattacctccacaagagccgtggtgtcatagcagctaaacagtcccggcactgcattttccaccttccagtccgccgtcgggacaacccgggataccgcgataaatccgtattttttcccgtggacttcaatcacctgcacctgctttgcacgctccgtggaatcgcccgcgccgccatatagaatcccggcgccgtctaacgctgcaaacgtatccgagagtgcatcccttccataatcaagcgtgtggttgttggcgagcgataccacatccacgcccatctcatttaatgcctttacatagcccggactgcaccggaatgtaaactgtttgtctgccatcggcgtaccgcggtccgagaatgggaattcattattcaccatcagaatatccgctgcccgaagctcctccagcagttccggcgcaaccacgccctcgattccgtccgcatcataacccgccttaaacgcatttgcaaacaggacatccccggtaaaaagaatcgtcgtactgccatccgcttccgcctgaccgcccgcttccgcttcttcggtcacttccgcggcttccgttctctcctccgcctccgtggtctccaccgcggtctcattctcctccctggcaggcgcacgatccgctccgccatccgctcccgcatgctccgtgtcctcacccgataccacagctgccggctcttcgcccggcacctttacttccggcgtgctccctttcgtccgcgccacggcagcaatacagcctgctaccatgacaatcgacagcacatacaataggattctgcactttttattcataaaattcctcccttattcttctctctcatcgtctctagtgtatcagtgctttgtgtttcaggcaagaaaaaagaccattccggcaaactggcatggtcaatttaatcgcaactggacatttttatcaatccatcttgtgttatactcttatgcatcaacgttgaaatacaaacttttatatgaatctgacagaatggagacttcctaatgacaaatcaaaatattaaaaaactggtaactgctgcccttctcgccgccatgacatgcgtggcaaccatgatcatcaagatcccgacaccaaccttcggctacatccatccgggagatggcttcgttctgctgtgtggcgtcgtgcttggcccacttcccggagcgctcgctgccggcatcggctcgatgttctcagacattttctccggctacgtgacctgggctcctgcaactttcattatcaaggcgctcacgggcggcattgccggactgctcttccatcgttttaaaaacaccctgcactcgaaaaagggacgctacgcagcgctcgcaatcggcggcatcgtcggagaagccatcatggtcatcggctattttctctacgaaaccggacttgccgcactcggcagcggagccttaaaccaggcatctatcgccgccggcattgcttcctctgcgaccggtatcccgtttaacatcgtacagggtgttgtcggcattattcttagtctgatactgcttccggtgctctctaagatcccggatgtccgtgactggatcgagcgctaggcgaccacctttcctccgaagatgaccttcttcgtggacaggtcatccttggagagaaggacacagtcgccgcggtggcctgcggtaatgcttccgcacacatccgccgcaccgatcgctctcgccggattataggttgcagcgcgcacggctgtctctaacgggattcccatggagacagcctttcgcatgcagtccatgagattcgtcgccgagccggcaatcgttccgtcctctaaggttgcaagattgccacgcacagtaaccggaagtccgccgagggaatacgcaccgtcctccataccggtcgccatcatgctgtcgctgattaagatcatacgctccgccccgaacagggaaaataccacgcggaccgccgaagcatcaatatgaatcccgtcgcagatcagctccggcatgacatgcttcgcgtcaaacgccgcgccaaacacgcccggcgcgcgatgggtgaacggcggcattgcattgaaaaaatgcgtcacatgatccgccccctgtgaaaatgcgcggtatgcagtctcgtaatcactgcaggtatgtccgaccgagatatgtacctgatccgccagccggcggatgaactccttggcaccgtccgtctccggtgcaatcgtaatcagacgcaccagcccgtgtgctgcctcctgcagccgcaggaacatctctacatccggattccggatataagccggattctgcgcaccctttttctccatggaaataaacggtccttccagatgaatcccgatcagtctcgccccggtgtcctgctctgcctccggtctctttgtatacgcatacgcattggcacacaccgtcttaagcgtctcctccgagagtgtcatcgatgccgggcagatacttgtcacgccctggcgaagctcgtacgcgccgatcgcctgcaatgcctccggtgttccgtccgagaaatcatgacctgcacatccgtgaaaatgaatgtccacaagccccggtatcaggtaatctccccctgcgtccaggatctcttccccgtccgtgccggccgcttcactccccgcaaaacagccgttttttatccggacatcccgctccacaaatccgtgctctaccgtgtatacaagtgcattcttaattctcatcttaaatcccccattttcctctgactttacctctataatggtgacagggaaagcgctgcctcatcgcagacaaccgtcacatccggatgcatctgcaggatggatgccggcacttccggcgtcaccggtccgaagaacgcgcgtgagacgatatctgctttgccctctcccgagacaaccaccagaatcttttttgcctgcatgatcgttcttattcccatagtatatgcctgcttgggcacttcgtcaatagaggtaaaaaaacgtgcattggcccgaatggtactctctgccagatccacccgatgtgtctccttctcgaacgctgcacccggctcattaaatccgatatgtccgttattccccagccccaaaagctgtaaatcgattccgccgagcgactttatgatctgctcatgcttcgcgcaggcatccgccgcgtccgggtttgtgccgtccgggacatgtgttgccgccttatcgatattcacatggtcaaacaggttctcctgcataaaatagtagtaactctgcgggtcgatgtgtgtcaggccgcggtattcgtccagattgaccgttgacactctggaaaaatcaagatcccccttctcataccactcgatcagctgacggtatgttcccaccggcgtcgatcccgtggcaagaccgagtacacagtccggtttcataataatctgtgccgaaatgatattcgccgcctttctgctcatatcctgatagtcttttgctctgataatgttcatcgtaatccccttttcctttctctcatgaggcaggagacgccttcccgtctccctcccgttatttactgcagatttttctgcctctgtcttgactttatcagccaatcgacgccctttcaagggtttgcgggcaactgcacaaacagggataaaaaaaggcaagcgcaaatcacttttcatttcccatggaagatgatatgatacatacatacatcaacaccgatcaggagatttttacatggtttatgcgatcattgccggcggggtattcctgtcggatctcatcttaaagcgttacatggacaaaaaatatgcccgcaaggtacgccatccgcggctcgggggcaggattgtcctggaaaaatattataacgaaggcgcggctttgaatttcatggtgaaaaaaccaaagcttctgcgcatcatccacaccgtcattcttgtcgttgtcgggattttttcctattttctgatgcgtcttaacggacacgcgctggagaaaacgggcgttgcgctcctgctcggcggcggtctaaacaacctatacgaccgctacacaaaggggcatgtcgtcgactattttcatctgaatttcggtccgaaatggctgcgcgcgatcgtcttcaacatctctgacttctgcattttcatcggggcactgctcgccgttgccggatcggaggtctcatgaccagagaatcctatgaaaaaatcaccggcatcttacgtggacatccgcggcgcatccggctggtatgcctgctcaaccacaccttgaccggctttattttcgtgctgtacccggcatttctgctgctgctttttcttgagggcagcacttttttcctgcgggcgcttctcgtccccgccgtctcctttgccgcagtcacgctcttccgccggatctttaacgccccaagaccttatgagaagttcggccttccgcctgccatagaaaaagatacggccgggaaatcttttcccagccgtcatgtcttttccgtatttatcattgccgccaccattttctatgtccacccttccgccggcattctgctcggactcttaggggttgtccttgccgtcctgcgcgtgatcggcggcgttcatgagccgcgcgacgtcatcgcaggcgctcttgcagggattctgtgcggcgtgctcggatactatgtactctagccgtccggcaccttactttcccagtacctgattccggtattcattggcagagactccctcctgcttcttaaatacccttgagaaatgtgccagatctaaaaatcccacctgctcggagatatctccgatgcgcagcgacggatcttttaacagttctttcgcatgctcgatacgaacgtgatttaaaatatccgaaaagctctgccccgtgtggcggtttaaaagcttgcttaagtgccactggctcacatacgttttctctgccacctcgcagagcgtcagcttcttcgtataattctcctcaatgtaagtcagtgcattcttcacgataaagctgctcgatgcgctctccttgtgcgcttccgccgcttccccatcctgcggatcacgcttcggctcatccccggtaattcctttccgttttaagttcccgcacatcttgccgatggcttcttccagttcgtccatgttggagctttgtctgtggtgttcttaagacgcacatcccacagttccaccgcatcgtccatcggaaccatgagtgtctggctcgccttgattcccttgtaatcgcactcataggttgtgtagctcatgccgtgtctgcaggtgtattttgcctgatccagcggtttgcccaccggctgccaggaaatgctccagtagtctccgtcctcggcatccctcagatacacataatgtcccggccggtccatcggcaccgcatttccgcgaaaacgcgtcacccggtgatactccggagactgatagaacatgtaaccgcccgccgtatgattgaccacgacgcacaaatccttcacgccgagataatttgtccacgataccggcaggtcgacgcggtcaatgacatattcccttttctcattgtcaaaatgtccgtactgcataaaaaatccccctgtcttaccttcctattttcattccttctgaaaatattatagtaagacagagggcgaaattgtattgccacgcatggcataatttgcatatttctgtcattctaaaacatagtctaaccgagtgccttttccagctcctcaatcacgatccggagcgccttgatcctggcgtacttcttatccacagactcaaggatatgccacggcgcataggtcgtgctcgtctttgtgatcatctcattgactgccgtctcatactgatcccatttttcccggttcctccagtcctcctccgtgatcttccactgcttttccggcgtgttctgccgctcgttaaagcgctccagctgcgtatccttgtcgatctgcacccagaacttgatgatgacggctccccagtcatgcagctccttctcaaattcattgatctcgttgtacgcgcgcatccagtcgttttccgtgcagaatccctccagccgctcgaccatcacacgtccgtaccacgaacggtcaaaaattgcgatgtgaccggtctttggcagtctcgtccagaatcgccacagataatgccttgccttctcatgcggctccgggcttgcaatcggatgcacttcataccccctcggatcgagcgcactggtgatccgcttgatgttgcctccctttccggcagcatcccatccctcataggcgatgatgaccggaaccttcttgcggtacaggcggttgtgcagctcgccaagccgctgttttaaatgctttaactccttgcggtacgtctcctcatcgagcgtcttatcgagcggtatctccgagagaagcggcatgcgctctaacgggaatacattctgcagaagcggaaccgccatatcacggttgtcaagcgcaatgtcaattccctgcgtcagcgtctcaagcacctgcaattccgtccacttcttcgactttgcatccacaatataccacggtgcggacggcatattcgtgctcttcaaataggaagaaaacgcatccatgcacttctcgtagtgactgttctgccacagatccttttttcccacacgccagacggtgtccttttcatccgtgaggcgctccatccgtctggtctgctctttcttggagatatgcaggaaaaacttcatcacgaggtagccgttatccgtcagctgacgttcaaaacgccgcacgctctcgatgcgctttgcatatttttcctcggaaagctccccgtgaaggcgctcttccaccacctcatccatccagccggaatctaagaacacaaactttcccgcctccggaatccgggtaaaatggcggtataaaaacggcttgcgctcttcctccccggtctttctctccatggactccaccttaaaatggcgcgggtcaatattctcgatgatctgaccgatgcagtagccttttcccgccgttccccagccttccagcagcaccagtaccggcactttctgctccttgatgagaagctgctgggcggcaagcttttccctggctgccgcaaggcgcatctttaattcctcttccccgggtcttaccggctctttccactctctcagcataaaaacctccgttccgcagacgcaatacgtcgcattttccttctcctataacagcggtgcaaacaaccgcagaatacactgtatgatgcgaagccccatactccgctttcccttatactgttccgtcacctcgcgcgacacctcaaatatctgctcaaaatcctctccgatggcaccgagtgcaccgcagccatgcagcagcacgccgttttcaaaatgatggtacaggcttctatagtcaaaattgatcgttccgaccgtcgccgtctccccgtcgcagagtgtctgcttctggtggataaatcccggcgtgtactcatagatgcgcacaccgcgccgcaccagaggcgcatagtaggagcgcgtcgtctgatacaccagcttcttatccggaatccccggtgtcacaatccgcacatccacaccccgctcggcagccaggcacaattccctcgtcatgtcatcgctgataatcagatacggcgtcgccgcatagaagaaatgttttgcgctcttgatgaggttcaaatagacatcctccgcaaaatagccgtccgtcaggggaccgtccgcatacggctgcacaaaaccggcatctgccgcgcggtaatccagctgtggaaaatacgtctgaaactcatgatccgcctccgccgtggcattccacatctggagaaatgtcacagtcaggtttgccaccgcatctcccgcaagacggattccggtatccttccaggttccgtacgggtgcgtgatattaaaatattcatccgcaagattgtagccgcccgtgtagccgatctttccatccaccaccgtaatctttctgtgatcgcggttgttcatgaaaatgtttaagaccggaagcaccggattgaacaccctgcactctacgccgatggcttccatgcgcttgataaagcccggatcgataaagccgatactgccgacatcatcgtaaaacaggcgtacctccaccccgtgtgccgcgcgctcggcgagcacgtccttaatcctgccgaacgcctccgcttcctcgatcgcgtgatattccataaagataaaatgttctgccgacgcgagatcgtgtagctgcgccgcaagtccctccgccgcatccgggtaaaatgtcacatcggtattccggtacaccggataatgcccaaaccgcttgatatagcggcactggttcgccaccgcaaaatcctgctcctccagccgctcaagcactgcctcatcctggggaatctgctcaaacagcaccggttcaatcgtctcaaagcgtctgcgcatcgcctttgcgaccacattcttgtgtccaaacaccagatatatgcagagccccagcaccggaaacgccagaatcagaataatccagggcattttaaacgcagcgttctcgtgcttggcgtaaatgcttaacgccacaagaaatgctcctacactaaagcataaactgattgccgtagaatatgcattcaaccgcaaaaacagcaacaaaatccacaaaacctgcaaaagcagggataatcccacaaacacaagtcttcccacactgtttttcacattagacttctgttccgtccgcatcttctgtctcttcattccgcatcctctccttatcatatcaaaaaagctttcatctgcaaacccggatgaaagctcttttttattcttatattgattttcttttgtaacgccatcctaagcctctgcagacagctgtaatctcgccgtaatctcccgcacttctttcataatcgcggcatacatttcatactcaagtccaaccggcgacatatgcggacattcctgcttcatccgataggcctgtcttaacaggctgcgtttgttctcctcaagctcccagatctgctctctgctcataacttctccactttccgcacaccggcgtcccccgccttcttctgtgctattctcttcttggtgtatatatcttgtacacacacctctaccatcatagcatatatagtggaaaatgcatcaggaagttgttcggcatttttaccaaattttgtgaccggatttgaggactttgcctatttacaaaacagcttttatctatttctcacaactgcatcagcatttcaagagcctgctttttcatgatacaaattccctgctctctgatatgtgcaatgtgcccctgatcggagtaatgcgcatcgtcatactcgatcgttccgaacgcaaatggacgcatctcctccttggcaaatcccgtaaaatccagaatcagatagtacgcgccgtccatcttgtagagactgctctttggaatcttcccgcgaaaagcaagcaggctcatcctgcgcatattctcaaaggaagaaaagcgcagtgcacagatcatcgggtcggtgcgcttatgcgttcccgcagcggctgccgtatccgctgtatctgctgcggcctgtgcgttcccctcctctgccttggccgttttccctgatgcagcgtccggatccagctggctgatcatatgactgaccgtattcaccagatccctcagtgacacctctttgtctgcgccaaaagtgatcgccatactatgatcctgcaaaagctccgccttcaccatcggagagatgccctccatctgaatatgttcctgttcctcgacgagttctaagacagtatgcatgaattcctgcgtgatctcgctgttcgcaatgatctcatcaatatcgtatccgagactctcgatctcctgttccgtcagtgcacagcggattttgttatcaccgatatgttctatttccataaatgatcaatcccatctattgtaaaatgttgtttttaagtgataccattatcctattttttgcactatttgtaaagtggcaatccttagaatacctttttttgcataatgcggacactgcccgcaaaggataccgccaatgtggccaggaaaaccagaaacactaccgcagtcacggccgcaggatttaactgcgcagaccacctcagccctcccgcaaaattctccggcagaagcttccttgctgcaattgcagccccaagcaccgcaaaccccagaatcatggttgctgtcctgcttttttccataccgtatttcaggctgaccggaagcatgactgccagaaaaattgtcatctctaataaaataaggaacatgggcatcagccattctaaaagagacaccacatctccccggatataatctgccacaaaaccggccgctgcggaaactgcccagaaaccaccgccgcaaagcatcataaatacatatttttccagcacataatcttttctggtcaccggaagcgtgaacagaaacagatagccgtgatcaaattcgtcatacgagatcgtgtttactgtaaaaagcatgccgaacatggtacaatatcccacaatgatctgcgctggctgaccgctgcaaagaaaaatgagcgcaatcagaatgacaatcgtaaaataccgcttctgccctgccagaatccgaaaatccttcgtcaataatcctttcatagcttctcccccctcgctgtcaaaatcagaatatcatcaatgctgcctttttccatcacaagatccgggtaattttcctgataataccggcgctcgttcgtcagcaggcgataaccgtacgcttcacgcattccggcaagcagatatctacggtccagcgcctgatactgccgctcatccacttttaagataccatatgaatccagaagaacatccgtctccccgtgaagcacaatcctaccccggtcaatcatatagatatcatcgcagaacttttccagatcgctggagatgtgggaggatatcagcacagatctcggtgctccgccggttccctccgaatccagatattcctgcagttcttcaagcatcgcctctctggacatcacatcgagtcccagcgtcggttcgtccagaatcagcaggtcagcgtcatgtgacatcgcaatcagcaatttcagctttgcctgcatcccggtagaaaaatctttgatttttttgttcgccggaagttcataccgctgacatttttccaggaacctggcctcatcaaatctggtatacagattccgcagaatggcggtgacatcccggacggtaaggaactggctgaagcccgaatccgcaagggataccccgatccgctcccggtcttttgcagtcagttctgtatatggttttccgaagatccttatctcacccgtctccggcggcaccagccccagcagaatctgaaatgtcgtcgtttttcccgctccgttcgccccgacaaatccggttgccatcccaggctgcacttccatggagcagtccagttgaaacgacccgtatgcctttgttactttattcagttgcaccatcccatcattcatatgattctccatttctgtgattgcactcctatgcttccaaaaacaattccagaaccgcccgcagttcttcgtcgctcatgccatacgcccgcgccttcgccaccagctgttccatccgctgctcgatctctcttttctgttcttccgcaagcagtgacggattcaccccgagcacaaagctgcccttgccatgcaccgttgcgatcagctgctcctcctcaagggcatcatatgccttttttacggtgagagcgctcaccttaagatcttttgcaagcattctcacactgtcaagtggcgctccctcccgcagggttccctgcaggatctgtttttttatctgctctacgatctgctcatagatcggctgcatcgatgtgtgatccacaattatcttcatttttttgtattctcctccacctctgcgcagtatgtaggttttccttcgacaaacagtatataacagtatagaactgttgtcaactgttatatactgtttattacaaaacaatggttgcttttatataaaaaatcccggtcttaagacagaactgtcattctctgtccgcgaaccaggatttcctctctcatcgttcctttttatctctttatagtgttatcagtcaattctgatatttctcacatcaaaagcttattgtttcttaattgcatccatctcattcgtccaatgcaagaaatgcatcttttattgcagacacgtcctcgtcgaagcccatgacatataaaatcacatccccgatgctctccaccgcaacgctctccgcttccacgcagatccattttgcaggattggcattgtccaaaagcgtctgttttgccttcggcacatcggttccgtccggcacgcgcagcacaacacactgatatgccaccgacgtcatcatcggcgcagaatatgccgagtcggtatacgtgatctcatctgtccccagcacatactcttccatatccgcgtcgatcgtcgtcatctcataatcctgcatggcatcccgcatggattcatccagatcggccgtttcgtaaactttgtttaaaatgtcaatacagcttccgctcagtgcctccgcttcctcagaagcggtcgtcttcccgcaggcggcaaaagaaaacaacatcacaaacatcattcccaccgcagccacgcgcttcccgtatcctgccctgccgtccattttacggttctttccggttctttttcccatatcctctctgtgatctcctttttgattgaaattttctactttatatagagtaaaacaggcttttggagatagtctgtccaaaagcctgtgtctttattgctgtcgctttacgctatttttcttccggcatctgaatgcggatatgaacgtcgtccagctgcttctgatctacagtcgccggtgctcccatcatgatatccatcgcgttcttgttcatcgggaacgggatgatctcacgaatgctctcctcgccgcagatcagcataatcatacggtcaacacccggagcgattcctgcgtgtggcggtgctccgtagcagaatgcattgtacatggcagggaattttgccttcacatcctcctcgccgagaccaaccagttcaaatgccttgatcatgatctccgggtcatggttacgaaccgcaccggaggaaagctctacgccgttgcacaccagatcgtactggtaagcaaggatggaaagcggctcctcgttgcagagtgcgttcataccgccctgcggcatggaaaacgggttgtgacagaactccagttctccggactcctcgccgatctcatacatcgggaaatctacgatccagcagaattcgtagcaatcctttttcatgtgcttctcgctcgcagcgccaagcagtctgcggagtacgcctgcggtcttctgcgctgccagcttcttgcctgcggtcagaccgataaagtcacccggctttaatccgagggcagcaatgactgtctccttgcgctcctgcaagaacttggaaatacctcccacaaattcgccgttctcgtccagtttgaaccagtatgccttgttggctgtctgcacttccacctcggcacagattccatcgatcacttttctggtcgcagtaaatccgtccacgacaaccgcttttatggtctgtccctcgaacggaccgaatccgcagtctgccatgacgtccgtcgcatcctgcaataccagatcaatgcggagatccggcttgtcggtgccgtacttgtccatggactccagatatggaatacgcacaaacggagccttggaagcagtcttgtatacaccatacttttcaaataccggcggcagtacctcctcgacaacagagaacacatcctcctgggaagcaaatgccatctccatatcgagctgatagaactctcccggagaacggtctgctcttgcgtcctcatcacggaaacacggtgcaatctggaaatagcggtcgaatccggacgccattaaaatctgcttgaactgctgcggtgcctgcggcagtgcatagaacttgcccggatgatttctggccggtaccagataatctctcgcgccttccggggaagagcaggtcagaatcggagtcgtgatctctaaaaatcccagctcgttcatcttattgcggagctctgccacgatgcggcttctgagcacgatcttgctcttgaccgacggatttctcagatccagatagcgatattttaatctggtgttctcatccgcctctctggactggttaatctcaaacggaagtgcattgtagatacactttccaaggatctcgatcccttccggcacgacttcaatctctccggtcggaagctctgtattcttattggagcgctctctgacggttcctgttacggaaatggtggactccttgttcactccgtccagcttctccatcatctcttctgtctcaacgacaatctgggtcgttccatagaaatctcttaaaataagaaatcccaggttcttgctgaccttgcggagattctcgtaccatccgacgagcgttactttctctcccgcattggaaagacgcagctcattacagttatgtgttctcgactgtgtcattttcttaactcccttgtatcaatctaaaaatattcttcaaatctgtccgggcagcagcctgtccggcgctttttttatcttacaccatgaaacgcgatttttcaacggttttatccgttctaaataattctgacaaacactccgataagcacgaacacaaggatcgtcaatccaaatccacgcagcgttatctttgttctccgtaacggatctttcagtgcctcctccagacaaatcctctcaagttcatccagcacacgccataattccgtataatcacgactgttaaactcatattttatgtcttccacgcgtttgcctatgtagcggcatgcttcctccgaccactcctgtgccctcacatgttcaccaatttgtctccagaactctggttctttgtacagagtaatcgccaactccgattgcaggaactcttcccagcgtttcttctgggttccttccccctgcaatgtgagacctcgcagccgctccggcaactcctctgtcagcattttcctgcttctctcctgtccggcacgaatgcgtgcaaaatactcctgccattgtgcttctgtctcatcggtttcaagctgtccgtactccttctccagcgccctgtcccgctcttttaagccttcccgtgccaccggtttcaccggacttggaaccgtcctgcttccgttcagatcactttctttctcttgtcttttcgcgtattgaatggcgcgctggtaagcatcgtgaagcactgcccactcctctggcttttcctccctgtgacagttctttactctggcagcatacacttttttgatctgtttttgatctgtagtctgggaaattcccagtatctcccatattgtcatattcttctagctggtcagatgtccgcccctccacaattcatattcctgttcctctttgcggtaatccacctgatcctgcgcatcgaccgcctgcttactactctcataccaccgggaaaaaccgtctgctgttccctcaaatgccgcctcctgcagacactgctcctccacatagtccagaaacagattcagctgttttctgcccttgttgatggagaggacgtcctgtcttcccagataatagttaaaatactgtacacgactgtcaatctgttcccggatatatcccgttgtctcacgatgcagcttttcagcacgcgcaagcaccagccggttttcctcaagatctctcggatgaatcttcagtttattcaactgctccagtctttttttcagttccttttctgataatttgattttatcattccggatcacgagctgtttttcttgtcctgtcgatacgacgtgcacatctaccaccagaattccattgatatcgtaagtataacgcacccgcaccttctcttttccttccggtccgacaggaaccggaaccgtgatgcttcccaacagcagattgtcttccgcgtacattgcttccccctggtataccttgaacctcattttggtctgcctgtcatgtgccgtcgtcataatagtctccctgctgaccgggagcgccatgttcctctcaatcagcacatcacagagatcacggttcggatctgcttcgttgtattgggacacgctgagagaaaacggacagatatccgtaagaagcatatcgcgaatatccgcattgcgttccttgatacctgcatacactcctgcgccgagcgcaatcatataatccgggctgacaaccgcaatatccgtgcgctgcaacagataattcaaatacttttgcaccaccggcattttacaggaccctccaacaagcactaccgcatctacttctccggcactcttctgcccgtccgacaacacacgccggatcggttgtgccatccgttcaaacagcggctccgcctgcaggatcagctcctttctggagacctccatccgatattctctcccagcaagtgtcacacacatctgtgcagtctcctgaccggtcagttcaaacttacagttttccgcacgttccaacacaattgccgcatcctcagctgagaagcggttttcagaaagtccgcacgacttccagaacatatctgcaatcaaccggtcaaaatcactgccgccgagatgattgtctccgctgaccgccagaatctccacaatgttatcaaaacactctactaatgacacatcgagcgttccccctccaaaatcaaacaccagcatgacggcatcctccatctggcttcggcactgataatataacgatgcagccgaaggttcattgatgatgcgctccacatgaaatcctgccagttcccccgcattttttgttgcatttcttgcaaggtcgttaaaatatgccggtacactgatgaccgcttccgtaatctcctcccccagataatgctccgcgtcttcctttaatctttttaacacaagcgcggaaagttcctccggacggtatttttttccggcgagcgaatatatcttttccgttcccataaatcgtttaaaaacgcttaccgtatcctccgggtgtgtaaccagacgctcctttgcaatttttcccacgtacaccgtgccatctttgcctatactaactacgctaggcgtcagatagtctccaaacgcattcggaatcagatgactctctccattttcccacactgccgccgcactgtttgtcgttccaagatcaataccgataattcttcccatatgccctccatctgcaagctgtttctctttttttactttataccgttcgtaatctcctttaagaaacgtgcacatccacgcgaagcttttttatgtaatagaaacgaagtttcccattatgtaaaaaacgccatagatcatcctatggcgttctctgtcagatcatttccggatcagtctttgtaaaactcgacaatgtccttgtagccctcggctgtcagcttctctttctggaacttcttgttcttgttcatgcgcacgacaagcacctgcttcccagcaacacgctcctcctgtgccctggcgatcactttcgatacctgctccgaggtacagcctttttcaatgaggtatgccaccttcgggcgctgcatcggcacggtgaaaccgctctccatcagaagaagaatgatgcgctcaaagccgatggagaatccgcacgccggaacgtcatttccggtgaacttgccgaccatcttgtcgtaacgtccgccgccgccgcacgctgctcccagctccggcattgcgatctcaaaaatcgttcctgtataatagctcattccgcgcacaagcgtcggatcaaataccatcttaaagtcggctgtcttcgccgtctccacactatcgataatctcctggagattctgctccacctccggctccaaaaagccctgtaaggtgtccgccagatatttgataccgttctgcgcctttgatacgccctcaaacagtgccagatacttgtcaatcgactccttcgcatagccttcctttgcgagttcttctgccacgccgtcaagaccgatcttgtccatcttgtccagaatgatgaatacggtatcaaattcttcctccgggaaaccgctgtacgctgccatcgcctttaagatgcggcgctcattgatgcggatctcaaagttcttgaatccgagtctgccgatcgtcgttgtcgtcgcaaggatcagctcgatctccgcgagattgctcggctcaccaataatatcaatatcacactgcataaactggcggtaacgtccacgctgcgggcggtctgcacgccacacactgcccatctgcagtgccttgaacggggacgggagatcattagcgttgttcgcatagaaacggactaacggcaccgtcagatcgtaacgcattccaaaatcgaccagatccgcctcttcctttgcctccgcgatctttaacttctcaccacgcttcatcactttgaagatcagcttctcgttctcgcctccctgcttattgctcaaatttgcaatgttctccatgcaaggtgtctcgatcggtgtgaatccaaaactgcggtaggtctccttgataacctgctgcacgtaatcccggatctgcatctcttccggtaaaatatctttcatgccgttgaccggcttcttgcttaatgccatgagcgttcctccattttctgccttatatcctccgattattatacgttttgtgttcctgcacgtcaagcatcaaggaccatacaatcatttatcgcaaatatgatcccgtcgttaaaaaatcacttcaaaaactgtgcccccagacggattgtccctgattacaatattgccatcatgcactctcacaatttcataaaccagcgcaagtccaaggcctactccccccagttccctgcttctggatttatccacacgaaagaatggttcaaatacccgttttctgagttcctctggaattccgcttcctgtatcctctacggaaagaaaaacatgtttttctttccactccgccgtcacaacaacctgcccgcccggacgattgtattttatagcattctcaacaagattatataccagtctgtaaataaggatatcgcttcccaccatagttacatccttacattttccaataagccttatatttttctccattgcaagtggttccagatccgtcaggacctcttctacaagtgcatcaaccatgattttttcatcacgtaccacaatctgaagttcactcatatccagaagaatctttaccatcctgctgagtctttcgttctgctccgtcatcatggcaattgtcttttccgcacattcgtcattgcccgggtgctccatcgaattatataaatcaagctgtacctgcatcagcgacaacggtgtacgaaactcatgtgcggcatttgccgtaaattgcctctgtacctcaaatgcttctgagaggcgttccagcatcttgttgtaagaaacactgagccggtttaattccttaacttcattctcttctatcctcgaatctgccagattttgtgcctgcactttctcaattttatctgaaaaatttctaagcggtttaagtacatgtccgctcagaaaatatgtggcaacacctccaagaagcgcaagcagtgtagagaacagcaagcttctttttttataatctgctttgttgttatatacctgaatggaaaaatcatctgcaaaatcatcccatttatcatctggaatattaatatatatttcatcagcctcctcactgttgtcctcatcactctgggcatcaacagtattctgcagcaaatcaatataatacacaccgttcttatatacaaacagggtaaggcatccacatatgactgcaataaacaatgtagttatgatcgtaagtctccactgaagtgacatttttttcattgttctgattcctctcgcatcttataaccctcaccaaccttgttcacaatcggatcatatcccagcactgccttaagtttttttctgagagaagacatatgtaccctgatagctccgctaaaactatccacagatgcatcccatacatgctctatcagttcttcctggcttaccggtctgccctgattaagaagcagatattccaaaattccactttcttttctggtcaaaggcaccctctcttcttttgcatatgcctcgcgcttttttgtattgaaccttatgtccccattgttcaggcaaacatctctctgtacaaatttacgtcttgtcaggcttctgatccgcgcctcaagctcctgcagatgaaatggtttttccatgtaatcattggctcctgcatccagcccttccactttatccgctatctggcttcgcgcagacagaatcagcacctttgtctcctcattctcccgcctgagttcccttagaatatccattccatctatgcccggtaaattcaggtcaagcacaatgagatcatatttctccgtcaggacatattcaagcgcctcgcttccattataagaggtatccacctcatagccaacatcatacagactttttgcaattgtatcacacaattctttttcatcttcaacaatcaataatctcaaaatatttctcccgcttcttaacaaggattttacatccactattgtataatactactgtcagctggtcaacaaagacaataacagcaaacgaaaggagtaatctgtctgatgcggaaaagaatatcacagttcgctctattcatcaccggtacacttatgatcggttatggtgcaatcagaggcgaagcagctaccgtgcttggcaaagcaattaaattatgtctggagtgtgtgggaattggataaaagaacaactatacgatcaaaaaaagtagcccgggtacgcgggtggattcaggcagctgccacattgcttaccaatattcatattccaaatttatttaaaggaaaaatatatcagggaaatgccaaaacagtatgtgtgccgggattaaactgttattcctgccctgcagctgcaggcgcctgcccaattggagcttttcaggcagtcgtcggatcctcaaattttaaattttcgtactacataaccggctttttcattctgctcggtgtgacacttggaagatttatatgtggatttttatgtccttttggatggtttcaggatctgcttcataaaatccccgggaaaaaattttctacggccaggctaaagcctttgagatacctgaagtacatcattcttatcgttttcgttatagcactgccgatgcttgtgacgaactccataggaatgggggatccgtttttctgtaaatacatatgtccacagggcgttttggagggtgccatacctctgtccctcgggaattccgccatacgatctgcacttggcaggctattttcttttaaatgccttattttaattactgttattgtcttaagtattttgttttacagacctttttgcaaatggctttgtccccttggtgcaatttattcactttttaataaaatatcctttctcaacatcaaggtcgaaaacagtaaatgtgtcggatgcggtctgtgtacaggtgcatgcaaaatggatgtcgatgtccgtaagactccaaatcatccggaatgtatacgatgcggtgcctgtatgaaagcctgtccaaaggatgcaatccattaccagtttatggaaaaaacatgtagcagcaatctcaataaccagcaatagccagccggcagctatttaattcttatcatttaaaggagtatttatcatgaaaacaaaaagaaacattatcgcactttttacactctgtaccgcattatcaatcaccggatgtgccgggcaggagacttcaaaaacagagaacacgcagaatactgctgctgtatccgccagcgaatcatctaccgatgactccaatgcagcgcttgatgatttatatcagcaggaaaaccagatctttgcagatcataaagatgtatgggacaaggtttttggcatgatgaataaaagtactgctgatccagatggaaattatgctgattatcttgctgatactgtcgaagcaaacaagacttcgtttacagacagcgagttaaaaactcttaccgatgatattaagaccattcgtaaaatcgaagaacagatcactgaaattgaaagccaaaatgctgtatccgatacttccggcgccaaaaatgattccgatgatacagcccctttccagaatttctccggaaaagattttgatggcaatgccgttgatcagaatttgttttccgggaatgccgtaactgtcataaatttctggtttaccggctgtaagccttgtgttgctgaattatctaaacttaacgaattaaatgacgctattaaatcaatggggggcgaagttattggtattaacaccgaaacttttgatgaaaatgaagctgctataaaagaagcaaaaaaaatccttgaaagccagggcgccgcttatcgcaatctttccattgactctgattcagccgccggtaaatatgctgctgatattatggcatttccaacaacaattttagtcgatagaaatggtaatataataggcgaacctatgctcggcggaatcgataaccaggacaactatgatgctttgatgaagcagatccagtctgtgattgatgctgatagtgcaaacaagtaaattctgacattctgtagcatcaatgaccattcacaaatgcgaaaaaggacatttctaagtaattagaaatgtcctttggcatactcccgagaatactatcccagcagatagcactctcccctctgaatcaatgctgttcttcatccagccattcttttagctttttctgtaacagttttttatctggcaaatataatttatactcttttgcataaatttctccttcaacttccgagtatcatgaatgttctttcacatactgcaaaaattccggtgtctttgaccagtattttacaccccagttttcaaaattccattcttccatgtaatcattgcactcgaaatcaacataatatatttcttcgttatttacaacaaaattcgttggaaaataatcaatatttgtattggcagcatataacagcgcacacattctatgcaattgctcgatatagtcagttttcatcttgtcttctaaaaccaactgataaatcgtgtcgccgtcaataaactccttcaaaatgcgttcatttttcacatctgcttcaagcatggcaggcatctttattccgatctctttcaatttcttgtaatccctgatttctgcctcaagcttgtttccgaactgataataatcacaaggttcatgatgtatctgcttcaaaacatacctgttatttccagactctgccaaataagaatatccaccttttccctttcctagcaatttaattattgtatagcttttcccatttacggtcatttctttattcatgtgttttctcctttgttctacatcacattgattactgatttgtaatattctgcttcaatattacaatagaaatatagttttcacaaaggttaaacgtgtaacccgccacaaaattctcattcgatttttgtgatatttccccatatttcaaattttctggaatgtcatgaaactcttcctgaaaaatttcaataatgaaattctctctgaaatcacgaaaactcaggtgttacttctttccaaagaaggtattgtagacacttcttttattggctcattttgctcctaacgctgtgttattcatgttctttttctcctagaataattgactataacagaaaaggacgaactcatctgctaaaatgaattcgtcctttaaggcacagttattaggttgtttcaatacatctcacaggttattccgtattattggatacttttttgatgtactatttcaggatgaatagcccttttattcttctgcaaaaagcttctgcttccgctgtatcatctcatcaatccttgcgatatactgcgctacatccttgacattctcggcacgttcaatccggtgcgtgccatccggattcggctctgtccagacacgttttgtcgaagctcccgctccgcatgccacaatggtctgtttctcctccataatcagcacattgtacacgcccgccatgccctcttttgcatagccaacgttctccagattgcccgccatacctttctgccggtacagataatatggaaaaagccccatctgctccgcacagtccgcaaccagatccatgtgctcctgcgtgttgatgatcttgtaatccttataatcttccttgaacatattcagccgcgctgcccgcttgagtgccagcgaatgtacggtcagattgtccggtgcaagctctgccacctgctccatcgtccggcgcacatcgtccagtgtctcttctggaagtcccatgatcagatccatgttgatattgtcaaacccgagttctcttgccatttgaaaactctccaccgtctgctccaccgtgtgatgtctgccgatcagctttaatgtctcctgcttcatggtctgcggattgatcgagatgcgcgaaattccatgctgtctcaacaccttcagcttttcgtatgtaatgctgtccggtcttcccgcttccaccgtgaattccaggcagtctgataaatcaaaactgcatttaattttccgaatcagtctgtccagctgataaggttctaacgtcgtcggtgtaccgccgccgatgtagatggaatttaaatgtctgcccgcaaacttcaccgctgcaaactctatctcccgctccagcgcatccaggtaggaatccacacgcttcgcccacgatgcaatcggataggaggtaaacgagcaatacagacaggtcgtcggacagaacggtatcccgatatacaggctgtacccgttgtcataatcgatcttggaaagcagggagagctccctctctgcaatgtctgtcgcaaggcagatcttctcatccgacgcaaaataagtctgcttcatatacgtatagatctcgtcccggctttttccctcttcgagcagcttcatcggaatcttggtcggccggattcccgtgagcgttccccacggcagatactgaccggtcgcatccgacagaagcgcatacagattctgtttcagccggttcttcgtctccgggcgatctaaaggatcgactgcaaaggtacgctccaccgcaggcgccgtctctccctgctgccagcgcagcgttatcgcatcgtccgtgtactccacatgcatgcgggatgtcaccggctcgtcatactccttcttttccgcggatactccgacatattccgacggataaaatgccttgatgagtgaatggatatcgtactcaaattccggctgattcaatgttacttctatcatatctgactcttttctaaactaaatattatatcatctttttgcgctgctttctgcgcatccgaagttccgcaggaacttctaatatgaatccgataggattcattatatcatatgcgtctttgcttcggcaaaagtccggaaaacctctggtttcccggatcatacgcttacagatatggattgtatctgcgctctgttccgatcgtcgtggtgtcattatgtccggtgtagacggtcacttcatccggaagcggcagtaacttctccttgatgccgcgaatcagcgccgaagcgctccccttcggaaaatccgtccttccgaccgactgggcgaacagcgtatccccggaaaaaagggcgtcctgataggcaaaataataacagcagccacccaccgtgtgtcccggtgtaaacaatacccggatatggaatcccgcgagatcaaactcctgctcatccttcagaaatacatccgcgtgataggtcgtctccgctcccgtccatccgcttaagttcagctttggatcatcgagggtctctctctcatgctcctcggcatagaccttgataccaaaatgcgctgcgacttccgcagcgcccccggcatggtcaaaatgtccatgtgtcaataaaattgcaacaggatttaacttttcttcctctatgatctgtatcagacgatccgcatttgcccccggatcaatcagaatcatctctttcgtctcatcattgaccgcgaaatagcagttcgtctgcaccggtcctaccacatactgttctaccttaagaggcgccatctttttccctccgtctgcctttcctgcttcatcagcctgtcgttctcacaatatcaatcacgctgtcgatctggcgcagcttatcaatcacgctgcccagctcctctctgcccttcgtgctgaaggacacatcgatcgtcgccacgccctgtttgctcgtcttggagtggatcgcatcaatatcgatctcacgctccgtgaacactctcgtgatgtcgaccagaagtccggtacggttgttaccaaaaatcttgatctccgcgcgatacagtccgttgctgccgtcctgaccgtcatgctgccattccgcatcgatcagacgctccttctccatatccgacaagttgatgatattgatacagtcggttctgtggatggacacgccgcgtcccctcgtcacaaaacccacgatctcatctcccggcaccgggctgcagcacttggaaaaatgaacagcgacatcgtaaagtcccttgacaatgattccgctcttggagcgcttcgccgactccggattcttgttctcggaaccgatggtctcaagaacctcctcgtccgtgatccgcgccagatgatcccgcttatattcctcgtacatcttattgacaatctggccttcctttaagccgccgtgtccaatggtcgccagacaggaattccagtcatggaaaccatattttctcagcactttctcctggtattccggcttgttgatgtctgcaaagttgattcccttcgccttgcaggacgccacgagaagctccttgccgcgcgtaatattttcttccttcagctcactgcggaaccactggttgatcttattcttcgcctgggtactctttacgatgttcagccagtcacggcttggtcccttggagttctgcgaagtgataatctcgatccggtcaccgttctggatgacataatcgatcggaaccagctttccgttggcttttgcaccgatcattttgttgccgaccgcggagtgaatgctgtacgcaaaatcaatcggcgtcgacccgttcggcaggttcttgacatcgccggtcggtgtaaagcagaataccgtgtccgaaaaaagatccagatcactctttaaaaggctcatgaactccttattatcagacatgtcgcgctgccactccaagatctggcgcagccagcttaacttctcctcctccgtgacagtcatcggcactgccgcgccgccgttgttgctcgcttccttatatttccagtgcgccgctataccgtattccgctgtccggtgcatctcataggtacggatctggatctcaaacggctgtccggtcggtccgattaacgtcgtgtgaagcgactggtacatgttcggcttcggcatcgcgatataatccttaaaacggcccgggatcggcttgtacatctcgtgaatcacaccaagcgccgcatagcagtccttgacggaatccacgatgatgcggatggcgaacagatcgtagatctggtcgagcgttttgtcctgattcaccatcttcttataaatgctgaaaaaatgcttcgcgcgtccctcaatctccgccacgatgcccgccgccttgatatgtgcgcgcacttcctccacgagcgactgcacgtagtcgtcgcgcacactcttgcgctggtcaatctgacgcacaaggtcgtagtatgcctccggctccagatactttaacgagagatcgtcaagttcaatcttgatctttgaaataccgagccgctgtgcaatcgggcagtagatctcctgcgtctcacgcgcaatgcggatctgtgcctccttggactggtactttaatgtacgcatattgtgaagccggtctgcaagcttgattaagataacccggatatcttttgccatggcgaggaacatcttgcgcaggttctccgcctgcatctctaagcgctcacgcagaacggtccttctgatcgtgattatggctgttgtccgtaagatgcagatggcgcagcttcgtcactccgtccacgagaagcagcacttcctcgctgaactcctccttgatctcatccgccgtcatgaccgtgtcctcaagcacatcatgaagcagacctgccgcgatcgtctccttgtcaagctccagctccgctaaaatgatcgccacgcacagcggatgcacaatatacggctcaccagatttgcgcgtctgtccctcatgcgcatcccgcgctacatgatacgccttttcaataagagaaatatctgcggaagggtgatatttgcgcacactggcgatcaactcatgatataaatcctccggactctcaaactccttcattggcttgatactgcggtcctcttcctttaccagtttttccaaatgctcacgctcaagttctttttctttctgagagtaatctgccatgtgcctcacccacttcatccatgataatttttatttcaatattatattttatttcctaataaaatgcaactttgtattttctcatctgttttccatctatctgcaccgtttcacagtaatgaaagcccagcttttgcgccagatgctccgataccacgtttccctcctcgatcagacagctgaccgacggcagcatgagttcctcttttacataggtaagaatcgcactgcatacctccgtcgcatagccctgcctctgccacgtcacaccgatggcataaccgagctccagctctccgcccagctcctcccggtgttccacgccggcgcgcccgatcagctctccgctgttcctgtcgcacacgatccacatgccgtatccgtagaaccggtacatctgctcgatatacgcctgctgatattcccgctcctcctcatacggatacagcggctccatgtagtccgtcattcctttcccggcatacagttcaaacagtgcatctaagtattccatggaaaattccttcacgatgcagcgcggcgtttttaaaatgatccacggaatacgatgatgtctctcatagacatgctgtaaaaaagatccgtcgatctcctccatcccttccgcatacatatccgccggagacgtcacttccatctccccggcggctgcctcgtttctctgcgcccttccatctcccggcatcagatagcaaagcgcagccatcccgatccgctgtgcctcgtttagttccttcgcatctcccgaaactaaaattgccttttccgcaaacaccttttccgctaacctctcttttgcaagcgccccttccacacgcttctcttcctgaatgtgtttcttcgcgctgtcccattccaaaacgttccgcccacattcccgctctgttctcagattctccagcagcatgtcacgctctgtctttggcagctttccaattaaaatatattctaactttaacattcttcctcttcccagaaaatttcatccagcgttttgtccagctccctgcatatcgcaatgcacagccggattgtgggattataatctcccttctcgatggcattgatcgtctgtctcgacactcccaccttctcggcgagcgcctgctgggacagatcctttgccgcgcgcgccgcttttaacctgagatttttcattcagctttttcctccgacagatcccgcttctcccggcttctttttatgagaaaaacaatttcaaagacaacgaacatcactgcaaacaccagattcaccgcgccaaatcctagttttccgtccgcaaacagcgttccgatccgctggttattttccgcgattccaagattgcacagtgccagcactccaaacatcagatgtacgctccacggcttctggttcaggttcatataagcatcgttccagatacaatatacgccgaacacaagcagtgccagaccaattcccagataatttcccatcgtatagtcgcaccaggacggcgcttctttcatatacaatgccccatataccagttcatacaacagcagcgtcagaaaaccgtaccggcaggcgcggtcgcgcgtctgatactgccgctcatcatagtcagcctccctgcgtccccgtttcttcacccagcagataattcctaccgccgccagccctgccacaatgccaagcagatacgccacattttctttcatcttccaatcctcctgtttcatttcctgtcacacagtcctgatagtttctgatttctccttttatggtagcatctgctttacaatatgtcaaatatatattacattcctccccatgcatctgtaatcccgtcatgcatccactgattctgttcctccgcataatcctgtaccagaagatactgatactggctgacggtttttaatgcgtcatacacgtagcgcagcggaatccaggagcggttgccgtccggatccgccggatccccgaggaacacctgatctgacgacgcatcgtaaaggctgatcgacacataatgccctcccgtcttcttccagtaggtatcatcgtccctgctggaaatcagaaccaccgccatctgcgacgccgcaatctcctgctgaaactcctcatagctttccggctttgtgtttaacgtacagtcaaagccgctttttcgcaatgtgaccttcatatccgcccaaccgattgctccgatcttccgcgacggcgcgtagccagacacctgtctcgcatattcgtacatatcccacggcgaacaggtatgttccgtgagtgtgcagtaaatatttgccatacagcacagaccgcatccgaaattgccaaaataattgcccctgacatactggttcgaccattcgcccgaccatgcccgtctttctgcccaggacttcggtccctgcagaaatgtgtagactccctgctccggatgtgccgcctcctctgccgcgcgtgctgccgcatctgcgaaaatctcatggttgtccaccagaatttccatctcatttgtgcgaaattctgcaagaattcctgcataaagtggtgtctgcacctgaccgtcggttcccgtctccttatatttctgcccgccatggcgcattttccactcagatccgtcatttttcccagagacagccgcactgcaaaataacgccacacataatatcagtgcaatcattccctgcataagttccttttgtttattcttgattatatttttcatattcatttgcaatttttccttcaaaatagcattcctgaatctacctaatgttaccctcttcctgcctgcagggcaagactttttcggaaattccatcgtttctctttacgaatccgctctttttcgctacaatagtgccgtagaggcggcggatgactgctgtcacagcaggctgcttcttatttcacccgcccgcatacagggcagaaagaggtatactatgtcaaacccaatcgttactatcgagatggaaaatggcgatatcatgaaggcagagctctatcctgagatcgcaccaaatacggtaaacaattttatcagcctgatccagaaaggctactatgacggactgatcttccaccgcgtcatcaacggctttatgattcagggcggctgtccggacggaaccggcatgggcggcccgggctacgatatcaagggcgaattttcccagaacggtttcaaaaatgacttaaagcacacagagggcgttctttccatggcaagagccatgcatccggattccgccggaagccagttcttcatcatgcataagacttccccgcatctggacggcgcatacgctgcattcggcaagatcactgagggcatggacgtagtcaacaagatcgcagagactgcaaccgactatagcgaccgcccactcgctccgcaggtcatgaaaaaagtgactgtcgaaacgttcggtgtggagtatccggaaccagagaagtgctaatgcaattctccgaaatgctaaagaaaacggtctgccaactaacgcagtctgtgctggaagaaacgttattattgtagagacaggcacattacggttctgaatgaaaattagcttgaacattcggaatcaaaaaatgcaggatttctaaccagcatttttgcatctgcgatgatccgtgtctttccaagtttggagcactccacggtgggtcatgtccgcactccgtgagacaatttgtaggacttttgtgcagcacttacctgtgctcccgaaaaaacataaccgcgcgaagcagatgtctgagctgctatctgccacaatttcaatagcagatagcagcgagttctgttcgcgcggtttaataatgtctatgagggagcacagttagtgctgccagaaagtccgcccattgtctccggtgtgtcggacatgcgcccaccaggtgtccaaacgtggaagagacacggaatcagatgcaaaatctgtctggaagaaatccacacatttttctccaccgaatggttcaggcttattttcattccagaacctgtcagtgcttttacctccatataataacacttactccagcacggtctgccctatccggcagaccgttttttgtgcatatttattttaccggaatcagcttctccttgcctccgacatacggacgcagtgctaccggaacattgacgcttccgtctgcgttgaggttgttctctaagaacgcgatcagcattctaggcggcgcaaccaccgtgttattcaaggtatgtgcaaaatacttgctgccatccttgcccttcacacggatctttaatcttctcgcctgtgcatcgccgaggtttgagcagcttccaacctcgaaatacttcttctgtctcggagaccatgcctcaacatcgcaggacttcactttcagatctgccagatcgccggaacagcactccagggtacgaaccgggatatccagacttctgaacaggtcaaccgtgttctgccacagtttatcgtaccacatcttggactcttccggcttgcagactacgatcatctcctgcttctcaaactggtgaatacgataaacaccgcgctcctcgatgccgtgtgcgcctttctccttgcggaagcatggagagtaggatgtcagtgtatatggcagcttctcctcatcgttgattgtatcgatgaacttaccgatcatggaatgctcggaggtaccaatcagataaaggtcctcgccctcgatcttgtacatcatggcatccatctcatcaaaactcataacgcccgtcacaacattgctgcggatcataaacggcggcaccacgtaggtaaaaccgcggtcgatcatgaaatctctcgcgtaggagagcactgcggagtgtacacgcgcaatatcgcccatcagataataaaatccgtttcctgccaccttgcctgcagcatccagatcaatgccgttaaaacgctccatgatctcggtgtgatacgggatctcaaaatccggaacaaccggctcgccaaacttctcgatctccacattgcaggaatcatccttgccgatcggtacggacggatcaatgatgttcgggatcgtcatcatgatcttggtgactttctcctgaagttccttttctttttcctctaattctgccagacgggcagctccctctgcaacctgtgtcttgacagcctcagcctcgtcctttttgccctgacccatcagtttaccgatctctttggacagctggtttctctttgctcgaagatcgtctgcttcctgctgtgtcttgcgcgcctcggcatcgagttcaattacctcgtccacaagcggaagcttgtgatcctggaatttgttcttaatgttctgctttacaacctccgggttctctctcaaaaacttcagatcgatcatgtcatttcctcctaaattcttctgttctatccgcacaggaacaaaaaaacctttcgcccctgtgtcaaatgtccccgtcatctctgaccgggcaccacttgcacatgggacgaaaggttctgcttccgcgttgccacccatcttgccacaggcatattcctgcgacctctcaaacgtatgttaaaggatacgaccctcgcagctttcactgccggctccaaaagtggaaagattctatcctgcaccggttcgcaccacccaccggctctctgtcgcagtcttcaaaccgcagctttcttcatcgccaattcttccgctattatataatgattatccgcaaaatgcaaggttaatatgcagattcgcccgttccgcgcccagtccgcatcgaatcccctgtattttccgcactttgtcctttatctattgcgcggcgtcctccgcaatccacgctgccagcgtcttcgcgcgctgtgcccaggtatgcttctgctccacaatcgctctgccacgccgcacaatctcattcctcccggaatcattttgcaataaatccttcactttttccggaagagcgtccatatcctgcagcgcaacatagcagacgccctcgccctcatgaagttcctcttccaggtaacagctcggatcggtcacacataccgctccgtttaagatggaattaaacaccctgtcatgcgctccgtccttaaaccacggcatcacgttcaaagacgccttcgcgtccgccagcatctcaaggcaggtaacggaatcggtctgcgggtgcagcttcaggcactccggatgtctcacatcctccagttcctcccagccttttccgaccacatgtaccggaattcctgcattgacgagcgtgcgcaccgcctttccccgccagtaattgcgcacatacagatcgatgaaaatcatcttgtgcagggcaatccgcagctgatcattgggctcttttcccatctcccgctcgcagtgggcaagcgccacttcctccaccgtgcaggccggatgttccaacagatcgtctatgatcccccggtaaaatgccgcatactcctcattgatccagttgatatagggttcaaaaaaggaaagttttgtgtaatttccggtcaggatcacgtcatagcagggcgccgcctgctctgcgtcaccctgtgcccccgcttcttccgtctcaactgcggtgccctgtgcccccgcttttcccgtcttagcttcgtcttctccctgccgcaatccggttcccgcaagcggcagaaatccccgcgacacatactccggataaaattcttcaaaatatgccttctgtctccggtcgatgctgatatgccggtatttttccggcagatcttttaacctgtcatcgtaaaagtacggatggtcggcggcaatattataacagggaatgtggtaggtatcccagagataaccgatcccctcgcggtacacgcccgcctccttttccagtccctgaaaattgaaggtcacaagcaccgtctcgcgcggtctgataaacttgcgcagctttccagcactgctctcctcctgtttcagatcatagaaaaatactgcgtatcccagtttttgaaactcccctgccatctgatgggagaagtaggatagtgtctccactccgccctccatcatgacaattctttttatcatgccagctcctttctgtccgcagcgctgtcattattttttttgcttactcatgccgcagcgcatcaatcggatttaaattcgccgccttgtaggacgggaacacaccgaatacgattccgatgaccatagaaaacgccaccgctcccacggctgccggaacgctgatcgccaccggcgtcgtcgtcacatacgagatcacctgcgcgagaataattccaaccagcacgccgatgagaccgcccagactggtgagcaccgccgcctccgtcagaaactgtccaaggatccgggacttgcgcgccccgatcgcctttttcagaccgatctcctgcgtccgctccgtcaccgataccagcatgatgttcatgacgccgataccgccgacaatcagcgaaatgccggcaatccagatcaacatggtgttggtggaactgcttagttcctgaatctgctgtgcctgctccatcaggtcttttgccttatactggatcgtcgtgtccgaaaccgacagatacccgtttagcagctccgctcccgcttttccggcgctggtcatatcatccgtactctccacgcgcagcaccacattctgtggctcgtcatactgataaatgatcggccaggtcgtcgccggcacatacacagagccggcggaatcctgcgcgtatgtatagtagtcgtcaatcgaattgatgaccggttcaaactttttcgcctttgtcacaattcccaccacgacatacggctcctgctgaatctcaatcgtctccccgacggcttcctccccctggaacagtgcatccgccgaatcctcatccagaatcgccaccttgtggtactggtcaaaatcctgctgcgtgaatccgcgcccttccttcataatataattgcaggtgtcaaaataagccacgtcaacgcccttgacataaccgccggaaagcccggtattcagatgatagactccgttgtaatcctgccggctcagatagcgcgacacattttccacatgcgggatctccttgagctgttcaaccacttcgtccgccacaagcggcacgccctccggaatgccgttgtactccatctcgtattcccactctccctgatacagagaaatctcgacggtattctcaccggctccgaccaggttctgcttgatctgctcatttgttcccttaattgtagatacaatcgcaataatagctgcaataccgataataattcccagcatcgtcaggaaggaacgcatcttgtgagcccagattccgcggaaagataatcttatattttcaaacatctccgttcctcctttaataattggatgattcgtccgtgacggcagcgccctccaccgcatttttcccgtacgggaatgcgatgcggtcgtcctccgtcagcccggacttgatctctaccgcagatccgtagaccgttcttccggttaccacatactgttttttcagccggttattctcatctgcaatcatacagtacgactttccatcctccgacctcacatacgctttttctataaaaatgccgccgccatcggactgattggtcgatatggacagatctaccgcctccccgttgcggagcgcggagctgtcctcgatataagccgtgtactcataataggagacattgggatttccatcgccccacgagttgcccgaaaccggataatccgatatttccgtgattgtggcatcaaacgtcatgccgctctcccatgaattggcagtcaccacggttcccaccgtcacatcatccaaaagcagctcgctgatcgtcccctttacatagagcccgtcatctccggttatcaccagaaacgcctgcccctgctcgggcttctcgtccggatcgccgagcgtcttgacgacaccgtccacctccgcgtagaccacaccgtccgtcgcacttttctccatggactcgagcgccagctgttcctgtctgcgctgaatatcgagcgtctttaatttttcttcaatgtcagccgcctcctgatagagttcctcggaagtatatccctttggcaccttccagtctgccataaaatcctcgtaggcctgcatgtactcatccgcgagggaggtcggtatgtattcttttcccgaaaacagataccacatgcggctctcatcgtaatccgccggaaaatcgctgccgtttaactcgacggtattcggggacactgtatcatccgcaaccggcgtctgccgcccggtcgcttcatcggtgtcaagcaccatcttaccgtccgcatccttcttgcagacgatcacgcgcacatgttttccgctgcctccctccgcggtaggacggatggcattgaaaaagccgccgtaggcgtatgcattctggttgacataataaatatacggttcttccgctgttcctgccggatacaccagttcccccgccgcattggttgtcacgttgtagggaatggaggccgccgtcagatagttgtagattctgctgtcgttcttatctgtctctgtcaggcggttttcctcgtccatgtgctgataccaggcaagctgctcctcgttcagcttcggcggatcttttttcaccggcgtctgcgtctttaacatttcatacttgtatttttgtctctcgatgttattctcgatcgtgctgatatcgagttttttgcgttcaatctctatctggagttccgccgtgtcataggcgagcaacgggtctcccttttgcacctcatcccccttctccacatagatctccttgatcattctggaatcatccagatagatctcctgtgaggaatcgttcgtgacggtgccgtaacttgtctccgtgtctccccagtatccccagttgaggttggaaaccggctgcacttccgcgataagctttttgtcctgataggacttatacccgtatacgcctcccaccgcagccgagagggtgaccgcaatacctgcgatgaccgcaatcactttcttaatcttcatgataccgctccgtccccctctccctcatagatctcaccgtcgatgatccggacaatccgcttggctttcgccgcaatcctgggatcatgcgtaatcatgacgatggtaacgccctcttcgttcaggctgtcaaaaagctccatgatctgctcgccggatttggagtccagagctcctgtcggctcatctgccagcagaatcttaggatggttgaccatcgcgcgggcgatggcgacacgctgcttctgtccgccggaaagctgtgtcggtctgaaattgacacgatccccgagtcccactctctcgagcgctttcgtcgcgcggctccgcctctcctttttgcgcactccggcgtagctgagcggaagcgccacattttccacggcgctctcccgcggcatcagctgaaaactctggaacacgaacccgatgctctttaagcggagatccgagagttccctgtcttttaatttgagcacgttctcccccgccagctcgtaagtaccgctcgtcggtcggtcgagacacccgataatattcatcagtgtggtcttaccggaaccggacggtcccataatggcgacatactctccttcctcgaccgtcagcgatacatcctttaacaccggcacaaccagcttctcctgctgatagtctttgtagatattctgcagattcagtatcattctgccacctccgcctctgtcccttctccggcatccataccgtcatacatttcatccggcagttctgtatcatagacgctgtccaacacatcatagagcagttccgtgtcatagacaccctctgtatcgtacagattctcgtccgccggctgattgtaaagcggagaagaataatccacttccgcctcgtcggtcacggtcgtcacaccctcatagagaccagccatcggccaggcaatgtaatcgtcctctgcaagccctgatacgatctcatactcatccatatccgcatcgtactctcccagctcgatgtagcgcttctccagacggtctttctcattagccgcccacacatacggggtatcttcgtcctgcacgatgtaggagccgtacagccacagaccttccttcacttcctcctgtccctgatccagctcgatgtacacatgctgccccaggatcagtccgtccaccgagtcgagatccacatagaacggatacttggacgctgactgtgtatctcccgccgaagaagtgctgtaatagctgttatcgttcccctgctgcgggctctccgtgtcaattttcccgatcgttccgctccacgtcttcgtgccgtccacacgcgagcggatcacaacctcctgtccctcggaaagcatccagacattctgctcatcgatgcttcccttgatccggtactctccagtctgtaagatcgtcataaacggcgcgctgttcccgttgctatccacgcctttctcattgatctccttgaccactcccgccaccttgctcacaacggaagaactgctgacctgtttctgctccttggagatctcaagcttcttgctctccatatcgaactgcttctgtgcgatggagttctggatattctgaatctgcgtggtgtaatcgtagcgttccgattcgtccaccttctccatctctttcgtcagtgtgtcgatctgtttgttgtaattatctatctcattctggatgccttccagctccagcttcgcctgctcaatcttcatggtaaggtcactggtgtcgtaagtgaccagagtctgtccctcctcgacctcatcgccgacctccaccttgatctcgctgatcgtccgggaagaatccacattcacctcgtatgaatcctgcgtctccaccacaccgttataccggttggaaacacctgcatactgattcataatgcgggataccttttccacatagaccttgtcctctgaacttccatcatcaaagatcggtatcatctgcctgatatcatcccggaaataataaccggttcctcccagaacagcagccactgctgccacaccgatcagaattccaacgctctttttgcccatagctcctcctctgccccagacgggttactttcttttctttattctatcatcttttcagacccgatacatagcgtttaattcttaataatttttgtagaatagaacattaaaaaagcctccgcgcatattgaacactcacaatatgcacggaagcctagtctacacactttgaaagattttattttaacggatattttgcggtgagctccgccacaatcgctctggcgcgatctgccgccggctctccctccttgatcatcatggcaatcgcctccgcaatctgatccatatccccggtattgaatccgcgggatgtcaccgccggcgtaccgagacgcacaccactcgtcacgaacggagacttcggatcgttcggaatcgtatttttattgcaggtgatatttacggaatccagaagcttctccaccgcttttccggtctggtcaaaattcgtcagatcgacaagcatcaggtgattgtcggtgcctcccgatacgatcctgatgccgcggttcatcagtcctttgcacagcgcctgcgcattgtcgatgatgttctgctggtacaccttgaactccggctgcagtgcttccttgaagcagactgccttcgccgcgatcacatgcatcagcggaccaccctggattcccgggaagattgccttgttaaagttgtacttgtctgccgcttcctgattgcagagaatcattccgccgcgcggtccgcgcagagtcttgtgcgtggtcgttgtcacgacatccgcatacgggatcgggcttggatgaagtcccgccgcaaccagaccagcaatgtgcgccatgtcaaccatgagcacggcaccgcaggcgtccgcgatctcacggaatttcttaaaatcgatcgtgcgcgcgtaggcactggcacctgcaataatcatcttcggcttgcactcgagggcaatctccatcaccttgtcgtaatcgatgaatccctcgtcgttcacaccgtacggtacgatatgaaaataggttccggaaaaattgaccggtgaaccgtgcgtaagatgtccgccgtgatccagattcatccccatcacggtgtcgcccggctttaaaaccgcgaactgcactgccatattcgcctgtgctccggaatgcggctgcacattgacataatcacagccgaagagcttcttcgcgcgctctctcgccagctcctccacgacatccacgcagtcacatccgccgtaatagcgcttccccggatacccttccgcatatttattggtcaaaacgcttcccatcgcagacatcaccgccgggcttacccagttctccgacgcgatcagctcaatatggctgttctgtctgtcaaactcatcctttattgcctgcgcgatttccacatccaccgcttcaatatcttccattgtatacatcgtatgtattctcccttcctgaaccgccgcactgtctttctacgaaaaacacttgtctttctacggctatgctactcattataaatgactttgtatctttattcaatcagaaaacacataccgtctataacaatttgttataaaacatataagcgcaccagataaatcgcaagtgccgcctggcaaaccagaatgagcggcattccggtcacaaaataccagtgctttgtcttgtggcggaacaaatacattcctgcccaggttcccgcgcttcccccgagcaggctcacaccaaagagcaccttctccggaatccgccaccggtgcagtcttgcgcgcttcttatccgaccacatgaccgccacaccgatcacattcataaccgccaaatagattacaaacaacttcatcccatccatctcatttctcctcaatgaccgttttcatgtcactccgcaaactgaacatccagatctaccgctctcttaattccatccacacttccctcttcactgtactgccagaaggtaaatatggcagggtcaatctctgcgccatgccattatacacgctatcgtacgtttcttcatgcctgcttcccgttattttcctttttcctgcagggaaataaaaaggaccgcaaatacatctttggtcaatgtattgcagccccttactatttattttatttcttgatcagtctgttcttgccaagatgcagtctcatgatgtaccacagctccgttgcaatacagatggaagaatatgctccgcagagcagacctgccatcaacggaagtgcaaactcacggatacttgcaacaccgagtaagaacagcatgaataccatgataaaggttgtcagagacgtattgatacttcgtgaaagcgtctgtgtcagactcttgttggcaacctccgccagaagctccggcgtctgctttgcagctgtcctgcccaggttctcacggatacggtcaaagataacgatcgtatcattgacagagtaaccgatgatcgtcagcatacatgcgataaaggtatttccgacggaaatacgaagcagtgaataaaccgccagcactaccagcacatcgtgcagcagcgcaataatcgcacttgcaccaaaacggatatccttgaaccggaaccagatgtagatcagcatgcagatcgaagctacgatcacggcaacgatggcatcggaacgcatctcattgctgacagtggagctgatactctgtgatgtaatggaagattcatccgctccaagctgatccaccagtgcctgctccagcgtatctctctcatccagcgtcagggtacgcgtctttaccgtaatctgtgtcgtaccttccactttgttcgccatgatgtcattgtcgccgatcacatctgcaaccaccggaacgatggtattctcaatctcttcaatcgtgtaatccttaccataatctgcagtggtggaagtacctcccacaaaatccagaccatagttcaacgctccgcttcccttggccgcatgaacgcccattccgataaatcccgctgcaatcattgccagagaaaccgcaaagaatacgcctctctttccgaggaagttcagcgtcctgcgctcttttgcacggccatagaacttctcgtcacggataccgatggcatagaaggaatacaggatccatcttgtcacgacaagcgctgtgaacatggaaagtacaataccaatcatcagagtgtatgcaaatcccttgactgtaccggaacccagcgcaatcagtaccagcgccgcgatgatcgttgtgatgttaccgtcaaggatggctgacattgccttcttaaaaccgatcttcattgaagaattgactgtcttgcccgtcgcaatctcctcacggatacgtgcgaagataatgacgttcgcatcgaccgccataccgatacttaagatgatacccgcaatacccggcagtgtcagtgtaatctcaaataagtataatgtagcaattaccagacaggtatagattgccagcgcgatggctgccgccagacccggaatctgatacatcacaatcatgaagatcatgacgatcactaaaccgatggctgctgcctttaagctggaagagattgcctggcttcccagctgtgctcctacaacgctggattccagctcctgcagctttaaggaaagagaaccgatacggatctgtgttgccagtgtctcggcatcctcatatgtcttcatgccggaaatctgtgcggtaccgccggtgatggcttcctttacctgcggatagctgatcgtctcgccgtcatacacgatcggcagataattgccgacattgtctgtggtggcatccgcaaacagctttgctccgtcgtctgtgagctttaactgtaccacatactgcttgttgccgtagctgtctgtcgtggttcccgcctgcgcatccgcaacctggtcacccgtcatgtaaaccgttccgtccggaagctggaactccaaagaacccggattaccgagatcctccagaatcgcattggcatccgatacgcccgggatctcaaccgtaatacggtcatctcccacctggtaaaccgacgcttctgtgctgtagccctctacacgcttctgcagcttgtagatcgtatcactcatatcctccgcactcggattgtcatccacaacctggtaggtaatggaaacaccgccggataaatccagaccaagcggaatgctcatctcttccccgattcccgtcgaagaaagaatgatggatgcataataagcaagtcccgccagtgcaccaaggatcacgatcaaaataacaatcgctttactcttcttcattcttttgttcctcctctgcagcttttatcataatcgcacattcgatgcgctttttctgaagctcacatccgatgtcatatgctccgcagatgtcgccgctgaaattgtaggcattcgccgcgcagccgccgctgcagtagaatcttgcgaaacacttgcggcatttctccttcgcatagacattgcagcatttaaactcgtcgcgaatgtctgtatttaagatgccctcatcgacatttccgagaaggaacttttcatttccgacaaactgatggcacggatagaaatcgccccacggggtgaccgccagatactcggttcccgaaccgcagccggaaagacgcttcgccacacacggaccgccctcaagatcgatcataaagtggaagaaattaaaatcttctccgctcttatgacgtctgatcatctcaactgccagcttgtcatactcctcgaagagcttcggcagatcctcctcccggattgcgtacggctccttcggctccgccacaaccggctccaccgaaatctgcttgaatccgagatctgcaagatgcagcacatcctccgagaaatcaagattataatgtgtaaaggttcctctcacataatacttatcctgatgtctgctctccgcgaactgctggaacttcggcacgatcagatcatagcttcccgcacccttgcggaacggccgcatcttatcgtgaacttccttccgtccgtcaatacttaaaacgacattgcccatctcgcggttacagaattccataacctcatcatttaaaagtacaccgtttgttgtcagtgtaaagcgaaacttcttgtcatgaagcttctcctgctctctgccgtatgccacaagatccttgaccacctgccagttcataagcggttccccgccgaaaaaatccacctccaggttgcgtctgttgccggaattggcaatcagaaaatcaagtgccttcttcccgacttcaaaggacataagagcccttctcccgtggtactcgccctcctcggcaaagcaatactgacaggcaaggttgcagtcatgcgcaatgtgcagacacagagccttcacaaccgtcgggcgctttttgaaatccatgatatagttctcgtaggtatccttcgtaaaaagctcctcattgtcgaccagcatctgcacctcatcaagtgcctcttccacttcagtctccggatagcgctcccgcagagaattcacaatctcctctcttgtatgtccttcatacagggcaatgacatcatatgtcacgtcatctaccacatgaatcgcgccgctgtttacatccagaacaatatcatagccgttgttcttatactgatgaaccactataatatttcctctctttctaattctgactattataacgtacaaatgaccgcacgcttcgcgaacggtcgtctgtaggtaatgctattcacttatgcccgtgaaaaattatctgttctcacagctctggtttcctacggtgcaggatgtcttgcatgcagactgacaggatgtctggcactcgccgcatccgcccttcttgatggtgttctgtaactttctggtatttaatgtcttaacgtgcttcataataatctctcctttatatcttacaataaaattctattaacccgtatagtatagcacatgaccggttagatgaaaagcctttttttgctgaactttcgccccacagagcggctttttcagcttaacattcctcccgccatgccggatgccccgcagaggatcagcgttgaaaaaatgcgcgtcatctgaagatcacccgtaccctttacgagcagcgacacaccaaacagcagcagaaaatagatgattcccgccgccagtccccacagaaacttctgttcccgcatccgttttcccatcagaaaacctccgcaaagcccggaaatcacatagaccgccacaattccgattttgatgacggattctcccggctccatcttgtataagagaagtgcgagaagaagcagtagaagaccgcttataaggaacatcacaaacacggctgcaaggatggctgtcgtcgggttgctttttgcatctctcggttttattttgtatcccagcttcatagatagacctgcctgattctttctatcctatctatatgccggttcgcatgcggctatgcaaacacgattgcatactctgcatcaaaactgcctccggctgcaagcgcattctcgtatgggcgctccgccaggcttccctcaaaatcaaccgcatcgcatcttccataccagggctcaatgcacaggaacggtgcttcctttccttccggagaccacagagcaaacagcggcgcatcaaagcgtaccgtcacataggcttcgccgtcgcggtccaggattgacacctctcccgtctgcgctccctccaccatgtaggtgcacttgtcaaagaatccgggcgtaatcacagcctctccatcctccagttccagctcctcatccgtcatgactgccatgccgtccggcgtgttgccgtgatgatgcagtctgtcggtaagatttccgaaccggagacgataccccgtcttatcctgttccccgttgatcgggcacaaaaatgccggatgtgcgccgatggaaaaatacatcggcttctcatcggtgttgtccaccttccagtgaacggagacttcattttcgtccagcatatatccgatgtgcagccggaaccggaacggatatttcgcataggtctcctctgtggatgagagcacaaaccagatgctctttccctcctgtgcctccagcgcaaactccatatcgcgcgcgaatccgtgctgtcccatcgggtaggttctgccctcataccggtattccttgttcttcggcgcgccgacaaacgggaagagcaccggcgatgttctgccccagtattccgggtctccgcaccacatatattccctgccgtccgccttgcgtttcacagacttgatctccgcgccgaacgattcgatctcgacccgcagcgtgtcattttccaaaatatatctcatgcttcacctcagtcttcccacttacagttcgcagttgttaaccgttctcgggaacggaatgacgtcacggatgttggacataccggtcagatacatcacgcagcgctcgaatccgagtccgaatcccgcatgtcttgcggaaccgtactttctgagatcgaggtagaactcataatcctcctcgcgaagtcccagctcgttgatgcgcgccagaagcttgtcgtagtcgtcctctctctggcttccgccgatgatctctccgattcccggaaccagacagtcaactgccgccaccgtcttgccgtcctcgttcatcttcatgtagaacgccttgatctccttcggataatctgtcacaaataccggacgcttgtagatctcctctgtcagatagcgttcatgctccgtctgaagatccgcaccccaggataccttgtactcaaacttgtcgttgtgcttctctaagatctcgattgcctccgtgtaggtcacacgtgcgaaatcagaattcaccacattattcagccggtcaaggagtcccttgtcgatgaagttattgaagaatgccatctcctccggcgcattctcaagcacatagtggatgatatatttgagcatgctctccgcaaggatcatatcgtcctcaagatctgcaaatgcgatctccggctcgatcatccagaactccgccgcatgtctggtcgtgttggaattctccgcgcggaatgtcggtccgaacgtatagatgttcttaaacgccatcgcatatgtctcgccgtttaactgtccgctgacggtcagattcgtcggcttattgaaaaagtccttcgtatagtccacggttccgtccggattcttcggcacattggcaagatccatcgtcgtcacctggaacatctcacctgcaccctcgcagtcacttcctgtgatgagcggtgtgtgcacatagacgaaatctctctcctggaagaacttatggatcgcataggcaatcagggaacgcacgcggaacaccgcctcaaaggtgttggtgcgcggtctcaaatgagagatcgttctcaaatactcaaagctgtgtttcttcttctgcagcggataatccggtgtggaagctccctccacctcaatcttctccgcctgaatctcgaacggctgcttcatctccggggttgcgacaagcttacccgtcacgatgattgccgcgccgacgtttaacttctccacttcctcaaagttctccagcacattggaaaataccacctgcaccggctcaaagaacgtaccgtcattgacaacgataaagccgaaattcttggaattacgaagacttctgacccatccgccgatggtcactgtcgtatccagatactcatccttgctgcgaaataaatcccttatatttaccagatccatacattcctccatccgcaacagacgggtgcgccactctgccgcatcccgtctgccactctctatctcttttctattatcttatctgcattgccgcaaaaaatcaatgcttattcctaattggctgcgccggtctcttccgtgctttctgccgcctcatacgtcgtagaggcatctgttgcacttcctgcctctgcttcatccgcagcgtcttccgtcaccgcgtcgctctccgtgtccgcagacggatccaccgtcacaactgccgtctcaagcagctgatccaacgcctgatcgtagcggtagagagctgcaaaatatctcttgccatagtcggtatctccaaaaccgtagatattatacatcgcctccacagactcgtatccgttctggcttaccagctgctctgcgtatgcatcgatgtcgtcctggttcacctcaacaccgagttcatccgcaatcgcatccataatgaactcaaggcggatgctcttctccattccctcattccagtatgcttccatctcctcaacggtctttccgtagtaggtgctcacataatcggcaagctggctctcgtctccgttgcagttctgctcaatgtactgtcttctgtaatcatccacacgcgcagtaagataatcctccggcacttccgcctcacaattatctataagataattctgcacggcagtcgtagtgtctttctgcttattatactcggcactgctctccatgtagctgcggatctgatcgtacatctcgtccaccgtatccacctggaactgctccttggcaaatgcgtcatccacatcatcgatcgtcatttccttctgaatggagttgacggtaaaggtaaatacaaccgcttttcctgccagatccgtattgccgtaatcatccggaaatgtcacatcacagtcgatcacatcaccgacggaagctcccttcaagccgtccgtaaagccatcaatgtagcctgtccctgtggcagatgcgttctggtacacatcaatattctgattctgtgcggtgcctccgttaaacgctgtaccgtcaagctttccgacatagtccacattgacgatgtctccctcctcaaccgtggtcttgtccgggtctgccgtatagaatggaccataattatcaaacatctgcttgaaatagtcctttactttctggtcatccacgtcataatccccggtgatcgtcaccggaatcgcgctgtaatcacagagtgttacataatcgcttcccttcaggtcaaacgcgctgctcgcacacggagtgctcgtgatcgtaccggaaaccgtactgtctgcgatgccctcggtcgacgctgcgctctctgtcgcctccgtcgccgccggatcggcgtcctttgctccgcatcctgctgcaccaaacgccatcatagcgcaaagcatcagtgctactgttctcttcttcatatacaaataccctttctattccctcttttggcgaaatctgctttcgtcgacttaacctttatattgtaccacattttcttctaaaaagccaatatcttttgccgcaaacccttattgttccacaccgacttcttctgtagtgaaatattgatgcttattacccaaaatcagttccaacccatcgggtttcttatcaatagatttgtatcaataatttgcattatgagaagttccaagatggaactgtaaaatgtattgaggatgagataccgtttgaactgccggaagggtgggaatggacaagattaggctcagttttttttactgtgactggaagtacaccttcgacaaaagatacttcgctttacggcattgattacccattctataaaccagctgacttggatgctggttataaagtctttaaatcggaaagcacagtctctgaaaagggatatcgttccggtagaccgttaccaccacattccgttttagtgacttgtatcggtgctaccattggaaaaactggttatatacataatgcaggtatttgtaatcaacaaattaacgccatacttcctaatacggatattctttcagattacacatacttctgtatatgttcgcagtttgagcagcagcaaatattgataaattcatcagctactacattgccaattcttaataaaagcaagtttgataaccttttgtttcctgtgccaccacatgaacaacagttattgatagttgataaaatacaaggcatgcttacacttgttaataaaattcaagataatcaagaatttttgaaagataagataattgcaacaaaatccaaaatccttgatcttgccatccgtggtgagcttgttccgcaaaatccagacgacgagccagcttccgttcttcttgagcgtatacgtgccgaaaaggaagaacttatcaagaagggaaaaatcaagcgtgacaagaaggaatccgtcatcttcaaaggtgacgataactcttattatctgaggagtgaatctaaagcgatagaaactacaaatgaattgccatatgaaattccagattcatgggaatgggcaagaatcggagatgttttgcaagtaaatcctcgcaacaaaattgaagatttattggaagtttcatttattccaatgccgctaatagatgatggttttagtggaaagcacacatctgaagtacgtgtctgggaaaaagttaaatctggttttactccctttatggaaggagatattggcatagcaaaaatcacaccatgctttgagaatagaaaatctgtagttttcagaaatcttaaaaatggctacggcgcaggaacgactgaacttcacattttaagaccatatgcatctactattttacctgaatatattctcgcttacgttaaatcttcgatgtttattggtaaaggcaagcaagaatttacgggcgcagtaggacaacagcgaattggtaaggattatgtagaaaattcatgtttcccaatcccgccattcgcagagcaaacaagaattgttgagcaaatacatattgcatataaacaacttgatttgatttcaaatgcattactttagcaaacagccgccctcgaattgaaggcggctatctttttaccatgttacaattttatccacaagatcctgttgttcgcttgcagtgcgacgaagatatattcgtgttgtttcaatactttcatgccccataaggtcggcaagcagagcaatatcattgtacttctcaagaaagttctttgcgtatctatggcggaatgaatgcggataaaccacctttttatcaagtccatatttatctgcataatttttaagttgttgtgaaatgccacgggtagtaattctgttgccgtaacgattaagaaacagatagccggaggaacggtttatttcctccagccattcaagagtttctttctttaatttttttggtatatataatcgtcgaagtttaccaccttttgtgtataggtcaaaatatccaatttcaatatgctcaatcttaatttgaatcaactcgcttactcttgcccccgtagctgctaaataccaaactacaaaataccattccatatttccatcctttttgagttgctttttcagaaacttataatcagcattactgataacattttctaaaaaattcttttgttgcactttcacagcttttagctgcaattgctgttcctctaaatattccaaatacttgtttatcgcttgtatccgtaaattcaccgttttgggtttaaaaaattccattaagtaacccttataggcaagcagattctctttactaacagcttcaaaattttcagtaaaataattaactgtccatagatacgaagtaattgtattctccgataaattttcctttctcaagtattcttcaaatgttagttttgtcttcataaaaagacacctccgataaaatattttgcgaaaaattcgctctaatattatatcgaagatgtttacaatcctcttattatgagaagattggtgacaaggtgttctgcatcgacgaagaaataccttatggcattccagatacgtggttgtggatgcgattagaaaattgctgcatcaaggaaattcgtcgtgggaaatctccaaagtatacagagaatagcgacattcttgtatttgcccaaaaatgtaatactaaatataatggcattgatatcagcttagctcagtatcttgacgaaactacctcaaaacgttatccagctgatgaatatatgcaagatggtgatgtggtaatcaactcaaccggaacgggaacacttgggcgtgtgggaatttatagagatttcaataatactacaggactttcaattgttcctgattcccatgtaacggtaattcgtggctttagctgtgtctattcacattatctatatttgttcatgaaagcatatcaaagtgaacttgagaaaaagggtgaaggttcaaccaaccaaaaagaattaaaaccacttacattaaagaaaatgttaattgcaattcctccattatcagagcaaaaacgcattgataaatcgatagaaactgcgtttcgtcgtcttgctgtaatcgaagagagtatcagttgaggctctcttcaacacaacctaagctttcaaataattcggatattttatttactattcgctgctgttctgctttggatggtaatggaacaaaaagttttttaagagaagtcccattgcagtttggctgtccgacacctactgctttactagtaacttgtttccaatagcagttactattgaaaaactgatatacataatttggtgatatacctctcattaaccttattctaataaggtatgatgcatatacagaagcatatggtaaatcagtaataaaaaaggatttacccacagtagctcctgtacgagcaaatatgatatcatttttatggagtaagtatttttcaggctcatcaatacttgtgaaaggtacactatcccagtcgacatgcccatcttgaatatcagtaattctcaatagtcgataatcaccgaaagtttcagcagaattactcaagccgtattgaatagcatctgagatacacccaagtcttgtccattcccatccttcgggaagttcaaaaggaagttgttcattgatacaatttgcttttccgttaaacagcttctcataataagagttatcgtcacctttgaagatgacggattccttcttgtcacgcttgatttttccctgcttgataagttcttccttttcggcacgtatacgctcaagaagaacggaagctggctcgtcgtctggattttgcggaacaagctcaccacggatggcaaggtcgaggattttgcgttttgtatttgcaattaccttaataatgttgtttttgtcactttcaatattagtaactaaacaaatcagttctctgaccttaatagaaattcgttgttgctcaattttaggggctataggaatcaatcgtgaggtaagcatattaagcgtaattctagttatacctacgcccttcatatctccacgcgtcgtggcataaaagtaaggtgactgcattgcatagcacatataccaattgtcgataccttgagcaggtttaagtaaagcaacgcttgataacatgctgaattcttcgcgcagcgtatttacggtcgctataccagatgttgcaccatctttaatatagaggatatcaccaaattccggattgcatcgagcaaatatttctttatgcacatcggaagcaacataggtgatatcatctaacagaacaccatctgatttgacattcttggctgtaatgtatttgtactcaccagtcggataattctcaggcgaatggtgggtaccatctgttaccttgatacagatagaagccagtctcgtccagcaccacccttctggcagttcaaacggtatctcatcctcaatacattttacagttccatcttggaacttctcataatgcaaattatcctcaccaacataaataacggtatcattctttatatccttttttttgagttttccatccttaaccatctgttgtttttctgtccggatgcactccaacagagcagaagccggttcgtcattcgggtcttgcggtacaagtttgccacgaatagcaaggtcgagaatttttttccttaatgcatctgtattcatatctttgtcttctccaatttacgcaaatagtttttaacatgcctgcatattgacttttgttttacatatgctatactgtgtataagctaactcgtgatggatacggctgggttcccgaatgggagtaggtttcgaccaagaattcctttgccccaggggtcagcttatttttttgcatttttcaacttttctacaatgtgagttggatctttttctatttctcccactattaaatcaattgcctgaattgagtatgtatacgatggttgtgcatattgcctgtgaacatagcaatatttttcatcacttttcaaatcatacactttattaaacaaattaaaaatatactgattcattgtaaaatcaattccagccaaataaagtctccgggagatttcctttatagcagttttcatcgtatacttatgagtattatttggatcttttagctcttttataatttttacaccagcatccgcatttttatctatgtacacaaaagatgttgccttgttcttatcctttgtcaaataatgcaagtgttcaattttaattgcaaaagcctgattattctctgcaatgattggttccaactgccgatcgattgtcataattttatttgctatttcttctggatacttcgcgcgtattatactttcatccagtgctttcatacttaccaccaatgtaagaaagttctgtggaataacttttgtcatatcaacatcatgtaattcctgcattttttccacatagttcaatacgcaagcctgaaaaagtggtatataaatcatctcatactcttctgtaataaaatgtgtgctagtattcctcagttcaataattttagcaagatttcttctcaaaggcgccttttcatttgtaaaaactttttgtaaacaattctctaatgtaattgttctttccggattatccctataataaatactgtcatttccattcgtttttaacaaatatgcttttaacatcagctcccatgcattacaaataaaaaagctgaatccttctacacgatacttaattgtcggcttgttgtaaatttctatcgccataacaaatgcttcttttgatttttccagcaatttgtccggtaacgtttgctccatttcagccctccacatctccaatcagcttttcaagttctgcaacggcactggcaatattcgcagatttttcttttatctcttctaacagttcccctagcgtccgatcatccgcgtcatcattgctcttcatccatgtaatatcaagactggtcttatcccttgccataatatcctcaatgccaaaacgacgccatctgccattcgggttttcctcactgtatgtctcctctcgcttgctcaaatcaccatccgcatagcaagcaataaattcgttaaagtgctccggctttaaaggattcgtcttaccaaaagacggcatatccgatcgcagatcatatatccatacttcttttgtgtttcccttgtccgttttacctcttgtaaaaaacaagacattggttttcacgccctgcgcataaaaaataccgataggcaggcgcaaaattgtatgaagattacatttttccagcaagtccttacgaatgcgttccccatctccatccgcgaacaatacgttatctggaagaactactgccgcacgcgcattgccatccgttttcaaactgcgataaatatgttgaagaaaatttaactgtttattgctggtagaaaatgtaaaatcgtcacgcgtggcacgttcaccgcccttcttagttccaaacggcggatttgtaagcaccagatcatatccgttcatggatttaccgatattagacaatgtgtcaccaagaacaatctcaccgtcaatatcatgcagcatggcattcatcaatgccagacgatgggtatcatgcaccagttcacaaccggtaaaagcttcctcgcgctcaaattttgcagtatccgcatcaagatcaaaaaatttatccgtatgatcgtatacatactgatgagcagcaatcataaagccaaatgttccacaggcaggatcgttacaacgttcacccggctgtggcttcatcaactttgtcataacatcaattagaacacgtggtgtgaaatactgtcccgcaccggattttttctcatttgcattcttttccaacaatccctcataaagattgcccagttcctcctcccgagcagaataccagtctaatccatcaatcgttgtgataattttttcaagattctttggttcatcaatattggttgctgcaccttgatagatttcgctaatacgaccagtagttttatcccccagttccaccaataattctttataaaatcgttttaattcaatgccactttttgcttttagttcatcccagcggtactgtgccggaatctgctcttctgcatgggtctccttcgccattttcagaaaaagaatataggtcagctccgtcacatactgatgataagtgataccatcatcacgcaatacattacaaagattccagagctttgaaacgatttcctgtgttgtcatgcagttttccctccatcatcgtacagatactcattaagctctaatacgatactttccaattgattctcaaatactttatttattttattaaatccaccaaaacttctgaatctgctgtcttcatcaaaaacctgtatattcagcacagattcctccagcagatatttttccattctggaaatccagctaagttcctgttttgaaaatgaatgggctttcttaagcttctcaactgctttatgaatccgagcttcatggctagtcaatatcgagccgattgcataacggcgaatcaagctgataatatcagctgtaatctcctcacttgtaagttcggaaactgctgtattaagctgctgtgttgtaaaaccttcccggtcaagcgtcaaccgcaactctttcagactctttcgcgtcaaatctttcggtctggtgcaaataatattaagtgcagcaatttcattgcggttcgtctgcacatattttgaaaatgcatccagataatcctgtggcttgtctgactttccataacctctactatgctccgtcaccttatcttcctccttagaaaccacgaccgattttgatccattcacccaaggttcctgaagcatattaaataaatcccgatatatcaacagccgtttcttcgcatccattggagactgatgctctatttcaaaaatgaactgtgccggatcttttccatctgtcatgctcttgaaatgctccaatgttctttctgacattccgtgccattttctctggagtttaccaattatcaggcagacctgctgctttatctgttcctcatcctttatcatttccagaccatccaatagctgcgtaaaggttgtcgcaggattcgttacaactggcttcatggtattgaccttctccagagaatcatataccccaactggatcataaatttcaaaatgtgttttatgaatcttcgggcatagtcgagtagctcgtcctaacatctgttcaaatagaatacgggattttacgcgccgcataaaaacaatcgttgtaatctccggtacatcaatccctgttgtcagcaggtctaccgtgactgcaatacttggatatcgctcatttttgaagcgtttaatcgcctcctgcacttttttcgggtttccccctcctacacttccagtaatcttttttatggcatcattgtcaacgccatacttggaataaatctctcttaaaatggcaacaatagtatctgcatgttgatcatccaccgcataaatcaacgttttgccttgttcttccgggttttccgggtcaatatcctttgcaatttctgtcagaaccgcccggttaaaaccttccactatcacctgatgattaaactgttccacctcgaaatcaagttcatcatccaacaattcgctgttcgtaatttctcctgtaactggatcatacaacgtcacattatcacctatcttatagtgaatacccttttggctaagctctgtctctaaatgatgtggtgcatcatgatccaccagatagccctcaataaccgcctcccgatagctatatttgaacactggctgtccgaaaatttctgttgtctgaagggcaggcgtagccgtcaaggcaatcttcacagcattgaaatattcaataacactgcggtatttactctgataatccctctgatcacggtataaaatctccgtgtcgctcatctctttatccaaaatatatccgcgatgtgcctcatcgattatgatcagatcataatcagtaacagcaggcatagtctcaccatcactatacaaaatgcgttttaccatgctctgaaccgtggcaacatgaatacgtgtttctttgtcaatcgttttctcgtccagccctttaatattatagattttatcaagagtcatcaaatcttccagtctgacttccttaaacacatccgtcgcttgttctccgagtgaagtccggtctacaaggaacaaaatccgcttgaaacggtttgttttcaaaaaacgatatatcattccaagaaccgttctggttttaccggttccggtagccattgcaagtaaaaccttttgctttccgtccacgatagcctgctcagcagctttaatagcattgatctgatattcgcgtagattaagaccatctttgcccgtaaggaaatcatatggcattgctttcaatgcaaaattaccggtttcagtatttttttcaagtaactcttccataccattagggctgatccagccatgcaatgcctgtggtgtattggagggaagccgcagatcaagaaaccaaatgcctgactttgttttgtactgttccagataaggacgcccattcgttgcaaaagtaaagggaactttatattctccccatgtaccaatcaaatatggtgcgtcgtctatgcgaatattacgcggataatcctttccctgataatctatcacagatggaatgtctttgtgctctgctttggcttcgataatcgcaatcattttcgtccccacaaagagcgcataatcagctcttccgtatttaccaaccgtagaatccgtaggccattctgcaatagcaagattgcgtcccttttcaggtctgattcccttggaatagcacaaattttccgtatcagcttcccaccccacctgacgaagctgttcatcaatcatatagcgtgtctcagcttctgacttctgacgctggcttgccattttattgccttgctttttatgttcatctctggataccgtattgtctgatgctttctgcatagcctgcttcgccaatatatctgattctttatcctccgcagccttcacatcctttgtagcaactatctttccaattgcctgatcaggcatgacaaatatctgatgctgataattccaatcaccataagtttgcataaaccattcgcagagactatgtgtcatttgcagaagtatcttacagtcagaaacagaatcatagttttcatgcaccgccttatttcttgcttttctcagcacatggagaatatccgttaaatctctagtcagaagtccctccctctgtaatgtatcaatacgagccactgccgtattatcatatggaaatgctatcttgtcatatgtaaatatcagatttacaatcgtctcgcccatcattcccaatttcatcaaacacgaattggaatctgtaaacagatactgttctgcaagttttccaaaatttgccaaaactggaaattcctgactcaagaactcaaaatttgacctcatgctttccatcttcctttccattcatagatgtcttcatcagttgggtagaacgttctcataatattatactatgagaagcaagaaacttcaattgacaatcgattttctattttccatgcacaatgccctaaaatgtttcaaatacaagattgcttttttgccgaatcaatgctacaattaaatgcagtttgattgtaggaggattttaccatgagtaccgtaaccattgtattgctggttattcttgccgtcctcattgtcggcttgatcgtattatattttctcggcaaaaaggcacagaaaaagagagacgagcaggaggcacagcttgcagccaacgcccagaccgtctccatgctgatcatcgataaaaagcgattgcgtctgaaagattcgggacttccgcaggttgtcatcgaccagacaccgaagatgatgcgccgttccaagcttccgatcgtaaaggcaaaggttggtccgaaggtgatgtcactgatcgcagacgaggcagtctatgatctgattccgctgaagaaggaagtcaaagcgaccgtgagcggcatctacatcacgaaggtaaccggcgtcagaggacctcttgagaagccgcagggcaagaagagtttccgcgcgagaatgcaggaaaaagccaagaaggccaatgcagagctggaaaaagaaaaggcagaacttgccaaagagaaagccgcaaagaagaaaaaataagcagctatttaaaatgcagggaatttcagattttgaaatcccctgcattttttgattgaatgttcatggtaatcttgcagtccgccatgtgctcataattcacttccagcgcataatccactttcacggacagattgtgttccgtctcctccacctgcactttcgtggcgtcgattccgatcagcagattcccgtacggcgtataataataagtgacatttttcttgtctttttcaaacatcatatgtacattcgtctcaccgcgcttcgtgatgtcaagcacctcatccccgagcttgatgatatttttggtggttcccgctgtatcctccgccacctcgtcatacagaatataatgcttgccgttcttcttataataagaaccggaggtaatcacctctaccggttcactgttttctccctcagcaaactgaagaccgctgatggagatcaatacatcttttgtcatcgttacactccctttatctcaactcatattaccgacttttggcggaataatcaagcctattctttcaggccgtccaaaaatgtcagatagcggcagcgcacttcataattttcctcctcaagcaccgcccggtattcctccttagacagcacttttttcagttcctccccggcgctctcatccacaacttcatacatgcttccctcgaaacacatattcgggtacatgacgcaccaccagttatgacctgcaccctctccgatcacaacccgcagcgcctcatattttcctgccgggaaggtaaatttcccatatgttttggacggaaattccgtctcctctatcgcggcatgcacctcgtacccatatccggcttcccgcaccaccgcctgcgccgtctccgcaatctcgggcaggtgcgcctccaccacctgctcgcacgcctctctgtccgggacatccgaaagcagctctgccatccggcttcccacggcatcacgcaccgcaagctttaaattctgatcctccgcggtgtcgctgttggcaagcacatggaaccgcagcaccttcccagcaatctgctcctgtattctctgatttttcacatactgcattccaagaagcgcaagcagcatcacattcattcccaacaacaagtaccagatccatttacgtctttgcataacggcattttcttcctttcctctgctgcaaaagacgattcccgttttgataccgttttattcactttatgataaatgaatccagtttatttttacctgatagacaatcgcaatctcttcctcgtagttctccccgcgcttctgatactcctcataccagccccgcgccgcgcctccgagcttgcggtaactgcctgtaagatccacctgccgcttccgctgcacatttgccgccatccggttcatatagtcttccgccaaaagtgcaagctcctttttgttctcctttccgccggttccctgcacgcttccgctgcagtgaatcgtcaccaggacttcccgcacgccatccttttccgagaacgtgatctcatttgtggcatccgacagcagtaacattccctcctccaacggtaaaccgtactccctcatgcggttttgtgtaaaaaaagcaagtctcgccgcctccgcgtcaaccatgcctgccggcatcccacgcttccacacataatactgctccaccgccggtttttcgtccttcacggtaacatacggcaaaaacagtgtctcctgccggttgtccatctcctggtacagcgatccgatcgtggggtacgcctgctttttgatctgggacacattctcaaactgttcctccagataatccccgaccgcttctcccagcgtctcactctgcgccagcagtgcttcggcatcctccgtgaccaccacataggcgttgcgcggcacctcgctcttctccttcaaaaacgcgagccactcctgcacggctgcctcatcctccacaaattcctgttccaggatcagaaccttcagatggctgtaatccaccatccggtttccctcctgctccgcttcataccacgtcagcccggcgtccttcatgtcccgcaccgcgatatcaatcggaaaatcgcgatcctccagctctgcgggggcgcagcctgtcatcacaagcaaggctgccgcacagatcaccgcaagcgcaagcatcctcctgccccactttttctgtgcggtaaagacgggggccagcaccagaaacggcgttccgacataccacaggaaccgctcgtaccagtcgaataccgctctgctccggtaaaaacagatcgctgccacagaagctgccaccgccacagatccatagaaaatccacatgtaatttttcccttttggcattttgcgaataggtttccataatttctctgctatgctgcttccgtaaaagacgcagctgtttaaaagtgcatacagcgtaaagaaccacacgccgaacataaacgcgtctgttcttttcaaaaagccgccggatatttttaccgtgctcatcagcgtgactgccggataatccatccccgcaagcgccggtaccccgaaaattccctccagaaccagatagagcaccgcatggagacatcccacaaataggattgccctctttcccgccgcaaacaatgtttcctgccgcttaacatacgttcccgaaaaaagaaggaaaaatgcaaaggaaagattcaaaaacaccccgtaagctccgcctgccacgccctttaagctgctcattccaagcggcgcccagtaatcggtgcacacttcatccgccgcagcaaagagcatgagaaacagcgggatcaaaagaaaccagaacagcatctcatagactctcgcccgtccctcgattccccccgcaagtccatacagcaccagcagcatgataaccgaaaggaccagataaaacgattctccgcgcagaagatcccggagaataatgtctgcaaacagatacgccacataccctgcaagcagcaccagataaatcagataaccggtctgtacgattcctcccccgattcttcccagctgccgctccatatattccggataagattcctgtgcgggcggcgcaagcctgcgcaatatccatagatacgcgagcgctgccgccatcccgattccgattgacagaatgccgtctctccccgccgccttcgcgagcatctgcggaacaagaagtgtgccgataccgagcagatcatacgtcatcaagcgatacatctggcgtcccgatatcctgttattttctgaaaacataatccgttccctctctgtcactgtttcatccgcagctttctgcggttatttttcttcgcgtagatcgggcgtttccagagcagccgaagtggctgccgccacaggaaatcgcgttcatcttcataatcgttcagatctgccgccacatacggcatcaggtacggcacgccaaagctttttaagtgcgacagatggatcagcacggcaagcagccctgccagaaacccgaaaaaaccaagccatgcgcagattccgataaaaaagaacttgagcagccggaatgccgttgcaaactcctcattcggtacagcaaacgaacacagcgccgtaaacgagatcacaatcacgacaatcggactcaccagatttgcctccacggctgcctgcccgatgatcagtccccccacaattccaatcgtattccccatcgctccgggcagccgcactcccgcctcccgcagcagttcaaacgaaagctccatgataatcacctcaatcaccgccggaaacggcacgccgctcctggcgtccgcaaaggacagcaggagcgtggtcggcagaatctgtgtgtggaaattggtgaccgccagatagagtcccggcagcgtcatggcaaaaaaggacgccagatagcgcaaaagccgctcaaagctcgcgatctcccagcggttatagtaatcgtcgctcgtcttgataaaggaattgtaatcggtcggcagaatgagcgcgatcggcgaattgtccgacagcacaaccactctgccgtcaaggatggacattgccgcccggtccggccgttccgtcgtctgaaactgtggaaacggggaataccatttttcctccgacagctgttcaatgactccgctgtcgagtaccccgtcaatctcaaatccctccagccgctcctcaatctttgccaccagctccgggtaggcgatcccttccatatagaccagatagacgttggtgttggagcgcacgcccatttttttctcttttaccttgacctgtggcgaccggattctcttgcggatgagtgctgcgttctgttttaccgaatccccgaatccctcgttagaaccacgcaccactttttccgagtccgcctcgttgacgcccatattcggataaccgtcatccggaatcttgaccgctttcgcaaaaccgtcgacgaaaaaaacggcttctccggtcaaaagaccgtcccccgcctcctcgatcgtcgtaaaataggtcgcatcggaggttccgagggcattctgttccaacacccgcagaatctcctcccgctccagaccccttaagtattttaaaacttctaacagcgccgaatttcccatatctaccgagacttcaatgaacgtgaggtagcacgccacgtcccggttttttccaagattcatccgcttcttcttgatgtcgtcacaggtgtgaaacagttcctccatatgtgcgatgttctcgtcgagtctctcgctgatctttgtcttctctgccacagattttcttcctttcctaaaacaaaaacggggcaggcatccgcctgtccctgttagtttgttccatttcgggaaatttattcacttttcctgctcccggatcatttccttcaccgctgtcgcctggttcatcacatgcttgtgcatcgccgccgtcagcatggtcttatcctttgcggtaagcccctccacgatctggctgtgctcccggatcagaatcgggaaattcttttcatcctttaaatattccacgcggtagcggtacatctgctcccgcagattgttgagcatgttctccagcttgacgttgcgcgtcgcatgatagatgatgtcatgaaaccgcacatccgcctccgcaatccgcttgacgtcccccgtctttgtggattcctcgaactcatgcatggtatgtctgagctcagcaagctcctcctcggaaatctgttcgcaggcgatcgatgccgccagttcgtcgagtgcatcccggatctgcaagacatcctccatgtctttttccgtcatccgcgcaacttccgcaccttttcttggaatcgtgaccgccagtccctcctgctcgagcatacggatcgcctcacggatcggcgtgcggctcaccccaagctttgctgccagctgcagctccataagacgctcccccggcttaagctctccttttaagatcgcttcccgcagtgtgttaaacaccacatcccgaagcggaaggtatgcattcatgttcaatgtcagatcctctgtcataagtacctccttctgctttgttatctgttctctgcccgtcttctcctcaccgcgcattattgtatatgcttgtcaggtaaacctgttttgcaagatttgattcacgcattgcctcgtatgcagccacggctgtatccccgttggcaaacaggccaaagaccgttggaccgcttccgctcatcattgcatggactgcaccgtgctccatcatatgctccttgatctctgcaatgaccggataattgggaatcgtaactgtctccagcacatttcccatatgacctgcgatctgctccagattcttcgcccggatcgcaccgatcagcccatcaatatccggatgcacggtatccgcatccagcttcagattctcatagacaaattttgtggaaaccccgatctgcggcttggcaatcagcaccggacatttgaccatcggaggaagcgccgataatttttcaccgatcccctccgcgagcgccgttccgcgcataatgcagtagggaacatccgcgccgagcttcacaccgcgcgtcatcagatcctccttagaaagccccagatcaaaaatgcggttcattccatataatacggccgcagcgtccgtgcttccgcctgccatgccggctgccaccggaatgtgcttgtgcagctttacatcaataccgtccccaatgtcaaattcctctttgagcagcgccgccgccttgtatacgagattgttttcatttgtcggcagaaacgcaaggttggtcgacatggtaatcctgcccgattgattgcgcataatctccagccggtcaaacaggtggatcgtctgcatgatcatccgcacctcatggtagccgtcctctctcttccgcaccacatcaagcccgagatttacttttgccagtgcttttaccgaaatctctttcataatgcccccatgtttttttaatgtattttgtatacagactgaatcttaccatgacttgtaaaaaaggtcaattatctctccttctttttacacaataaaatttctcaaaaatctaaaccgggcaatgcttcctgccgatatagaagatgagacaaagagcaggcatggatgcctcctgtcaattattttaaaccgatccaagggaatggaggaatgaattatggcaattaacagtatcacaaactcagtagcagcacagcaggcttctacttataccgcaacaaagacggactatacagagaaaaaaagcgagagcagcacaaagacagataccggtgtcgtatatgagaagagttctgatcagacatccggcacagttacaaagaaaaccgattacgcacttgtcaacaagttaaaggcagatgccgaagagcgtacctcccagcttcgcagtcttgtagaaaagatgatgaccaagcagggtgttgccatcggtaccgctgattctatgtggagcttccttgcaaaaggtgattttaccgtagatgaagccaccagggcacaggcacaggcagatattgccgatgacggttactggggcgtcgaccagacttcagaccgtattcttgattttgcaaaagcactttccggcaacgatccggaaaaagccgatcttcttcttgacgctttcaagaagggattcaaggaagcaaccaagtcctggggacaggatcttccggacatctcacagcgcacctacgatgccgttgtggagaagttcaacaagtggaagaacggaaccgaggagacggaggctgcccagacgcaggcataatccgaatttaaaacgggatacgttttcttataagtaatagagatgtatgacgttccaaatgcaaccggggcggcaattctaatcgcaaaatccggtatttctaaccatgccgcgtcgaacatccttgaacatctgtgtttttccaagtttggaacattccacgtggtgtgtccacaaactgcagacaattttaggacttttgtgtgtgccccttgttggcacccagacaacagatggcgaaatgccatctttatgtcaaacaaaacataaccgcgcgaaccgaaactcgttatcatctgctattgaaaacagggcagatgataactcagacatcggcttcgcgcggttatgttttgcattcacttgttcaattccggtacgtcatctgcggctgtctggcagcctccatctgtttctgacgtttgtgtctgccgtgtacggtacagaatccgacgaccgccgccacaacgtccagcacaaagataaagtgcagtatcgacagggcaactgctgcccccacggacagctttttttcactgcacgcccgaatgcagccgcacagtccatagatggacggcggtatcaaaaacaggacatccgcaatccacatcacgccgataatcgcgactccgccgaacataaacgtcgcaaatcccgccagcaccataaacgccgccagcagataatacgggatatagcacagcttcatcagcatatcccacagaagcagcgcctgcgcgctggttcctgccgccgtctgatagatgacccagacgacatttaagagcacgaccaccgtgtagacaatgcagattgtcgtctgcgtcatctgcaatctggaatcgcccgccatgatataggctccggacgaatctctgtccggtcttcccatgcccacagacagaaccacaaaaagcagatacggtaaaatcagcagaagaatcggtgtcactattccaattatttttttcatatcattccccgctctgtgctcttacgcctgctgttcccccagaatcttctcaatgcttgccagctttacgcagactacaaaaatctgtgttgccgttgtaagatcctccagcgacggatacgacggagatatacggatgacggaatctttcgggtccttgccgtacgggaacggtgctcctgccggtgtcatcacaactcctgcctttttcgccttatctaccacgctcttcgcgcatccctccagcgtctcataggtgataaaatatccccccttcgggctgtaccagcttccgacgccgagatcctttaactccttgtcgaatgtgtccagaatcatctcaaacttcggtctgagggaagctgcatgctttctcatgtgctccgtgataccgtgcacatctttaaagaagcgcacatggcgaagctgattcaccttatcatgaccgatcgtctggatcttcagctgcttcttaatatcctccagattgttcgcggaagttgcaatcgcagccagaccggaacccgggaagctgatcttgctggtcgagcagaacttgtataccatatccggattgcccgcgcgcttgcactctgccagaatctcgatcagatgatcctgatccatatcatataaatgatgtacacagtaagcgttatcccagtaaatacggaagtcttttgccgccggttttaatctggcaaaacggcgtaccgtctcatccgagtaggtaattccctgcggattggagtatttcggcacacaccagattcctttgatcgcctcatccttgctgacaagctcctccaccatatccatatccggtcctgtcggaagcattggaacattgatcatctcaatgccaaaatattccgtgatggcaaaatgtctgtcatagcccggaaccggacataagaacttcaccttgtcaagcttgcaccacggcgtatttcccatcacaccgtgtgtcatggagcgtgaaatcgtatcgtacatgatatttaagctggaattgccgtagataatgatattttccggattgcactcgatcatatcgccaatcagcactttcgcctcctggattccgtccagtacaccgtagttgcggcagtccgttccatcctcgcatgcgagatcggaataggacgagagaacatccatcatgcccatagacagatccagctgttcctgggatggctttcctctggacatgtcaagcttcaatccccgctgctggaacttcttgtattctgcttccagatgttccttctcttttaacagttcctctttgctcatctcctgatatgactgcattgttccttcctcctgctatctgtatatacattttatatgaaccttatttctaaggctgcatcccttttattttttcaaaatattcccggattgttttctcatagccgttctccgacggatgataaaacatgcggtctgtcagaccgtccggcagatactgctgcttcacataatgattcggataatcatgcgcgtatttgtaaccgacgccgtgtcccagcttctgtgatgacttataatgtgcatcctgcaggtgcaccggtatcggtgccgtcatggtatcccgcaccgccgccatggcatcgctgatggcacagaccgcagaattgctcttcggtgcgctcgccacataggtcaccgcctgcgctaaaatgatctgcgcctccggcataccgatgcgctccaccgcctgtgccgccgatgtggcgaccacaagcgccatcggatctgcattgctgacgtcctccgccgcacagatcatgatacgccttgctataaacttgatgtcctctcccgcatacagcatccgcgcaagatagtagactgccgcatccggatcggaaccccgcatacttttgataaaagcggagatcgtgtcgtaatggttatctccggacttgtcgtatttgaccacgcgcttctggatacattcactggcaaccgcaagcgtgatgtgaatcttcccgtctgcactccgctccgtcgtcagcacgccgagttcgatcgccgtgagtgccgcgcgggcatccccgttcgcaacatccgccagaaattccagcgcatcgtcatcaatcacggcatcgtaagcgcccagtcccttttcccggtcggttaccgcacggagaatcaatgtccggatatcatccttcgacagactcttcagctcaaaaatgatggatctggacaacaaagctccgttgacctcaaaatacggattctctgtcgttgcaccgatcagaatgatcgtgccgtcctccacgaacggaagcagataatcctgctgccccttattgaagcgatgaatctcatcgataaagaggatcgtcttcctgccgtacattccctggttgttcttcgcctgcgcgatcacttcctccatgtccttcttgccggcagaagtcgcattgatctgtaaaaactctgcgctcgtcgtatgcgcgatgacttttgcaagcgtcgtcttaccggttcccggcggaccgtacagtatgatggaactcagcttatccgctttgattgcacggtacagcagcttatcttttcctataatatgctgctgccccaccatctcatccagcgtcgtggggcgaagtctggatgcaagcggcgcctccgtttccttttgttgttctctcatatattcaaataagtccatgtcaaaacctgctttctgatgtataaaaattcccggtcactgccttccggcgcatgtccgtgcgcagcgtacacttgaccgttttgaattttcttcatgtaaaacttgcatttttttaatgattcgtggttttaatcatgttttttccaaaaaatatgacagattacaacatcaaaattgcatcacttctattacaatacacgatatatgccctttttacaagtaaaaatatgcattttctctgttgtgcacgattttccacggaaatcattttctatactgtaacaaattgatcggagggttgcaagtcccaccgtgtctcactccagcagaatatcctccaccgtcacaaatgtatacccctgtgccttcaattcatcgatgatcttaaatgcggccagcacggacgactccgacgcatcatgaagcagaataatatcattctcctcgacatcccccaacacgcgctgcgcaatgaccgatgagttgctcgtcgcccagtctttcggatcgacatcccagagcacctcaatcattgtcgtctcataatccagattcggtttccagcacccgaacggcggccggatatactccgggaacacgccgataatttcatgaatcgctgcattcgtcttatccacctgctcgatcgccgccgcatcggtcagattgctcagattgacatgttcataggcgtgtgtcccgatcagatgtccgccctcatggattttcttcacaatctccggatactgctccacttcttttcccaacagaaaaaacgtggcgctcacaccacgttccttcaatcccgaaagaagctcctccgtatagtccggattaggtccgtcatcaaatgtaattgccactttttttgccaattcatccatcgccatcgcctccctggcctttgttggcacacgcagggatacctgcatgtaaaaagccgcacaacaccccgccgccatgcatgccattcctgctgccacccagatcagtctgcttcttttctttttattataaaacccgcttcctgctatgcgcacctctactctgacctttatgctctgtcacttagagtatattccgaaaagcgcgatgctatcacttcattgccgaaaacgctcacataaactgattgccgcccggctcctgaacgtcatagtaatctctaaaataatcgtagggatcattatagtaatcgtagccgccactgccatcaccgtcataccatccgtcgtttccgtcaccgtcataccatccgtcatttccgccaccgtcataccatccgtcgtttcctccgccatcataactgccatttccatcgccgtcgtaccatgcatcacttccatcgctgtcatagctgtcatcatactgatcgtataggagatcttcgtatgtaatccccgcatttgtcattccgaaccacatggcaagatataaaacgacagaaagcaccattgagatcgccgctgtgatgattccaccgattgcaagaccttgctccttatttttcgtgatctgaatgattccgaaaatgaccgccagaattgccgtcacccagttgatgcaggtacaaaacagcagcacagacacgattccaagtataagcgatgcaatgccatatcctctgccgtcccctttctgtttctgctgcggcattcccggattcattccattcgcattcggcgtccctgcatatgctcctccagggttcattccgttcggattctgcatccctgcatatgctccttccggcgccacggcagcccgctcaaacgccagacgcggcgcgccgtttgccagatgaatcaccccgcagtacacaaatccgtttttttgcagaagatgctgcataatgcggttgtcctgatgcgtgtcagccctaagactgctgcagccatgcatttttgcctgcttggcacaccaggaaaagcagattcccgccacgccgcggagccgtccggcggatgccagccggtgcacggttccataacttccattcgtgtgccacattccctgcccaatctgccggtaggtcggatcctccccttctatataggaaaacacagcctcaatcacactgtccctgtcaactacataactgactccgcgtgcgatatcctcctcaatcaacgtcctggacggatatcccgccacccactggttggggttgccggacgcgtgcatatactgcaccgccctcgcatatatctgcatgatctgctccagatcctgtatagctgctctgcgaatcatcatctgactgttcctctcttttctaacctctcatccaccggatgttctgcaatatacttttccaatatctcagcggcatccccgacaagttccttgcaggggcgctttttataatactctgcagtccgttccttcggtgtcggttcttcccgctttaccgataaaccaagcagttcccgacagacaatcgaaccgtttttttcctcaaacgccttcgccagttcctggattctcgcatagtgtgccgctttttcctcccgggcgcccgggtcgtcatagccgtataatatgcccgccgtaagaaacatcccgctgaccgctccgcacacctcgcgcagtcttcccattccgccgccgaaagacgagctgagtgccgccgccgtgtgcgtatccattccatgtaaatccgaaaacgccagaaataccgactgcgcacaattatatccttcttcaaacagtgccatcgcacgctctcttctcatcctattccctgcctcacatttctttcagaataccttaactatataacttttcctacattttctcaacgattatgttataatagttccaatctcaaaacaggaaaggagcggaactttggttccagacacacatgagtacattgaaccttaccctgctcacagatctctatgagctgaccatgatgcagggatattttaaaaatcataatcaggatgttgtcgtctttgacgccttttaccgcagcaatccctgcgacggcggttattccgtctgcgcaggtttagcgcaggtcatcgactacatcgagaatctgcatttcgatacggacgacatcaactatcttcgcagtctgaaaatatttgacgaagattttctggaatatctgagcaatttcaaattttccggcgacatctacgccgtcccggaaggtagcctgatcttcccgcgagagcctctggtaaaagttgtcgctccgatcatggaagcacagttaatcgagactgccatcttaaatatcgtcaaccaccagtgtctgatcgcgaccaaggccgcccgcgtctgttacgcggccaagggcgataatgtcatggagtttggtttacggcgcgcacaaggtccggattccggtacctacggtgccagagctgccgtaatcggcggctgcaacggcacttccaatgttctcgccggtcagatgttccatgtgccggtactcggcacgcacgcccacagctggatcatgagttttccggatgagtacactgcgttccgcaaatacgccgagctctacccgtccgcatgtattctgctcgtggatacctacgacacgttaaaatccggtattccgaatgccatccgtgtcttcaccgagatgcgcaatgccggtatcccgctgacttattacggaatccgcatggacagcggcgacctcgcctacctctccaagcaggtgcgcaaaatgttggacgaagccggtttttcggacgccgtgatctccgcttccaacgaccttgacgaatacctgatcgaaagcttaaaattgcagggcgcaaccatcagctcctggggtgtcggcacaaatctgattacctcgaaggacaaccctgccttcggcggtgtttacaagcttgccgccatccgcactgcagacggaagtttccagccgaagatcaagttatctgagaatgtagaaaaagtcacaaatcccggcaacaagacattttaccgcgtctatgacaaaaagaccggcaagatcaaggccgatctcatctgcctgtacgatgagacattcgacgagagcgaagacttaaagctgtttgatccgaacgctccctggaaaaagacgagacttccgggcggaagctacacgttgcgtgagatgctgattccagtaataaagaacggaaaaactgtctacacttccccgagcgtcatggagatccgtgaaatctgtaaccacgaaaaagacaccatctgggatgaaaccaagcgtttcgtcaacccgcaggagatctatgtcgacctctcccagaagctctacgatatgaaaacggctctcttaaacgaaatgagtatggattcttaatagcaggcaatccctgggctgtaccagagagaactttttcggataatgcatgtgtataaagttccagctgtaaccgtcagcagcattctgaccgcaaaatccggtatttctaaccacaccgcgtccggcatctttgatgatccgtgtctttccaagctttgaacactccgcaggatgtgtccgcaagccggcagacaattttaggacttttgtgtggcgcttattgccactgatgaacaaaacataaccgcgcgaagccgatgtttgaattgacatctgccttattttcaatagcagatgccaacgagtttcggttcgcgcggttttatattgtctgtgaagaagtggcattagcgccactagaaagtccgctcattgtctgcgggttgtcggacacaccctgtggattgtcaaagcgtggcaaagacacagaattggataccggacgcggcatggaagaaacactcgaattttgcttcaaagaatgctgccgccggttacattctggaacttcataccatgcattgtccgaactaatctctcacaaatacagtgcagggattcccgctagttgaatccgaccactttctgtgaaagcttatacgccgcaacggagatctttcttccgccttttcccggcagattcatcgtattgccgaggattccagcacgcagatggtggaacaggcgaatatccttttccttaatatatttccagagttctctcttcttctccagattctcctccgtgccggagcggatcagcatgatcgtcgagatgaccgtgatgatctccagatagttgaacatataatgtctgagcttgcggtttggaattttccacaggtcaaacgcatcgaccataatcttattcacacggatctgctggtcaatgcgggaaatcatcactctctcattgacggactgatcgtctcttccgataaaataccggtaaaaatccacatccatataatagagcgtccgcacactcggaagcggcttgtatacatagatgttatccacatagaaggtgtgcttcggcagttccagtccacattccaccagaagcttcgtgcggtagatcacggaatgcatgagaatatactgtcccttatggaaatgtcctgcttccttccatgtaaatatccggtctttcgggagattggagcagcgcatgacttttttatgcttcactccctctttctcatatacataattagcaataaacatatccagcactctgtcaccgccggaaatctcccgtaacttatccagaatcttgcggtaggcgtccagatccacccagtcatcactgtccactaccttaaaataaagcccggtggcattgcggatacccgtattgaccgcctcgccgtggccaccgttctcctgatgaatcgcccggataatccccggatactttttctcatacgcatccgcaatctctgccgtgcggtcatgcgatccgtcatccacgatcaaaatctccacatcatccccgcccggaagcagcgactcgatacacttttccatatatgcttccgaattgtagcacggaatcgcaaatgtcaacaatttcattttctaatctctcctttatctccgcaaaagaaaacccggctttcttcccaaaaggcagattttccgtcacactcttacaatctgtctgccagttccatggcgcgcttcaccatcgcgtcgatgttgtaatagcggtactccgccagccgtccgagcagatgaaaatgctccatgccagccgtgagtgcccggtatttttcgtacagcgcctgatttttctcattcaaaatcgcatagtacggaatctctccctctgctcccgtatacgcaaacggatactccttcacgatcgtggtgccgtccgtatccttctgcccggtcaaaaacttgaattccgtgatacgggtaaaatcctcgttcacagtgtagttgaccacactgtgtccctggtaagacgccccgtcgtaatgctcaaaccggaaatccagcgagcggtacggcagtcttccatacctgcatgcaaacaattcgtccagcgcgccggtgtagatcacgtcgccgtcgaatttttcgccgtcaaaataaatctcattgtccgcaaagcgcatgcggcttaagcagtccgtgccgcactccaccgtgatccccggatgggaaagcatcttctcaaacatttccgtaaatccgttcgccggcactccctgatacttatcctgaaaatagcggttatcataggagattaacaccgggacacgccctgtgacctccggactgatctcctccggcttctgcccccactgcttcatcgtgtaatataaaaatacattctcatacacatactgtgcaatctcgcggatatccgcatcctcgttctcgcgcagcttcatgatcggcacacgcgaaccctcgccgtaggtttcgatcagcttttgctccagccggtcggctttctccttcccgtataccatatgtaacgtatttaagttaaacggcaccggaatcagctgatccccgacctttgcgaccacctcgtgcccgaacaggtaccagtctgtaaaacgcgataaatatgcaaacacttcctccagacctgtgtgaaaaatatgcggtccgtaattatgaattaaaatgccgtgggcatctttctcatcgtaacagtttcccccgatatgcggtcggcgttccatgacaaggacacgctttcctttttcctctgccagctttcgcgctgccaccgctccggcaattccggctccaatgacaatacaatcgtacatgtctcctccgttctgcggtactgcccgcattgtcttaacattgacctgtttcattatacaggattttccacagtacgccaatttattttttccttaaggttttcaaaatatccactgaaaaatgtccacttccttcatttgttcatattttatttacaaaatactaataaacttggcatacgctggtcatatttccattttatagtatagataaagttaagacagcaagttaaatttttcatagaactttttcattcctgacaagtgcttgtcaggtcaccttgcttagaaataggcaaggttcctcccagcagatagtgaatttatttcactttccatacacacaatctttttcatatgaaaagccggtgcaatgcaccggctccctcttttttacaaacttttttatctttcttgatcttaatcaaattccttttttaaataacccgcatatgctgaaaatgccgacggaatggcataacgctctctcgcatcccatgcatccacaaaaatcagtccgccttccccgtccgctttctcttccggggtgcgcccatttcctgactccggttccttttctgcggcaaagccggcttcctccaccagaatgacatatccactcatcctccactcgatatgggaaaatatgtgctttgcatccgcaagcttctcgattcgcagcggagcaaactgctgttcctttacataggaaaggacttcctccgcacttaatgcgccagacagattcggcagctcatacagcccggcgagcagccccttcttcgggcgcttgcggattgccaccttttctccatcccggatgacaagcaccgtgcgctcctcaatgcggcgcgccttcgccttgctttttaccggaaaatccatcacacgcccctgtgctctcgcaaggcacatcttactccacggacattcctcacagagaggtgcgccgttcggcacacagaccgtcgccccgagctccatcatcgcctgattgagcgcgcctggaacattttcatcgcgaagggcacgccgaagctcctcaggaaccgtaagttcccgcatcatctctcccagctgcgcttccaccgcactgcggaacgactgtttcatgatgtcggtatcatctgtcgccacacgtgtcaagatccgcagcacatttccgtctaccgcaggcaccggtatcccataggcgatcgatgcgatggcacccgctgtgtaggaaccgatccctttcaattccaaaagcttcccataatccgccggaagcactccatcatactcctccgtcacggtgactgcggctttctgcatatttctcacgcggttgtaataaccaagcccctcccagagcttcatcaattgatcctccggacaggctgcaagcgccgccacatccggcaatgcttttaaaaagcgctcataatacggctttactgcctccactctggtctgctgcagcatgatttccgagacccacacgcggtaaggctccggtctctcacgccacgggagcacccgcgcgtgatctacaaaccacgcaagcagaggctctgccaactggttcagatgataattttccagcattctcttctccgtctctactgtcaagcgtttaaatccaggtcaaactgcgccacaaacgccgcaattttttccagacatttctttatcacatccttggaatatgcataggaacaccggatgtatccctcgccgcagcttccaaaggcatctcccggtatcaccgccaccttctgctcctgcaaaagtcttctgcagaactccattgaggtaagcccggtctctttgatcgaagggaacacataaaatgctccctccggctcaaccaccttaagtcccattgcccggaatccgtccaccatcaggtggcgtctctcgtcatactcccggcgcatcacatcgatctcctcgtcccgcaccggactcgtgagtgcttctaacgccgcatactgggacgtcgttcccgctgacatcgtcgtgaactgatggatcttgttcatatggaaaatgacctccgccggccccgccgcgatacccatacgccatccggtcattgcaaacgccttggaaaaaccgtttagaaccacgcagcgctcatacatatccggcagcgccgcgatcgacacatgcttcttgccataggtgagctccgcatagatctcgtccgtaatcacaaagaggtcatgggcgagcactacctcgcggatcgcctccagatccgccttttccatgatggcacccgtcggattattcgggaaagagatgagaagcacttttgtccgctctgtgatcttctcctccagttcctccgccatcagacggaaccggttcttcgcctgcagcggaattgacaccggaattcctccgcacagttccacgcaagggatgtaggacacataggcaggctcaaccaccagaacctcgtctcccggatccaccagcgcacgcagcgccagatcaatcccctcgcttgcccccattgtgataaggatctcatccgcccggtcatagtgcagatcgaacttttccagatactccgctgctgccgcacgcagctccacggtaccgcggttgtcagtatactttgtctcggcgcgccggatggaagcgaccgccgcctccctgacatgctccggcgtctggaagtccggctccccgacgcccagagacagagccccgtccatggtattggcaatatcgaaaaaatccttaataccggaatccggcatctccacaacaacttttgacagataagatctctttgtgctcatatgtatgactccttagtaacgtactcattttaggatttattataccccctttctttccaaatgaaaatactgttttctattgacaaattttagaaaacgctgtactctaatattagtaatttgttaattttttatcaaactattcaggagggttttagaatgagtgaatttaacaatttgaaattggaaatcgctgaccagactgctgttctttccatttccagaccagcagctcttaacgcattaaacagtgagactcttgacgagttaaacacggctctgactgagatcgaagctatggacgatgtcaaggttgtcatcttaaccggcggtccggacaagaagggcaacgagttcaagtctttcgttgcaggcgctgatatctccgagatggtgaacttcaccgctccggaagcaagagcattcggcatcaaggcttctgttccatttttcaagttaatgaatatgcgtcaggttaccatcgctgctgtcaacggttttgctctcggcggcggatgtgagatcgctatggcgtgtgatatccgtatcgcatccgacaatgctgttttcggacagccggagtgcggtcttggtattatccctggattcggcggtacccagagacttgcccgtcttgttggtatgggacgtgccaaagaaatgatctttacctgtgacaatatcgatgccaacgaagcataccgcatcggccttgtaaataaggttgtcgcaaaagaagaactgatggctaccgcaaaggctatggctgcaaagatcatctccaagggaagctacgcagtctccgttgccaaggcagcaatcaacaacggctacgacatggacatcaagaatgccgttgagatggaagcaaacctctttggtgttgtcaacgacacacatgacaagaaagagggaatgggcgcattccttgagaagagagctgccaatctgacagatttctaaacatcgtacaccaggacttgacgtttggttctaaaaacgctaccatattttatagaaagacagccggctatctttagccggctgttctggtatcagcatacaatacatagaaaggtggtttttgatatgtttgacaaaatcattggtttcatcggtgccggcaacatgggcagcgccatgatcggcggcatcttaaacgcctccctggtaaccacggggcagataatcgccagtgcacactccaaggagacactcgacgccattcacagccggttttccatcgagacgacactctccaatgagacggtcgccgagcgcagcgatattctgtttctcgccgtcaagccgaacaaatttgatgaggtgattccgcagattgccccgcatgtgaagagcagctgcatcatcgtctccatcgctgcaggcaagaccattgctgccatcgaagaggcgtttggcaaagagatcaagctcgttcgcgccatgccaaacacacctgccctcgtcggcgaagcaatgagcgccctgtgtgtcaatgcacatgtcaccgaagccgagctttccgaagtgcaggcgatcttcaactcctttggaaaagcagaagtcgttccggagagcctcattgacgccgttgtgggcgtgtccggttcctcccctgcctatgtctatctgtttatcgaggcaatggcagacgctgccgttgctgacggcatgccgcgggcacaggcttacaaatttgccgcccagtccgtctacggcgcagccaaaatggtattggagaccggcagacaccccggcgaactaaaagacgccgtgtgctctccgggcggaacgacgatcgaggctgtcgccgcattggaacggggcggtctgcgtgacaccgtaatcactgcacagcgcgcctgctctaaaaaatcacacgccatgagcacagcgaaataaaaaagcaatcacaggaggcaacgcattatgtgggcatatgaaagtgtattttatcagatctatccgcttgggttctgcggcgcaccttttgaaaatgacggggttctcacccaccgcatccaaaaggtaaacgactggattcctcatattcaaaagcttggcgcaaacgccgtatatttttcaccgctctttgaatcggacacccacggctacaataccagagattacacaaagatcgacacaagacttggcaccaacgcggattttaaggaagtgtgtgacaacctccacgccgccggcatcaaagtcgtcttagacggcgtcttcaatcacgtcggccgcggtttctgggcattccaggacgttttagagaagagatgggactctccctacaaggactggtttcatatcagttttgacgggaattccaattataacgacgggctgtggtatgagggctgggaagggaattatgatctcgtaaagctgaatctgcgcaacgaggatgtcatcgcacacctcttttcctgcatcaagggctggatagatgagtttgacatcgacggactgcggctggatgtggcttactgcctcgaccatgattttatccgaaggctgcgcgcctactgtgacaccttaaagccagatttcttcctggtcggcgaggtcgtacacggcgattacaaccagatcatgaacgacgccatgctgcactccgtgacaaactatgagtgctacaagggactgtattccagttttaactccatgaacatgttcgagatcaatcactctctgctgcgccagttcggcccggacaactggactctgtacaagggaaagcacctgctctccttcgtcgacaaccatgacgtcacccgtgtggcaagcatcctctcaaacgaggcgcaccttccgttaatctatgccatgcagttcggcatgccgggcattccatgcgtgtactacggaagtgaatggggtgccaaagcgcgaaaagaggacggcgatcccgcattgcgcgcctgctttgacgcaccggaatggaccacactcacggatttcatcagccgccttgccgccgcgaaaaagtcttccgaggcgttaaactacggcgatttccgctctgtcctgctcacgaataagcagtccatctttgagcggaaaagcgccaatgagcgtgtgttagtcgccatcaacgcagattccgaaagcttcacggcgcatttcgacgcaggctgcggcacagctgttgacctgctcaccggggagacgcacgactttggaggtggcagtacgctcccgccttactccgcagccttctggaagatggaacactgagacagaaaactgacagatcaaagggactgacacagagacagggatctgataacctggaaattcatatgtaagttccaaatataacaggcggcggtaaatctgaccgcaaaatccggtatttctaaccacgccgcgctttgcatctgcgatgatctgtgtctttccaagctttgagcactccgcaggatgtgtccgcaacctgcagacaattttaggattctcgtgtgtccctagcggcaccagggaatccgctcattgtctgcggtttgtcggacacatcctacgtattgtcaaagcgtggcaagagacacagaatctgatgcatagcgcggcatggaagaaatactcgaattttgcttcaaagatttaccgccgcctgttacattttggaacttcactcctgcaggttccttataatcagatcccaacctctgtgtcagccctttctctgtcagttcttctttcccagtgtgacagagagcgtctgctcttcatactgtccgttggaagatctctggatggtgacatccacggtcgttcctgctttgtaatactgaagttttaaggacagatcctccatcgaggagacatccttgccgtcaaatgcggtaatgatatcgcccttctgaattccagcctgctctgcggcggagttctcttttacctgtgttacatagacaccggtcggcatattgtaagtctttgccacatcgcttgtgacatcgacgccgccgataccaagatatgcactgtctgcctcatctaccttttccttcgtaatcaggtcctcaatgatcggcattgctgtgctgatcgggatcgcataaccgattccctcaacacttgtgtctgcatattttacagagttgataccgatgacctcgcctgctgcattgagcagtgcaccgccactgttaccagggttgatcgctgcactggtctggatcagttctgcggtgtaatttgtgttgctgttggaatcggatacggttacttcacggttcaatgcgctgatgacaccggttgtcacagactgaccatagccgagtgcattaccgatggcgatcgctgcctgtccggctttcagatcatccgaattgccaagtgttgcaactttgattgtatttaatgtgtcagaatcgatgctgcttaacgcaacgcggataactgcaagatctgtggaaggatcggtacccttgatctccgcgctgacggttgtgttgtcactgaatgcgactgtgaggctgtctgcaccctccaccacatgattgttggtcgcaatgtaaagattgtctgcatcctggctcacgataataccggaaccgcagcttgtgctctgctgtgtctgtgttccgccgaaaaagctctgatactgggattcgctcacattcgtgatcgatacgatagaaggcattaccgcttccacgatgtcagagacatcggatgccacatagctggatgatgcgccggtcgcctcaatcttggtgttggaatcggactgtgtcagcacgctgcctgtggctgccaccgtggaatccgagtctccgaaaatctgacccgatgcgagatgtacgccctcgaacaccgttccggataccagcccgaagacaagtgccagtgccgcacattttgcaagcttcataccaaagccgcccggctttctctctctcttttctcttctcttcttttccttcttgccggaaggattctgaccgtacgccgcattcccagctccctggctctggtagaactgttgctgataaccgccgttctggtaggttcctccgttctggccgtatgcactgttattctgtgtgccgctctggtaggttcctccgttctggtaagttcctccgttctggtaggttcctccgttctgaccgtatgcgctgccattctggtaagctccgtttgcgctgtatgctccgttgttctgcgatgtgccgttctgattcgttccgttattatatgaatagaaggaatcggaagactggttatgattacgttcattgttatccataataattgctcctttccctgacaactctttgttctgttccagtgagtatttctttttctctctcactttctatgatgcagtttacagggaaaatgtgatgtaattgtgacgaaagtatcaaaaaagtatgtttctgttcttttctgtctaaaaaaggacctgccacaccagattccaaacgcccgccacgagcagtcccacatagaatccatttctccagcgcttctttttcagggaaaatgcaagtgtcaaaataataaacagatataaaagatccgtcagataataaacacgcgcaccggacgcatacatcgtcggagagcaatacataatcgcctcactcgcgattcccgcaagataggcgagcatcagcgtgatgtgcttttttgacacgcgccataaaaacggcagggtgaaaagcagcgccgcagcccaccagatcatcgcaaggatcacttcccgcgtcatcaccgccatggacggcacctggtacacgcacgcttcgatattgatatactgcatccccatatccgataacagatcaaagcctgcataaggaagcaatgcggccagggtaaagaccgccgcgatcccaagagcgatccagtctctctttttcttctgctcctgctgcagcagaagaaggattcccacaacccagatgccgcataaaaacagtttgttctcatttgcaaacgatgacagcagccagtgtatcgtgatgaacacatgctgtccgaaaggcatcgtctcgtattccggcatccagtttgcaatctcacttgccacacggatctcattgccgggagccgagaacagaatcacaaacgccaccgctgtcgtaagtgtctgaaccagaagaagcggatgcacttttttatggcgaaggaacagtgcgacaaccgccaacacctcaaacgtcagcaaaacagcgctcatctgctcgatggacatcgttcctgccaccgcgcacggtatgctgatcagaaaatatttcttattcagcgcaggctcttcccccggctttgcgaacaccgcgtccgcaaaaggcatcagcgcccagattccgcaggtaaaacaccaggtatagaagatggaaccattcacccagaccgccgcatagccgacagtcataatgttcatgagaaaatagccgcccactgccgctgcgcagggtccgatcgcttcctcactgtgtacaccaatccctgccgccttttctgacaagcgcagcacccccatcggcagaagcaccagcatcacggcatttaccacacgccagaagccgagccctagccggaatgcaagatacacaaacgcctctcccgacattcttcccacccaggtctgatagcgccaggacagatactctccaaatcccatactgttcgtatactgataaaaaaaggcatcgtcgccatccgaatagctgctctgacttaccaccagaagtgccccgatcagcatcaatgcccaaaaaatccacactttatattttttactcataaaaccctctattccacagattccatgcccaaaagaaatcacaaccggttattccgaaatcaaaaccgttattccctgccgggagtgtcttcctgctctactgcatccaaaagcaccgattcaatcagatatctcggacgccgtttcgtctccatatacgtcttcccgatatactctccgataattccaatcgcaaacagctgcagaccgccgagcacccagatggaaataatcacacttgtccaccccggttccacattgccgttcgcgtaatccacaaacgccttaatcagcattcccaggctgacgaggcacacaaacaatccgcccatcgtaatcatgcggatcggcttgaccgagagcgatgtcactccctccagcgcaaatgccaccatttttccaagcggatatttgctctcccccgcgaaacgctccccgcgctcataggttacggtcgtactctgatagcccaccattggaacaattccacgcagaaacagattcacctcttcaaaagacaggagtccttttgcggcacgtctgcttaacagccggtaatccgcgtgattgtacacgatctccgcccccaggaaatgaagcatccggtaaaaaagctgtgccgtgttgcgcttaaaaaacgtgtccttctgtctggaagaccgcacgccataaacaatatcatttcccgcttcataggcatcgatcatgcggtccatcgcatccacatcgtcctgcagatccgcatccatggagacgatcatatccgcatgttccgccgccaccgcaatccctgccagaagcgcattctgatgtccgcggttcctggataaattgacaccggaaaatacggaattctcctcgtgaaacttctgaatcatctcccacgtcgcgtctttcgatccgtcattcacaaacagaatccggctgtccgcgtcgattttgccgccctgacgtaatgtctgcactttttcccgcagtcttttggatgtctccggaagtacctcctgctcattatagcagggtactacgatatatagtatgttactcattttctgctccctacttttctgaccatatccgcttccagtaatacggactcatggtacacttcaagatctgccttctgccaagcttctgatagcgttttcccagaaaatagccggcgtacctgccgacacactgccaccctaacttccagatcagatacggcttgtgaatcttacacagataacccatcgtatttttcaccagccgcatgccctccgcctccgagctgacctgctcaaagatctccggatgtgccgtctgggacaccgccagatcaaaattgcggtgaaactgctgcttcaccgaatagttgtgcgaatgaaccacctcggcgtccgccgcatacgcaaccttgtatccttcctgcactgcatgcgccgcaaaaaacatatcctcgttaaaaataaccggcgattcaaatccgccgagctgctcaaacagatccctgcggtatgcagcgcacacgtccgagcagaaaaaagtcttaatgccaagccgcggtatgtcctcacggctcttgacgcatccctcatcgggataattaaactgtctggtatagcgctcgatgatgccgcagtcctcccgcgggagctgccttgcatacgcgaccgcaaccgcacctttggctggagtccccggaccgtgcgcaccggatgtgagcgcatgcaccagatgttccaccagcctttcgtctgccggcaccgcatcctgtgtcatgaatatcagaatatccgcttcggaataccccgctcccatattcctggcaccgccgtggtcaaagttctctctggtcatgtgaaaaatgcggctagaaaacggaagctccttccgaatctgttcgatcggatacttccgtacagcctcattccacagtgcttcctcggtattaaccaaaataagttcatgtataacaaaggtctgctcctgcaatttttgcaggagcagacaaaaagtgtcatccggtttgtaagtcggaattatgatatctacacgcatcaatagccatctccctggtggaatccggtatcactgataatcttttcactgttgctctttaccgtgtctgtcggctcatattccgtatcatcgtacaggaactgatgcaactgaatgacgttggatttcagatcacacggtactaccacacttcccttggaaccgagcgtgatcgtattcttctcaaacgggaatccggtcgtctcgccaaggctgtaattgaatacctgggatgcaagtgcaatcaggtcggtgttgctgtagcttgtcttaatatcgccgaatacctcatcgatcaggctgttgatcgtcttgagatcggacttctgcgccttctggatcattgccgtaagcactgctctctgacgctcggtacgcttatagtcatcgcccgccgtataacggatacgcgcgaatgcacatgcctgtacaccatccattgtgtaggtgccggctcccggcagatactcggatttcttcttggtcagcttggagatctcatccatgtagccgtgcatcagcaccgcttcctcatcggttacggtcatctcaacaccgccgagaagatccacacactctaccaccgcattaaagtccacggtcacataatccgtaatatttaagtcaaggttcgtgtttaacatggagatcgcctgctccggtccgccgttcgcataggctgcattacatttcaggtaggtgctgttgccgatgtcgagataggaatctctgtatacggataccagcttcacctcatgcgtatcgttgttgatgctcgcaatcataatcacgtcgctgttacccttggataagttgccgttggaacggttgtccaatccgaacagcgcgatcgtcgtataccccttcatgatctgctgggattccgaagaaagtccctcgttgaattccagatcactctcattgaaggaggtgtccttctcgattttggagagcttcactaccgcaaacaatacaactgccagaagcagaagtaccaggatctcaaccacaacgagaataatcttcttctgacgcttcttcttgcggatcgctgccttctgtgcttttgtcagcggcttcttctgcggatgtccgctgccgcctgtctgtgtccggttgctgctgtgcgccccgttgctgctatgtgccccatttctgctgttgccactactactcataaatttttctcctaatatgcatttttattgataaatcccttgaaaaccgtgaggaacagaatcttgacatccagtcccagtgtccagttctcgatgtagtacagatcatgctcaatgcgcttgcggatcgacgtgtctccacggtatccgttgacctgggcccagccggtcattcccggacgcacctgatgcttgatcatatatctcgggatctcttcccggaatttctctacatactgcggacgctcgggtcttggtcccaccagactcatatcgcccttcagcacattaaataactgtgggaattcgtccaggcttgtcttgcgcaagaactttccgactcctgtgacgcgcggatcgttcttcttcgtccagcctttctgttcttcctcctccgtctgcacatacatggtgcggaacttgtacatctgaaacggcttattgtgcagccccactctctcctgtgcaaagatcagcggtcccttcgatgtcgccttgacaaggattgccgacagcagcatcaccggtgaaaagaggatgatacacacaatcgatcccaccacatccatacagcgcttcacaaatgcgttgaacgtgttggacagcggcacatagcggatattgatcacagggagacccagaagatcctccgtgtaaggtctcgtaggtatgatgttgccgtaatccggaatgaacttggtgtgcacgccggacttctcacactccgcaactattttttccagcttataatattcttccagtccgagggtgattgcaatctcatcgagactgttctgcggcaggatgtagttgagattaccaatactgccgatgaccttcactcccttataggaggtgcctctggcaatattgtcatccaatacccctcgcacattgtatccccactgcggattctgctgaattctgtcgatatactgctctgccgctcttgaatagccgacgagcagaatgtgctttaaattgtatccccttctgcgaatacttcgcagaaatctgcggatcaaaaggcggacaatctcttccaccacaatattggtcacgtagaaatagaaaagcatctcccgtgagaagttgcgatactgcggattgtaggacgtcagggtaaagagagccgcaaacatcagcagcagtccaaccgtattcgccatcacaatgttggaaaactccagccgtctcccctgcacgcgcttggacgtgtacagattgaacgcataatacaacaaaatatacaccggaacaatgagcagcagcgccctcatatagaactcaaatgagagtacgccgacttcatgatccagaataccgctcaggaacttcagccaccatgcaaacacatacgatacgatgataaccaaggcatcgatcagtacatgcagcttattaaagtactgctgattgtcttttatcatattgctatccttttgcgaattctaactaccatataacatcaatgatacaataatttccataaaagcacaacgcctttttcgcaaacattctgtaacattttcttaatatttcttaaagatttgtttgacgatcaaatttatcttcctgccagaatccggatcacattgccccacaaggccagctgtatgaccgcgtaatttcccagatttttccacgagaaccgcacttttttacattcccggcacccggtaatcccggcgccgattccccttaaatattctcccgcaaacccctttttcaggaaaaacagactcttgatgagaatacctgaaaggatcagcggcaggttgatcagcagctgtaaaaatggcatgttcttgtagatcagatacatcgaattgcgcgccgcgaggaacacctttttctcattataacgtgttcctgtagtagcgctccccacatgatacacccgcgctccgggcgcatagcagttgatgtatccgtggatttttgcccgataccccatatcgacatcctcgagatatgcaaaatggcgctcgtcaaacgaccccatttcacgcagcagcccggtgcggtatatgacagcgccgccgcaacaggaaaacacacggcacggtctgttaaaatccgccagcggttttccctttccgcgcgccaccgcccatccgaatgccgtgtaatagtcgccggcattatcgatgcgctctctgtcatgataatcgatcatcattgctcccgcggaaaagatgcggtccgactttttgatcgccgcaagcagctcctccacgaattccggcagaacctccgtgtcgttgttgagcaggatgacatacggcgtgtcggcatgccgtatgccctcattcaccgctccgcagaaacccgtattctcctttagcgcaagcatcgtaagatccaggctggaggtcacctctgtactgccgtcgtccgagccgttgtccaccaccagaagcttaaaatccgtgcaggtctgtttttccagtgtctgtatacaattttccaaaagcttctttccgttgtaattcggaataatcaccgtaacttccggctgactcgccatgtaatacctccgcttaatgataatctctcagcgcataattcggatataccgttgaaaagtttggattgtagtagggatcaccgttctttaaaatgccgatccagtgattccgcatatattcgatctcccgtccgaagcgcgccactttttccggggaatcctcgcttccgcgcgatttggattcgtagtgataggcttccacccgcggctggtacaccacaaggtaaccctctttgcggactttcaggcagaaatccacatcgttgaacgccacggcaagcttttcctcaaatccgcccaccgcctcgtagatactccgctttaccatcaggcatgccgccgtgaccgccgagtaatccagcgcaagcgacgccttgtgcagatatccgctgcgcgctctctgcagtcccataaacatattctgtccgatgccgcgcgcattgccaccgattccgacaacaattcccgcatgctgcacggtatcatccggataatacagcttcgctcccacgacaccgacctccctgcgctggcaggtaccaagcatctcttcgagccagtcttcggtaatcatctcgatgtcattgttcataagcaccagatattcgccctttgcatgagagacgccgaaattgttaagcgccgaataattaaacccttccttccagactgccacgcagatccgctgtccgccggataaggttccctcatagcacaccgcttcgccctctttcacctcttcggatgtgatcgagcggtaaaaatcaaacgtctccggagcgctgttattctccaccacaatgacttcataatttgcataatgcgttttttgaatggctgcaagacatttttttaacgtctccacttcatccctgctcggtatcacgatcgagaccagcggattgccgctgtaaggatagcgcaccgtgtaaaagcccatatcctttgtcgccgtcacttcccccgcaatcccctgacgcttcagatgatcctcgagcgcgcgccgtcccgcatccaccgcatactgcttggaaaacgggttttccgacgtcgactccgtgtggcagcgccagtggtagagcacccgcggcacatgtccgatggcctctgcgcactccacacagcgcagaaacaggtcgtaatcctgcgcaccgtcatactcctcacggatcatgccggctttctccagaagcgttttccgcatcatggtaaagtgcgtgatatagttgttggaacgaagcagatcgatgttgatgtccggcttaaagtgcggctggaaatgcgtttttccatccatgtccaccttgtcttcatccgtgtagatcatgtcatactgcgcaccggcttttctaaaacctgtcgctgcaactccggtctcatccttcggtccccgcagaatcagatgcacggtctcatacagtgcgtccggcgccagcagatcgtcatgatctaaaagtgcaatccactccccgtgcgccattgcaatcgccgcattggtattgccggcgattccaagatttttttccagtctgcggtaacagatgcgcgcatcctctccggcacatttcctcacgaccgcctcaagacgcgcagcgttttcctccggacttccgtctgccaggcagagttcccagttttcgtaactctgcgcctgcaccgaaccgatcatctcccgcaggaatgtctcattggtacaatagagcggcactacgatgctgacgcagggtgctcccttccacgcggcagactgcttccgctgacggcgcagcgtctcctccgtcgccttgtgatgctcataccatggctcatacggcacattttccgattccatcttctcctgcagccgaatgaaaaactccttcactccgtaatgcttcagataacgcacccctttgataaccttctgcactgtaatcttcatatgctcaatgcttcttctgatggatgtaaagccatccatcggaataatctttcctttcctcttctgacatttccgtgtacttaccgaaatccatttttgcaagaaccatctgcggctcactgcacttgtagcattccacatccttgcgtctggacactacgcgcatccagccgcaggacggacatatatataccttcatcatagaaccggaatctcctcttttctgtctcgtaccagctgtctttttgttttattcacctgttttcgccgtcccccgcgttatctgcgcagcgaaaaatcagaattgtccagtgtcagattcggattgtagtagggatctccctgctcaatctgatctctccaacgcgaaagcagaatctccacctcgccgttaaagcgctcgactttttccggggaatcctcatagcctctcgacttcgattcgtagtggtgcatttccgcgtagggatcgtacacgacgagccatccgtgctttcttactttcaggcagtagtccacatcattgaacgccacagcgagctccccggtcattcccccgaccgcctcaaacgcctcacgcttcgtcatcatgcacgccgcggtaaccgccgaataatcctgcgcgcacagaattctgccaaaatatcccgtatcgtatctggattttccaatgaaagcatgtcccgccgtgccgccaaagcctaagatcacaccggcatgctggatcgtatcgtccgcatataaaagctttgcaccgacgattccgacgtcctctctcatacaatatccgagcatctcccggatacagcccccgtcaatcatctccgtatcgttgttcagcagcaggaaataatctcccctgcatgccgccgcgccgaaattattgatctttgagtagttaaagccgccctcgtagtacaccacccggacattttcatgccccgcctcaagttccttataataagcaaacgtctccggctcggtactgttattttccacaatcacaacctcaaaattccggtagtcggattttgtaaaaatggaatccagacacagctttaaatcctccgcgtgatccttgtttggtatgataatggataccagaggttcctctttccactcgtagaccgtgcggtacattccgtagaacgatgcattttccacgcgcgccggtattcccagtctgcggtaatgctcctcaatggcgcgccgtcccgcctcaaacgcatagagcttactctccggattggatgcggtcgagtccatatggcagcgccagtgatacagaatcttcggcacatgataaatctttttggcctgctcgctgcatcttaggataaagtccagatcctgcgcgccgtcaaacgcgctctggtagctccccgcacgctccgccacatcttttcgcactgcgagcaggtggcagatgtaattcacactgcacaacagatccaggtcaaagtccggtttgaaatgcggctcaaaaaagtgtctgccgtccatgctgaccttgtcctcgtcggaatagagcatatcaatcacgtcatccctgcggatcgccgacgcaaattcgtatagcgcattttccggcacgagatcgtcatgatccaccggtacaagatagtctccggaagccattacaagcgcggcgttcgtattttccgcgattcctccgttctccggcagcacctgatagtgaatccgcgcatcacgcccggcatactcctccagaatggagatcagtgctgcatcctcttccccggatgcggcaagcgccatacacagttcccagtttccgtaagtctgcgccgtcacggaatcaatcatctcccgcagatactgcggcttcgtcttatagagcggcacgaccagcgaaaacaacggtcccgcatcaaacacatcctctctctggcgctgcagttcttccggcaccggaagatattttgcccgccagttctcataggtattgccctctttgtgcgtcagcttgctcttaatcttataagcggttgcagagattccgttgcgctccagatagcggacggtatccccggctttttcgattacatactgcagcttcgtgccctcgtcccacttcgtgagtctggttctcgaatgattcttcgcgccacgcatctccagataaaacggtccgctctgccctcccgctgcggttccctgcaccagaaaaccgggcttcgcctccttatcacattccggaaaaacagaaagaagatccttgcggtaatagtgctccaccttctcggaaatcggctgtctgctgccgtcgagaagttcaagcttgatatcccccgccgacatgcaccagccagtgaccgtaatctggctcccctctctgtgacagttttccacatagtagctgacttcattctccagtctgccaagctttgctgttgagatggcataagatttcttatattcttccctgtaagcagccatcaatgtcacccggcggccattgcgccagtccggcggaagctttatgatgcctaccacttcctcctcgatctcattgatgctgcggatatatttctgccggacctccgcaccgcgattcacctgtaccgtaagcggaagctctctgttgtccagatatgccttgatggaatgttccttcgtactcccatcaaaaaaccacccgacaaagaccagcgtgtcctgttccttcagatggaaccgcatcttttccacaaaaaatttatgtgtatccatggtccgtcctctctcgccattgactcctcggtcaatctctttgatttcgtattccactataacaattccgacgttttgcgtcaagttgttaccacgcctttacattccttttgttctctgttaatgtagaatgcaaagaataaaccgatcaactcaaaggagtccttatgatgcgttttaaacaccttttttccactgtcattgtcgttctttttgccgtagttctcgcggcatgctcccatcatacacccgtggaatccaaaaaagattccaccggctacacccccgatcccgccacggaatatctggtgacgcaatacgcggacgcaaccggcgtgcagggaactttttacaccatcacgaacgataccaccctcatcatcatcgacgggggctgggcagacaacgcctccgccgtgcgcgaggtcatcgccgcccacgggaaccatgtcaacgcctggattctctcacatccgcatcaggatcacgccggcgcattcaatcagatctacgcctcaccggacggcatcacgatcgacgccgtctacgacaacggtttcgactatgactttatcgaagcggccggagagccgtacgatgacattacggtgatggagacctaccacacgctcacccgggatgcctccaacgtgacgcacctgcaccgcggcgacgtcctctccatctgcggtctgacgttctccgtcctaaatgcctatgacgacacggttctgcagaatgtcggagatgagaaagattaccagaacaatgcttccctcctcttaaaagtaagcagcgtaaacagcagcatgctcttttgttcggacatcaaatacgatatgaatgattccctgcttgtcgcatgcaaagaccagctcgcctgcgattacgtgcagaccggtcaccacggaaactggtctttctcggaggaattctacgacgcagccggcgcctccgtctattttatcgatgcgccttcctccattaccgacaacgccgactttccggcgagcacactcaaatctgatctgctcgcaaaaggaaagacggtgcttgattttagcaccgccccgaatactgttaccttgaaatgatgtcatcatgatgtgaaatacactgcaaccgtggaatcatatctaatcatgtagtttgtttgtctgaaaagcaagaggcggaatgcctcttcttttttattgtttttgttgtctttaatgctttcgcaccttccgatacacctgttccggtgctcctactcgaaagttattgttccgatgcacttaccgcggtgtgctactgtcagttgaagtaatagcttcccactgcattaatctgcacgttgctcttgttctgcacgaagacgcggtaatgtccgctgcttgtgattgcaaaatcgtgagacaggctgcccgttccctccacatagcgtgcattgttcagcgcatccatgatgccaatccaaaatgtgttaccacctggcgttgctactgccgccatatggatcgtctgtcccttgcttacccagaactggttgctcaccatgcgggtgcccggagacacattccagttaaaagatactgcttcattcgcactcagcaacgggctgatcacctcaagctccggatacgcatactccaaggtatcgtaagagcgatccatcacgcctaagatctgctgctcctcgagcacgttctcctcgctgccatctgccgtcagagcctccacattctggtagatatcatcgtgtacatccgcagcctcgctgcccgccgcatagatcggtgtcacactcatcagcacaaacgccgccgcaaaacacatacttgccagtctcgatgctacttttccgttatattttcccatatactcaattctcctttccagtcttctctggttctcataaagcatagaaaaaatataattctcatcggtcacaggactgtgcttcacactctctataatcatttcaaaataacaccctgcatccatttcatcgctgatggctgcaatcgcacgtgcatcgcagtaaatctcgctccactcgtccagcagtgccatcaggttccccgtcagcgggttgatgtggtgcactgcagtcacacacataccgcataatctgacaaacgggtcatgactcttgtaatgcatcagctcgtgatgaaagatcacgctcagatgctttctgtcgtaggcaatatctggaagcaccacccggcaccggaaaataccggcaagcatcggactggtgatacggtcattccggtacagacgaatgttcgaccggataccaagctttttcttcacacgtgcgaactcttcccgcacggcttcctcttcctccggaatgtcacgcatctgaatccgcttcatcccgcgcaggctgcctacaaactctgtgattccctttgccatgagggcaagccagcagactgcggcaaagaacgcaagaatccataaaaatcccgttaaagaaaaattgatctgccagataccttccttctgcagataaccgtgaatcgtcatctgcatccatccataatccaatggaatcaggtacaacaggcagaccagaaaaagcgccagatatacatattgcggcttcgtacaaaagcggctgttcataagcagccgccagagtccgtacgctgccgttcccgtgacagaggtaattaccactgcaaataaaatctgattagctatgttcattcagctttttctttagtttctcgatgtcctttgcatccagcatgtcatcacacagacagcatgccagttctccgagatctcccttcgtaaagaactttgcactctcttccatcgtcgcgcgccagaagtcttccttgctgacaagcggctgataatagcagtatctgcccttgcggtacatattcagaaagcctttctttaccagacgggataaaaatgtggaaacagtctgcggcttccagttcttgccgttctcatgattgactccatccatgacttcctgcaatgccaattcttctgtagaatcccaaatgaccttcatcacgagcttttcgcatgctgaaatatcgttcgtatccataaaatcattcccctttctacggttatagtataaaccatattcgtatcaaattcaatctttttttctgatacttccgtatcttttccatttttatcacaattttaccaaaaaggcaagcaaaacaagcacattctttataaaatattagatattatgcgttctccttgctcttgctgatggagatctcgatgcagcgcagatccgaaccaagagcctgaatggaatacgtctttccagcggcaatacttacggttgcacccgccattaggtcgacctccacgccttccatgatcagcttgcccattcctgaaagaaccgtaatcgtctccgtatgctgcagatgtctgctttccggcgtcttcttgcctgcgacaaccttgatgcgttttgtcacactcttaataccatcatcctcatcgttgtcgatcgtcttgatcgttccccagcggcgctcttcgtatttggaagtatctgcaatatttgcaagacagtccttgatataggagctctgatgcttgtctgccaccaggatcccatcatgggaagctgcaataaccatatttttggctcccatcactaccatcggaattccaagcacattgatcgcatggctgttctcacaggtgtcatcccatgtcacatcaccgatgctgttctccggcatctcctcggtcagtgtgttccatgtccccagatccttccacagatccgcatatttgatcgccacgatgcgctcccagtgctctaagacttcatagtcaaagctcttcttcggaagcttctcataatccgcgaccatctcatcataatttgtactgacaccgtactttttcagccagccagccgccatggaaagtttgaaacagaaaaccccgcagttccagagagcaccgtcagcaaccagcttttctgcggtcgcctcatccggtttctcgcggaatccggtcacttttaactgttctccctctccctgctccggcacaatataaccgtacttggtcgacgggtaagtcggcacaccgccgagcagaccgatggtatcatccgatgccgcaatggtttctcccagacgcttgattttctggaaaaaatctccggttgtatatggatctaccggaagaaacgcaacgacatcatctgcttttgcccccttcttcgacagaagataagcgcaggaaagcataaccgccgggaaagtatcgcgccgcatcggctccactgccacctcagctgcgccgtttagctggctctcaatcagttccacctgcgcactgcttgcacacacgatcgtattctcggaaagtcctgccgtctcaagctgcccaaacacacgctgtaacatggaacacttttcacgattctctttctcagtgtcatgattcatcagcttaatatactgcttggagcataaatcattggataagggccacagacgttttcccgagccgcctgataacaacacgatatacataaaaaaatctccattctcatatttatttgctaattttaacgttctgctctcatcggattatttaagaaatcctcatatgcaaggcggataccatcccggagttccgtcttatacttccagccgaggctctccagtttgctgacatccagaagctttctcggtgtcccgtccggtttgctcggatcccacttgatctctccggtatagccgattacctccgccacaagttcggtaagttccctgatcgtgagttcttttccggttcccaggttcacggtctcatctccgctgtaattgttcattaaaaagacgcacgcatccgccagatcatccacatataagaactcgcggagcggtgtgccggtaccccagcaggtcacttcctttgcacctgacaccttcgcctcatggaaacggcggatgagtgccggaagaacatgactgtgctccggatggtagttatcgttcggtccgtagaggttggtcggcatgacagaaatgtaatccgtaccatactgcttgttcaaaaattcacaatatttcagaccgctgatcttagcgagcgcatatgcctcgttcgtcttctccagctctccggtcagaaggcagttctccttcatcggctgcggagccatacgcggatagatgcaggaggaaccaaggaacatcagcttcttgcagccgttcttccatgcctcatgaatcacattcatctccagtgtcatattgtcatacataaaatctgccagcgcttcgctgttcgccatgataccgccgacttttgccgctgcgaggaatacatactccggcttctcctcagcgaagaatttttccacatcctcctgacggcagagatttaactctttatgtgttcttgtgataatgttgtgatatccttctttttccagctgacgcacgatcgcagatccaaccattcctctgtgtcctgccacgtaaattttcgcatctttttccatcatgatctttctctccttttttaccacaacctggcgtgccgcggcagagactactgctgcggcacgccaggcataacatctgaacggactgttatttagttctcttttgtgacgagctccatgtcatgttttaccatgatctttaccagctcctcgaaggttgtctttgtcgggttccagccaagctctgacttcgcctttgtcggatctccccagaggttgacaacgtcggtcggacgatagaattccttggatacctcaatgactaccttgccggttgccttatcgataccgacctcgtccatgccctctcccttgaattccagctcaatgccaacctcgcggaacgcatactcgcagaactctctgacggagtgctgtacaccggttgcgatcacgaaatcctccggcttgtcatgctgtaagatcagccacatgcactctacataatcctttgcatatccccagtcacgcagggaggacagattgcccagatacagcttgtcctgcttgccctgtgcgattcttgccgctgccagtgtgatctttctggtaacgaaagtctctccacggcgctcggactcatggttgaataagataccgctgcagcagaacatgttgtatgcctcacggtactcctttacgatccagtagccatactgctttgctacggcgtacgggctgtacggatggaacggtgtggtctcacgctgcggtacttcctctacctttccgtataactcggaagtggatgcctgatagatacggcaggtcttctccagtccgcagagacgtaccgcctctaagatgcggagcacgcctgttgcaacaacatccgctgtatattccggcacatcaaagctgacacctacatggctctgtgctgccaggttgtagatctcgtccggcttgatcatgccgactaaacgcatgatactcatggaatcggacagatcaccatagtgtacgtggaagttcgggttgccctctaaatggtcgatacgctctctcttctctgtggaggaacggcgcaccatgccgtgtacctcatagcccttctccagaagaagctctgccagatagcttccgtcctgtccggttacgcctgtaatcaatgcttttttgctcatttgaaatctcctttttgattctataattattttgcttatatcctgtttcaaagccgctgtttagtataatctaatttttctgatttgataattgaatatcttgcgcaaaaatagtattatattgctatgcttaaaaaccgggagaatacggatgagagactctttttttgaaaaatacaagacctccgaggtcaccaataccagacgtgtcatcaacaccccctccgccttcacgcgcgagcattttttctatatccaggaggcagggtatttaaaaagtttaaagccgcacatgagcaggcggagcgatctgcagtcctacctgtttctgatcgtgctctccggcagcggcgaggtcgcataccgcgacaccgccaagccagttcctgccaccggcagcgatatgggcaaacggagcggcacctccgccgccggcgatggcggaaacggcagccttgccactgtgcacgccaaggccggggactgcttttttctggactgccggaacgaatatacccacatcagcagtgaggacgatccctgggaactgatgtggattcatttttacggtccgcagtgcgatgcctactacgactattttctcaaacagcagacgtggcattttcacacggcgcacctggccgagctgaccgccgcgatccagtcagtcatccgctttcacgaggagccgaccgacgacaccgaccttctgaccgcccagcagatcgtcaatatcctcacgttaatctgcaccgagaccgaccgcaccggtgcggagatctccgcattgggcagcaagctcaaacagattctgcactatctggacgagcactacacggagacgatctccctcgattttctcgccgaagagttctacatcagcaagtattatcttgcgagggaattcaaaaaagagtacggcaccacgatcatacgctatgtgcttgcaaaaaaaatcacccatgccaaagagcttctgcgctacagcaattcctcgattgaggaaatcgcgcggctctgtggcatggatgacgccagttatttcaataaggtattcaaaaaaatggaaggatgcacggcatccgaataccggaagcagtggtgatcagtctgcgtcatttttctccccgcacagacactttttctcggcggtcactctctgcagctgcatctcaaagtcctgcctgttcttctgcgccatggtctcaagcgtcacgcccacaaagagcgactggatcgcagagagcatcgtgaagccgcagacgatcagggtcgggaaatccggcacaagaccggttgccaggtaagtacccatcaccgggatgaaaaaggcggtcgctatcacggcgaggatcagtgcaatgattccgaagaatcccatcggcttataggcgcggtacagtctcgcaatcgtcttaagcaccttaaatccatccgaataggtatccagcttggacacgcttccctccgggcggtcgcggtaggtaatgaccacattttccacgaacatattcttgtcgatcgcgtggatgctcatctccgtctcaatctcaaagcccttcgagagcaccggaaacgtcttgacgaactcatagctgaacgcccggtatcccgtcatgatatccttgatgtcgttcttaaacagggtattgatgctctttcgcaccagagagttgccgaaattgtgaaacggtctcttgttctccgtaaagtatgtggaggacaggcggtctcccaccaccatgtccaccctgcgctcgagcacctgatccgccatctcccttgcagactctgcgggataggtgtcatccccgtccgtgatgatatagcactctgcatcgatgtcgcggaacatccggcgcagcacgttgccttttccctgacggtattcatagcgcaccgtcgcaccggcgccgcgcgccagctcgtccgttccatcggtggaattattgtcgtagacgtaaatcgttgcctccggaagcacccgcttaaagtccgtcacaaccttctctatcgtcctgctctcattatagcagggaatcaatactgctattttatccattctcactcccaaacctttcttctgttaccgcttcccggcacagactgctgcccatggcatcagcccgcaccgattcccagacgcaggatcatcttgatctgctccaccacttccggatatgtataagtcacatttccatcgttctgcaccagatacagcagaatactctttccaatcgtgatgaacgcccagagcgagataaagcagctgaactttcttcccgccgtctcggacagattgtcatgataaaacccgatcaccaggaaacacagcacacccatgatccaatactgatccatgcggtagcgctccgtcataaacggcgaccagagtgcatccataatcgcaatcacaagcggaatcacaaacagcatgacgataaacgcgcgcatctgctgttccttcatgcgctttaagacaccttccggcgacagtccgatcaccgcaaaccacaggatcgggaaattcagcagaataccgttaaaaatcacatacgggaacgcctcgcagatcggattatagttcacgaaattgtagagcaccgcgttggcaaccgcgatcatcttcgtctgtgaaaaataggacgcaatgcttccgtaatggctctggtctgccgctgtcagctggtatgcctgtccgaactcaaacgggctctcaaagcgggcataattgtagcacatcagaagaattccgatgacaacatacggcagcgccgcaaccacaagctccccgaacagttttttcgtgaatttgtgttttttcagatataccaccagcatcggaatcacgaacaggttggcgagcgccaccggcggtctgcatccgaatgccagcgcaccgaacaggcttccgaaaaatgccagacggatggattttttctcgtcctcttccacccacaccgcgcgcatgaagaaaaagaggctccagatctccatgcagagcgctccggtgattgctgtacagtacagtgccggcgcatccacgctgtaccagacgctcataatcgagaacgccgacgccagcatcaggtacatgccaagcgtcatcttcttaaaaaaccgctttgacatcatataaaaattcgcaaagatgccgcagataaagagtgcgacaaaaacctgcgtcgcatggtaagtcgtaaggctcattccggtaatcagacggaacggcaaaaacagcaaaaataccggcacaacgccaaaatacatataataatgtccgtgatagtacgccgtatcccagcggtagtccacgccgagatccacacgcgcctgcggatcatacggattgtccatctgtaaaagcagcggatcgacatccccgttgtcaatattgatatgtccattcagaattgcctccgcaaccagctcatactgattcgtcgcgcccgggtcttccccgttccagcccggcgccagccccatcggcagtgtgcagagcagaatcaggatcactaacaccacgccgatggtgatcttctccctgcgtccgcagtctgtaagcttttttgtatgcagcgcagacttcggccgcagcataaccagcacaaacagcacaatgccgtaaatggcacagcctcccagaaaatatgcgatcataacttacctccttatttgcttctcatcttttgcttctcatcttttgtttcttatctttacttcgcaatttttttgctttttatcttctgcacacaccgatcgcccagccgatagatgtgctcgacacaccatgcttccggcacatggaaaagcgtcacgcgcgcccagtcgatcacgcttcccatcacaacgagcagcagtgcaatcccgagcagcagaaattcataggtgttttctcccgcgcgggcaacatagtcaaacatatagtgcgagatgaatccccgcagcgtccactcaaacaggaagaccgccggcacatgcttcgccagccggttcacaaatgcattttcaaaatgatgattccggaaaatcaaaaataccagaattgcctcaaaaatggtaaacagcgtattgtcccttgcaaaacggttctgcaccgttcccgtcaccacgtacagcgctccgttcaggcagaaatttacccctgccagaagtgcaaaccagccggcaagctttgccgtacgatactgtctgtctgcgcggtacacgccgatgtagcggccgatcagatacagcatcaccatctgggtgattccttttccgccgtccgagttgatgtcaaagaagaaaaatgtcgtcacccccgaaaaaattacaagcatcgtaatcagaagctgtctgaaatgcgcttcacttaacttttccaccatctcatttaaaaacgggctcaaaaacgccagcgcaaaatagcaggtgaagtaccaggaacgctttccgatgaccggaagcaggtaggataaaacctcctctcctccaagtgcatttccccacacatactgaaacaagagtcccgtccaggaatagaacaaaagcatgcattccagatgcatcatttttttcacatccaggcggattccgtaatatcccgaaatcaggataaaacaggatacaccgatatttccgatgaccgcaaccgcaatatcaatccaggcgccaatcccgttcgccacaccgctgtccgcggcgtgcatccagaatatcataacaaggcacacaatccgcagcagttcgatactcgagttacgccccttttttactgttttttccatgtacttaccctctgtgctttccgtgcagtgcccgcttgattccatcaagagtctttccaaacagcagacacccgcagacagacgccgtcaccctcaccgtgtggtaaaggacgaacgcggcgccggtcagttcgccgatattgataaacttggccgctgccatctcaaaaatctcaagcccgagaatatgaagcgccagaagaacaatcgtattctgcccgatataggctaacaccgtacccacaatgcagttctggaatgcttttccgacccagatgcagagcatggagcccgtaataccgatcagaataaaaaacggaacactgaacgcctgatacacgccgtactcgcgcaccgacatgttgatgcccggattcgcccggctgagcgacagataaaataccagtatgccaatgatcacccacagattccagtccctgtcaaagaaatctgctctctgaagcagtgtacctgcaatcataaaaatcgttcccacaaacgcgagatccagactccacggaagcagtatcggcagttccgccaaaagcatcgtgagcacggtaagcaccaccagacagccgatcagaaaccggcggctctttaagcagcggtcgatcaccagatggtacaccagacttgtcacaaaaaatgcggtcagataccacatggcaccgtttgccacggtaaataaaaatacgttgtcctgatgtgtcgtcgtatcaaaaaggcagtagcgtgagtacagcactccgagtgcagatcttcccgtctcctgccaggtacgtccgattgcccggtagaacaccagcagcaacgcgctgtagccgaaatacggaaccagcaggcgcttcgccttgtgcaccacattttccccatagcttctgcccggcttgtacagatagcccgacaccacaaaaaacagcgggatataataattgatcaggtacgggctcagcccgcagctatgtgaaatgatgacgaggagaagtccgattcccctcgccacatccaggtatttccagtgtttcatccccactcctatctccaatcctgccggatcagcgcgcgttcccacagatacggctgtatccggttccagatatccgccgcctgatggaaggttgcattctcaccgtttaggaactttgcaagatccgcacgcacgcctgtggcatcgtcgattaagctgcagtttgcaaacgccgggtccgccaccgtatcctcaaaaaactggcggtaaggtccgcgcatccagtccagaatcggcgcattgaatcccagcttcgttctgcggtaggcaatgtcgtgcggcataaagtctgcgcaggcatcgcggacgatggatttggaaaatcctccgtgcagcttggatttccagccgatcgaaaacgcgaactccacaatcctgtagtccagaaacggcatgcggatctcaacgccggacgccatactgtctctgtcgtaattgcgcaaaagcgtcggaagaatcgtctcatgtgtggagacaaacagtaccttattcagattgtccagcttcttccagttcggatgatccgcgtaagcgctcgatacatccgctcttcccagaagcttcttcgcataatacttcgtcatatagtcacggtacagcttattccgctgccgcttaaattctgcggacgacgggtcatatcccatctcactccgctgatttaaatatgccatcgtaatctggtcgatctccgcttttccctttgcatccggatacgcttttaacacgtcgaatccgtagccggcaaataattcatctgccgcatggccgtcgagagataccgtcgttccgagctctctctcctttttataaagctccatcataggcacctgcggattgccccagagttcctcaaagcagtacagctgacgcagaaattcccgctccggcaccgcgtcgtcaatcgttaaaaacgtatgcctgatgccgagataatccgtcacctgctttgcgtattttgtctcatccagatccgttcccgggaagcatgccacatacgcgtgctgccagtctttgttcgcgcgctcatccgcacagtttctggaaatgtaagacatggcgcagatggtggcggaagaatccagtccgccgctgagtccggttcccagagtcacatcgcttctcatgcggatcttgcaggcatccagaaacagctcgcggaactgctctacctgctcctcgtaggtatccggcacctcgatcagatgatccagtgtgttccagaagcgtgtgatctctgtttttccattgcgaatccacgcataacttccagccgggaatcgcttgatccccttgatcaggcactccggctgggactcataatgattgtccgcaaaataacggtcgaacatctccttgttcggttccaccttctcaagcagcgggagaagcgccttcatctccgatgcaaaggcgaatcctccgtccgggaactcggtgtagtaaagcggcttcacgccaaaacggtccctggagagaaacaggctcttttcctgtctgtcccagatggcgaacgtccacattccattaaagcggtccacgcatttttccttccactcgcagtacgccgccatgatcacttccgagtcgctgtttccgcggaacgtgtaccccttatgctgcaattcctcccggatctcgataaaattgtatatctcaccgttaaacgtcatccagtagcgctcattggcgtaggacatcggctggcttccggcgctggagagatctaagatcgccagtcttctgtgaccgagcgtcacaccatcctcctgccacagtccaaatccgtccggtccacgatgtatcatcgtatccaggcactccatcgcctgttcccgtctcacttttctgttaattacaccgtagattccacacatacgaatgctgcctccttcttctcgttactgtctcttcgttctggtcagccataaatagcgcgtgtttgtcacaagataccgcttgaacagtcgcttcggatcctgcatcaggcggtacagccactctaaagacaacttctgcatccacatcggcgcgcgcttgatgttgccggcatgatagtcaaacccggcgccgacgccaatcatcacgccgtggactttatccctgtgatcgtacatccagttttcctgcttgggcgccccgagtccgacccagatgatgtctgcgccggacgcattgatcttctcaacctcagccgcatcctccttctcacttaagctgcggaacggcggggataccatccccgcaatctgaagatgcggatagcgctccttaagcttttgctctaacatctgcaatgtctccggcgatccgccgtagaaataatgctttaatccgttctctcttgcgaacagttccagcatcagatccggacctgtcacgcgctccgcctccgggaaaccgtgttttctgctatacacggaaagcggctttccgtccggaaggacgaacgccgcactcttttgtacctcatgataatgcgcatcgtcatgcgccatcaccgtcgtatggacattgcccacgcagatatattttccgcgcaattcttccatatcatgttcaattcgttccactgtatccgccatattggtcaccagaatccgggtgcccagtatgtcacagcatttcatctctatcataaatttaatccttctttacaacctcaagcggtatatcgccgatataggacggaagcaggctgaatgtgctgttatagcttccgagaatcttccggcatctggagagcgccagcatctcgatgtaagcgtcgcagattccctctttggaattgcggtcaatgataccggaatcatggaagatgagctttgcgtccggcagtgcttcccgcagttcgcgcttcaccccttcatcgtccgtcgccacaaaaaagtccgtccccggcacttccgtcatctcctgccgcatcttatccgcaaacagcgacagcggactgttggcgatcgcctcggtgtgatcggtacgtctgacatgcacccccaccgtctttgcgccaagctgggaaaacagcggttctcccttttgcagaatacccgcgctcggctttaaaaaggcaaggcttgccgcatccagctcacagagcggtccgaaggacttgatatagatgaccggctccttctcgatgactgccagcagtccctcgtagcctttctgctttttgatcgcttccacatccccgcactccaaaaaacggtctgccttcgcgcgccatttcttttttaactgattccctctgaaatgcgcaaccggctccttggagtatccgttctcgctgatctcgatcacacggaacgggagatcaaacagttcttctgcttttacgttacagccaacctcacgcttccacatgacgatcagctcacggtttaacttctgtgccaccgcataagccgaggacatgccaagcagcttatttccaagtcctgcacacggttcaataatgatcatattttccctcatttcttctctactgcgcgtcctgaacagttacacttccgttctccaccttgtatacaatgttgcagtttttgatggtcgacaggcgatgcgcaatgatgagcattgtcatcttaccctgcagactgtcgatcgcctgcataaccgccgcctctgtctccgtatccagtgcagacgtcgcctcgtcgagcaccagcacctccggcttgcggtacagagctctcgcaattccgattctctgacgctgtccgccggacagacgcacacccgcctcaccgatcaccgtgtcaagcccctcctcgagcgactccacaaattcatcgagctgtgcctggcgcagtgctgcccagacatcctcgtcgttgattccttctttttttccaaatgcaatattgttgcggatcgtatcatccagcatgtagatcgtctgcggaatatagccgatcttatcgtgccatccgcggtacgatgtgctgatatcgacaccgtccaatgtaatctgtccctcctgcggctttaacaccccgaggatcagatccaccatcgtggtcttgcccgctccggacggtccgataaacgccaccgagctgttctttggaatcgtcacattcacatgggacaataccggctcctccatctccggataggtaaacgtcatatcgttgacgcggatttcacgctcaagtgccatcgccggataatcgcgctcctcggaaagatcaatctccagatcgcggatcttcgtgtactcctcgccgatcttgtgaatcacgacgccgttgtgaatgatcgacgctaagtattccgacattttgttggcagaaggaagcaggtaaaacgccgcagccgcaaatacggcaagcacgccgacaaaatgggtcggatcggactctgtcatattgatgcggaccgcaatcgtgatcatcagacccgcaatacataacgcttccatcaccggcttcgggatggaacttaaaaatgcattctgcttgatgacgtaggtgtaaagtccgttctgcttgcggaactcttcctcaaaataactctcacggtttgcaatcttgatctccttgattccgccaaatgcctgctgcatgcactgaataatgttcgcattgtatttccggcgctcatcaccgaagcgcgccagcgtgcgctttaactttttcatgaaaagcagcaccatcagcatcatcgcaagtgccacaccaagcgtgataatcggatctgtcactaccagaaagataattaaaattgtgcttgtgcacagttccgctgccagctgcagcatatttaataccgctgcatagaacatctccggatcattgttgatgtcgcgcatcagctccgcactgttatggttcagaaaaaacgtatagtccttgctgatatagtacttcatcagacgatcctgcatctcccttttcccgtagtaagaaaaacgatactgcatattattcataaaaataataaacgcattctttgccagatagacaatgacaattccgatcgctatcgccgtgatcagctcgttgggattctccatccccatccactcgtaaaatgccgccacatagcggttcgcaagcagttcctccggcgctgtcaccgcctggataaacggcagaagcacggacacgccgagcagactgactcccgaattgatcagaatgagaaatgccataccaaacagctttctcttctgctttccatcaaacaccttaaagacgctctttaccaaactcataaaacaatccactccttcaaacgtatctgttcacagcccttatattccggcataatcactactttttccggattcggattcaagtaagccgcccaggtggaatacgaactatttgatatgatctggtgacggcacgccgccatcaggaaaaattcatcgacatccgaaaacgctcccagttcggagatataggtcatcttccgctctgtatgttctccctcgagcgcttccttcgccgcctccttgtcgttggtaaacacaagatagcgaagccccggacgctccttttccatgcgcactaaggctcgctcaaagaaagctctccccggacccacaatatctccgccacgcacatgcacagcacaggtgtccgtcgtctgaaattccgcacacagctttttcacaagttcactctgcccgtacgcaggcgtcatcatatctgtaatctcttttaaataaggttcaaaataacccgtatgctgccagtaaccgtgcaggtatttgttgcggaatctctttttctggaagactctctgatccaccgcatgcagatcacgctccttgatgacgcggtacttgagatctctccgcagacgtttgtaaattttttgaaaaaccgtccggttcggaaaactctcccgctcatcatatttcagatgaaacttatccagttcaaaatcgcgcagggtggaattgtccgcctcggaagtatccagctttaacgtatcattctcccgccgcgccgccgcatatccgcacgcgtaattaaacagctggttgcccatgccgtcaccgatttttacaataatcatgcccgataccccagaatcagctcacagatgcggtccacatccgaaagatccagatccgcatagagcggcagtgtcaacacgcgctttgacgtctcaagcgccaccggcgtatccttcgcatcatacttgtcgctgtaacactgaaattcgcttgtcagcggatagaaatattttctggtgaaaatatcatgctgctttaacatctcataaatatcatccctgccatatccgagcactgtctcatcgaacaccaccgggaaatacgcatagttcggctttacatccttctgcggctgtaccagcttgattcccggcacaccgtttaaatgctctctgtagcgcgccaccacgcggctgcgcttctcgatctctccgtccagatgccgcaggttgcaaagtcccatcgccgcctggaattcattcatcttggagttggcgccgaccgcgtccacaacgacctcattgcggattccgaaattcttaagaccgtacagatcctccttcagtccgttctgctctccgttaaagcatacagcgccgccctcgatcgtgtggaacaccttcgttgcgtggaagctgaacatggacgcatccccgaacgtcgccacaccgcgtcccttgtacgtaacgccaaacgtatgcgccgcatcgtaaatcactttcagatgatgctttttggcgattgcctcgatcgcctccacatcacagagattgccgtagacgtgcaccggtatgatcgcgctggtcttgtccgtgataagcgcctcgatcttggagacatccatcgtgtagtcctccggattcacatcacagaataccggcgtcagcccgttccgcacgatcgcatgtgttgtggacgcaaacgtaaacggcgtggtaatgacttcccccgtcagatgcaatgcctggatcagaagctccaacgccatgtgtccattggaaaaaagggaaacgtgatccaccttcagatacttttccagttctttttccagttcattgtgcttcgcacccatattcgtcagccagtggctgtcccagatatccttaatctcttctatatattcttcatactccggcatggaagaacgtgttaccaatattctgctcattttttcgcctttcctctcccgcagttctctgcggggcagtccaatcctgcattttcagaaatagataccctgtcatgataataaaaatgcaacttcttgtcaatctttgcgccattttcggcgcatttctaatgatttcttaagaaattcagcgccacagatgtttcatacacttcctatataaatgtgtgttccagtatccgcccgcaaagtgcacgatgtaggcgccgtcgtcaaacaggcggcggatcagcttgtagtgcgcactaaggagcagcatatgcttttctcctgtaagccggcttaggacatgctcgacttttccgtacagccggttctgatgaagtgcatacagcctgtccgcatacggattgccgatctcaaaatacggcatgcagttaaaccggtaatccagttccagaaacagccccttcgtctgggtgtaatacgccatcggcgcttcctcaaacgccgtgttctcgccctggctcttcatcgacatgtagtaatcccggaacagatcggcgacaaggcgcggacggaacaataacacgccaccgttgatattaccgaccagaccatccgccgccgcaaacccgcgcgacgtaaaataatcctccaccgtctcgtttaaaatgcgctcgttgtccgcatagattttgcggaaacgcgcggacgagcgcggattgacctccgccatcagtccgatattctccggcataagtgcaaaaatatccgggcaatccggtgagatgatgatatccagatccaggaaaagcacctgctcgtattcccgcagatagtccgggatcaaaagcttctgggaataaatatcccgcttcttatccttatcaatatagtcgtctataaagcgaaaatccgcatggcacttcttcgcataagccatcagattgtcccgcaccagttcgtattgttttctatattttcctgcgccaacagacattacgcataccactctgtcattcattgcgtagacccccttattttcttataccatcataaattcaaacacattccttgtcaaccacgggcgcaatccacaatcattgcttgacacgcttttttgctacgatataatagaagatactgatgactcaccaatattatatgagaaggagacttattatgtcggatatcattcccgttattgtacaccatgagaccggtgaaaaaccgcagacaggtggcaaaaagaatcaggaatatttaagatactgcatcgcacaggcaaaaaagtacaacgaaaaagtcgtacttttaggcgaccagtacaataaggactggtgcgacgactggcacgatgccaacgatttcatcacagacaaatggaaggaattccacagtgttttcaaaaacctctccccttatccacaggcatgggcggaaggcattttccggcgtttctttctcattctggaatatcttgaccgctatggatacgacaactgcgtgattatggacagtgatattcttctctatacaaacgtcagcacttacgagccgttccgccactgcaagatggcagctgagtctcctctggagcaggacattgccgtcctctggaaaggcaacggctacaaatggaaggtctgcgcaggtgttgcctattttaccaggcagggactgatcgaattcacggattactgtatcgatatgtacaagaaccacatggatgtcctgatggaaaaatggaatatccaccagaaataccagatctacggcggtgttgcagaaatgtcactgctttatctgtgggtaaagactcttcctgagggggaattcttaaatcttctgatggacgatgcgaaccactgcgtcttcgacaactcgatcgggcttccggacggatatctggaaggacagtacgagttcaaccgccgtctcggcgtcaagaagctgcactgggaagacggaaagccttactgctacaccctggacggacaccagaagaccggattgttatgccttcatttcgtaggcgtcaccaagatcttcatggaaggaatctatgagcaccaggattatgccttcggcgccagattctacacctatctgctcaccatacgcggtcatcttgcggacatcaagcacgggaacaccaggttccagcagcgcatcaaaatccgccgcgccgagaaagccagcaaggcttccaacaactgacaggagatcacaccatgaagcatgaacgttcttccaattttgagctgctgcgcctgctttgcatcttcggaatcctggtaatgcacacgtttgcaggaattgacactgccgcttcgcccggcaacatgctggcgaacgtctttgccaactccctgttcaacaccggcgttacctgtttcatcctgctttcgggctatttcggcatacgttttgacttaaagaagctgatcgggttagacctgatggtgatcttcttcacggtggtcggcactgtggcactcggcgatttcggtgtcaaggatctgatcaagtcctgcattccggtcttgtcgagacgctactggttcatcacctgctattttgttctctgcatcctggcaccgtttctcaatcagatggcagaacggctggaaagagagcattttcgcagactgcttcttttactgctactcgtcttcagcctgattccaacagtcacgacctacgatgtgatgcaggatgccggcaagggacttgcacattttgtgatgatctatctactgggacgctatctggcgcgctatcacaccgggcattgttccaaaaagcagctgctcctcggaattacaggatccacggcgctcatcttttgcgccgacggagcgctgaccctgcatcagggtgtcatctacagcactttttcgcgggattgttcgatctttattatttttaccgctgttttgctgctgttgctcttccgtgagttctcgctgcagagccggatcatcaaccgcgcggcgaccaatgtgctcgccatctacgtgctggatcaggtcatccgcagcctgctgggacgctatctggatctgaatgcattttccggccagtggtatctgttctttgttgtctgcggctatgtgctcctcgtcatgctgcttgccgcagtctgcaatgagctgcgcaagctgacgatcggaagaatcgagccgtggctggccggcatcatcgccgcttttctgcaggcttgcggtgcgctccttattcgtacgggtcagcggattgttcactggtttatttcgatggactgatccgcacaacaaattatttttgctttaatatgaggtttttatgaaaaaacgattcttatatctgcgctattacttaaaacatctgcatcataagttccgcgccaagcgcggtggcatgtacagcatcatgcacacaaagtttctcgggaaaatgccgccttccgacgaggaggccaaccatctgatcaaggagatgattacaagcggcaagccgttcgctctgtgccgtctcggaagcgccgagtttaccctgatgcagctgtttgacgaataccagctgtttcaccacgacagactccatcagagcaacatgtacacgctgttccacaaggacatggacgagatctcccggtgggtcaatctcaccaaagaggactgcaaggacgtcgatatcatggcatattttgaggatcatccgatggaagaatatctgatccgctcctactgccagaattcccgcctgatccgcctcgagcagatcgagacgattctctacgatgtgccgtggacgatggcgttagaaggaaaaaaagtgctcgtcatcagtcctttcgtggataccatccgggaacagtacccgaagatcgacaagatctatgagggcaggaaaatgcttccttcttttgagcttaagacattaaaatccgtatggttcagcggagacagggaggacgatgacttcgacacctggtttgacgctctccagtatctctacgacgaggcgatgaagattgactttgacattgccctgcttagctgcagcaccttcggcttcgatcttgcctgcatgttcaagcgcgccggcaaacaggcgatccagtacggcggtgcccttcaggttctgttcggcatcaaaggcgcccgctgggacaactacccgccctacagcaagtattataatgaatactgggtgcgcgcaccgaagaccgaagcaccgagcaaacgctttgcaaacaaactggataacggctgctactggtagacggctgtatttgattttaaagaataagagggaacatcatgaatgtagatcacattggatatgcagtcaaaaatattgacgcatccagacaggcttttgaagagctcggttatgtttttgatccggtcgtaaacgatacggaccgcaatatttttatttcgttcggtcgtctgggtgattaccgcatcgagctggtatcgccgctcgatcccgcacttccttcgccggtcgacggcatgttaaagaagagtgggaacacaccgtatcacatctgctatacaagcagccgttttgaggatgacatcaaggagttgcagcaaaagcgttttcttctcacaatcccgcccgctcccgcatgtgctttcggcggcaggcgcgttgctttcctgtatcatctccaaatcggattactggaactggtggaagcctagtcggcttccagttccgatatatccagttccagcatcttctggcttcgctccttgatgcggatgcactggtatcccagatagattccccacggcttcgtatccttcgtcgccaacgtcatcgcacagagtgcacatccctccgcaatcgtaacacccggcagaatgatgcagccagctcctatgttggaatactttttaatcacaaccggttcctcaatcacattcgtgaacttctccggaaccgtcggattcgtcataaaatctcccgagtaatcgtccgatgcggcataaactgcacagtgcgatgaaatcccggtataatcctcaaatgtaatgcctgccgttccgccaaacaatgtcgtggtaaccgccacatggatataattcccgaatgtaatcttaccgctgagcacgcagaaatcatccactctcacatgattgccgatccagatattggaggcaccgtaaatgcttgccttacggctgatcatcacatcatgtcccacatgggcaaatcccatctgttgtaattcttcatccgaataaaaacttgttgccatctctctctccattctgccgcgcgaaatgcctacgcgctgttttctattctgatcgctgcgacaccatcttacacatcccagaccacagtatgaatctgctctgtctcagaaagtgaagcaagctttcgctcgtactgcttctgctcctcatccccggagacctgtgtaaatcccagatgctcccacagctcctcaaccggcttattcttcgccgtctttttgtatgccgccgtcaccctggtgattccatctgcctgaagcttcttaagtacggcgtccaggatcgcatcctcgactttgcgtcccatcacccggcagctcatgaggaaattgtcgatcactgccgtatcgccgtcctgatgatacaaaaattcactcacccatccgctgtttccatacttgtcggagacttccgccatcagcagatgacctccctcctcgccaaggtaatgctccagtgccagttcatccatccgcagtgtacaggtattaaactgattcgtcttgttcatcagctgcacggcgcgctccctggtattgtcgtttaccggtgccagccggatcgtcgtctgcagcgaccgaagataatcctcataggataccgcattctcacgctcttttctccgctcgcgttcctgctgatactgcgccgtctttgccctgtcttcgtctgtcagatgccatgtgaagaaatagttctcatagacttctgccatcaccgccggcagcgtcgtaaggtctgtcgggaaatccacgactgtcacttccggctgctggatccgcatcgcttcgcgctccgcctcattgtcgtccacaaagacaaacgagtccagaccaaggttcaattcctccgctattttcccaatattgacgggctttggattccagtctgcatagatcgcagaaaaatccgattccttcaggatcatatgtggattctcacgaaatgcactctgcacatcctcgctgttattcttggacgcgatagccaaaagcactccctgctgctgcatctttttgatctgtttctgggtatcctgatagatagctccctcgtgtgcactgtcgagcacaattccttccggtccatcctcgccgatcacaccaccccagagggtattatccagatcgagaaccagcactttcttcggaacacgcgccagtctcgccatcacctgccgcatctcctccgcgagcagatgaagcgctttcatatcgtaagggatggaacccatataccagaatttcgcggaataaaactgttttcttccataatcttcgatcaggcgccgcagttcaaaacggtgaatatttttctgccgctccgccagcccggtcagaagcgtatcccaataagcgccggatgcctgtgccagatcgcttgcatctcccgcgccaatatgttccggccggacatcaatggtcgatacgacaagatagctggcagagtaattctccgccagcttctctatatactgctccgagcggtctaagaccgtcttcacacttcccatatcttggcacccttctaacagggcatttccatccagcagtaaaaacagacattccggcgcaaacgccgccagacgctcgtcctttttaagtgcatacgtgatccactctccatacccgtctgtctgaaatacttcgttctctttttttaaaagtccggacagcatgtccagattcacgttggacaaaattgatagccgcattttatgattcctttatatattgataaaaatcgttcagcttcttgatcgtagagatccgctccatcggtatcataataccgtattttgcctcgatctcaccgagcagacgaagttgcatgagggaatcccatgtctccacatcatcctgggatgtctccagtgtcagtgtattcttatctacttccaatatgtccgctataaaacttaaaaattcttccatctttctatcctttacccgacttattcaatcaccagatcttcccagtcatcgacaggtactaatgcaacgtaggtttttccggtattgatcgtaatctcattcccctgcgcgtcataataacgtgtcggagacgtcatgctggtcttcttccatgatacatagagcgccttgccgtttgtgacgtaatagccgtaaccactgctgatgcagtcaaagatcatataaccgtgttcgtcatactgtgtatagccgcagctctgaatcagaagattcttaaagcacagctgtgcgttgtcattgcctggatctacatgggctttgccgtactcggaataatagtaaagctgatcatccgcattgtactccagataagatccgttgtgcgggaagggaagatctaccatattcgcatcaatcgcatcatccggataagatgtcccgagatcaaccgggttgttctcattcgcaaactgataatgtgctccctcgtaataggaagtatagtcctttgacacatcggagctggagaagttcttgtccatgtccccggaaagaatatactctgtatattctctggacttaccgttatccacacgcgaaaatgttccgctgaaatgatcagaacatgcctcatccaaatactcatccacatagaacggacctccgtcatgacagatgatggcattccattctgcagccagtatcacgttcgtcggtctgacactgcggatacttccaatctgatccacactctcataatccttaaacagcgccatgaatcgtgtgatacgtccgttcagcgtgctgttcatcatctcgtataccacatctgcatgtgacaagccataatgcggaagtgcaatggattcgttgtctaccataacagcaatcgggcgctgatccttcagactgtcgtcaatcagctcgttcgtcagctcactgcgatattttccttccggaagaacctcctcttcctctgtgtccgcattctccgtctgcgctgttacctctgcctcgatctgctctgcgtcattctccgcgctgctctccgtggcatcgcttcctccgcatgccataaggttggcggatacagcaagcagtgtcaataatgtaactgctctcttcttcactaatgtctacctctcaatatctttattttctaccgggatatatctacagtcagatctgcggatatatctgattccattctaccatatctcaggacgctgtaaaagccttttttctacttaatccgagtcacttcggcgcggttgctctccgcaacaatatagtgcgggcgctgctttacctccatgtaagtctttgcaatatactgccccataattcccatacagaaaagctgtacgccgccgatgaacgtgatgatgcacgccgtcgatgcccagcctgtaaccggatctccgaacaccagcttgcgcaccacgataaagattaccgcgataaaagaaagcagcgtcatccccatgccgaaccaggatgctacggcaagcggtgcctgtgaaaaattgataatgccgtcaatcgcatattttaacagcttccagaagttccactttgtctctcccgccacacggttcacattttcatatggcagccagtatgtcctaaaaccgatccatccaaagattcccttggaaaagcggttgtattctcccatctccacgatcgcatccaccatctcccgcttcatcagtctgaaatcgcgggcaccgtccacgatatccgcatcggagatccggttgataatctggtaaaactttcttgcaaaccagctgcggatcggcggctctccctcgcggttcaccctgcgtgtcgccacactgtcgtactctccggatgtaagaagtgcaagcatctgcggcagaagtgccggcggatcctgcatatccgcatccatcactgcaacataatctcccttcgcattcgtaaacccggcatacatcgccgcttctttaccgaaattcctcgaaaaggaaaggtaggtaacgtgttcatctctttctgccaagtcctttaagattgacaatgtcgcatcctttgacccgtcattgacaaacaaaaactcatattcacaatccatccccgcaagaacttttgtggactcctcataaaaaatcggcaatgcttcctgctcgttgtaacagggaacaattagtgaaatcaacattttattttcctttcgtatgttacaataatctgcgaaacaccggcagcttcttcataaccaatgtcaatgccacgcggattccaaacagcacaaaaatctcaatcaaaaatgccggcagatatccgatatacggcataaacttctgataaatcacatccatgcggccgcccgccccgataaatccatcaagaaggtacactccgaacacacagctgccaacggttgacaggaaacgcttcaatccctccgggagatcctctctctggaacaaaagcttcaaatcaacaaaagtcacaagcgtgataagaggcatccacacaccgagatacatctcccggtaagtgcctccattcgtctgccagtcccggtataccagccgccaggtgattaccactacaaccagaaaagccagattgcgcagtacatttttccatccgaaaaacgactgttcctccagataccgatccagtccaaacccgatcaccggataaaataaggtggtctgcaatacccccgccacgctgaaatagccgcagagcgtatgatatccgaaaaagccgagtgtaatctgcaaggactccgttacaatctgcagcgcaatcagataccagaatgcatttttcggcatattctgtgccagcgggcgcaaaaaaggaagactgacaagaattccaagataactatagagataccagtatggcagaaatgccacatcaaacggcaatccaagcagaaaacggatcggcgacaccgatgcctgtccccgcacagcaaatttcaggtaatacagcagtgaaaaaataacaatcaccgccacaatacgcagaattctcttccgcgcaagttccccaaagctttcatttttcccaagcaggagcgcaccggaaaccatgtagaacaatggcactgctgccttacaaaccagggaaagaaaaaacgacaccgcatactgtacgccatgctgtgtcgcaaacgacataaacggtgccgagtgattatacatcaccaagagcaccgccgtaatgcgcaccgcctccaaatagtatttcttcttcatccttatccccaacgtaaatagattaacataaactggttctatgataccacaattccacttatctgggaagagtcaaaaacggccgcctctattctgttctaaggtcagatcccaactgtgttccgaccactcttataaggtatactccgatccaagtgccgcatacagcaccttcagtcctttgcgcttcttttctgcatagtcggaagccaacaggaaccgcaggtagtcctgcacctcctccttttcacaattcagtgaaaactcctcctttagcgcctctatcaactccgtcactgacatcggatgattccgatcccacaaaatattcaaaattaaattcgccttctccggcagtgtatccagcatgacacattctatcatccgtttactccccttttcttctttctttgtatagtaccttaccgcttgccttgtcttaaatgtatatattttatcccaattttttccaaaagaccattcgatctgacgtaaataaaaatttacgtcagatcgaatggtctttgtcggtaagtgctcctactattaagaaaaaatgaaaaggagacttcacaaatgaaaaaaatgattctgattgcagctcttacactggttctcaccgcagccgccgtaccgggcgttgcagcatcctttgcagaaaatgccggagtgagtgcatgcttcatctttggcgacatgattgaaggctattaaagttcaataccataatgtgatttgcaccagtcagccgctctgcacgctttctcatccagcttcattatctcaaacagggtaactgactgggtaaaatacttttttgcttcatcttttcgattcagttctgcaagtgaacacgctttattatatatcagcaacggaagcattactaaatttccgtattttacacagaacgccactccttcattgcagactttatatgcctgctcatactgttgaccaagagcaagccaattgctgatatcataaacaattaccgggtattttgcagccttctgcctgctatcaagaattcgttgttccatgtattgtttcagccaatatcccagttttaaagaatcttcctccttatgattttctgcatactgtactgcaatggcattaataatcattatttcatcaaacgtcagcagattgtcatataaaggcgttttcccatcaaattgaggtaatgtaatatgaaccgctttcagcaataattcagtcacttcttccgactttccctttttatgccgcaataattcagcctttgcaaaataaaggtactggcgctctaattgtgatgttttccttgtcatatcttcaaccttttgaatctgccgttccaattcttcaaaattaccgtcagccatatttctgaccatttcttgcacgcgctcgtaaagttccatttcctctttgcttacaaacacgttaaatacactattctccatgccaagccgttccatcagtttatctaatatatatctgcccggtgcctgcatgccattctcaatgcgagataatgatgctggtgtacaaatgccataactgacttcttcctgtgtatatccctttcgtattctggtctctctaataaaatcaccaattatatatgtcgccatttatttttcttaatcctttttatccgtaaatacccaaaacttactgattacataattaagcacgatcacaatcacctgtgcaatcactttcacaaccatgctgttaaagcccagccaggtaataaataccagcaaaatgatctcttcaatcaccagtgtgaccacacgcccgccaaaaaacgaaagcatctgccttaaaaattctgtgatcgtatgtgtcggtgcctgaaatacccagacacggttcgttgcaaacgcgaacgatacagccagcacccaggacatcacattggcaatcagctcgttgattcccatggatacattaaaaactgcataagtaacaatgctgacaataaatgtcagcccaccaaagaacaaatacaacaatacttccttgttttttttataaaacggctcaaagatgttcaacagcggcaacgccatcatccggtcaaaaatatcccgtttctcctgcattcttcatttcctcctctactcttgtattgcttaaacgcaattttaagtatagcgaaatcattccgaaaatacaaggcaaaaaccgttttaccatctcttgggccacactatttcatacggcaggcaccttccgaaattatttttgtagattttatcggttgaaaataccgattaagaatgagacagatctgtctctacattttagactgaaactcttcaatagagtccgcgcgtgctgcaagcttaagccacgcagatagcacatcttcattctgttcctttgcaatgcgctcttttgtttgatccggaagtgttccaagatcttccagcagtgcaaggatgttttgtgctactcttgatgctgccattgactctgccattgacttcaccattgattccgccatcaattttgcccttcgctctgcttcctggtggatatactcctccattgtcatatagcctgcctccaatttccgatcgcgctttaggtatttcactctttcgtgaattttaagaattttctcatcctgatgtctgacagctacttcctctgtgctctgcttcagatactcaaacaaatgtagcctggctttaactgcttattcaaagcaatctccaatacatttctgcagatttcctcatcctgcatggctgccgcaaacaagtacgcatttgtcaaattcagtttttgaaaactttctcccatacacgggtacctcctctgtgggaagtgcctgcctatggaagtattatagaccggattacatttgattgtctattgggcgaaatcacgaattttctgtttcttccgcacataccccgatgcattttaaaaagctttcaaaaagtggcgttgtataatatacgtctccttcatatccaagatatgcgcccaccttttctttacaaaacccggttcttgtgacagcggacagaatatttttcacttcgtctttttcgatcccgcaatcttttcttatatcttcataaaatgcttcattgttgtatttatattgatgtaattttgccagaattgtaatttctctgatggacagttcttccagccgtttcagattctcctcatacaggtcaatgtctctgtcccctgccagcaaaaatgtatgtttaaataaattggcaatatacagcaccttttcattggttgccagccggttcaatacctccagcgtacgcgccagttccatgagaaacgggacatctgccacgtcactttttacaatcagctcccccgactctgtaatataacttaggaattcttcccgtttccttttctgaaacccggcaacctcctgttccagaagattctttgccagacagccgatccccggaatctcacccagcatctccattccactttttatcatcggatttgagaaaaaatccgcaatagcttccatgtcctgcaactctgtttttgccatttcaaaattttctttgcaagaatttttattttccataaattcctcacatttccggcacaaagtgcttccctttcccattaaagccggcagccaggctacctttttccccgaaaaatcacatccagcattcccccatcgccggcagtttcatttccgcccggcacaagccttccaggatcatcgttgtagtcatccggcttcgtccagtcttccagataagactcaatcaaactggtactgatatccgcatctccgggatcatacacaatctgtgcggcaatctcaaccggaaatttatttacgatccccatgatctcattataaatgtcttcacggatgtattcctcccactccaatgctacacttgaaaaatcacattccagagcttcaccattataaaaagtactctcctctatcgctgtattcacattatatccatcataatagtccgactgatccacgtccctggcatacgtttcaacagcattttgtaatccccgcacaaaacttttccggtattttgtaaacagccattcgccaccggtttttttcgcctcccgcgcgatcgtctgatactcccacagtccccgttccatcagaaaatcttccagcgtctcctgattcagtttcgctcttgtatgatagaacacgtccatttttttctgcagcaaagcgaacaaaatttcttcgcttctatctcctttattggtatagcagctccccggttcctccaggaatgcctgcacgaactccatatgacacatatcccgtatgctgttatcgcaaataactccaagaattttaccgcgctttgcttccaacatgcgaaaatgatactggtaaatccgcccattccggacaagttcttccacgcagccggggcagatccgctccagctgcacatactctgtcgcatatgccggcatatttgcctgctccatcggattctcccggatataatttttcaaaaaatcattgatcgatgggttgcatacgccaatgcgctttctgccgttctgttctatcatctgcaccatggaatctgtcaaccgtctcagcgcctcgtcatacagatttctggtggtatccatcccttccaggctggaaaggcgtttcaaaaatgctgccacaagaaccggttcctccacactcgtatcagtcagcgaatacaacgtcaacagcaacgcccgatcctccggtccaagttttctcgtaaattcatccttccatagttctctgggattctcgagacagtccataataaacgccgcataatgatctggtgcagcctgctcgtaatttttctttttggtgacaaactcaatcaatcgtggcgtgtaatttacatgcctgactatcgcccgataacatctgtccttagaaacattccggtaatattcctccggaatctccgcaaaatacaggtgattgtagaaaatcctgcccttctcttcctcatccagcccattcatctctatcttgcggatttttatattctcatcctccataaaataccggaaatcacacgatcgttcctttgcttcgtgaaaaatcgtaacacgggaattcataatcagaagcttggccgggttgcgcatgatatacttgaccagcgccagcagttcattttctttcgtctcctgcattttaaaataatgctgtcccaggcagtcatcaagaacgatcagttccttccgctccctgtcggcagagagtgcacgttttaaatctgccagttccccattggtcgtataccgtatccggtatccttccgtcgcaaaagccagcgcgagcatcttagtcaacatggtctttcccactcccggatcgcccaacagcatcagcatatgctctttttccagaagctttctgccttcctcgtaatattttgtcttcacaaaaagcttctgttccttttcaatccgatagaaaaaggcatcacagtcgatcgcgatatcctgattgccaagccgttctaaaacactggtcgattccagccacagcttataatgccgttccagaatatcagcgttctcttttttatgtagaaaacggtcaatctccatcagatccacaaccgcttccgcatcatccatataatctgaaaaaagctgataaatctcagaaatattgcatgccgtcagctttttcccacagcaaacataataatgctgcggctgtttctgttttaccttcgggagttctttctttaagctggagagcagtgtggggtaagggctgtcgatataatgtttcacctgcaccatatgttttcctgacagttttgtctctgtaatgtctacaccgccatcccttccgggcgcaaaacagcgaagcggacagccgatcttccgctccatgatatcccgacacaacaattcaaattcaaaatccgataaatttgcataatgaaacataatggtactttcccttgtcttctgttctcgaattatcagacagacacgtcccgaaattattcttgtagatcttattggctaaatccttccgcgctcgctccaatacattcttctctgacagaccgtcagaaaaaacatattctcaaataagtttgcaataaatatgatcttttcattggctgccaatcgctcctccactatcaacatctgataaatttctttttactggtgttttacattttcatactcacatgaaaaataagtatctactaaacctttatattctgtatcctctgtataataatgcataacctcatttttatcgtagtatacatcataacaagtcaacaccggaacatcttctgttaattcgtatatatattgataatatgaagacaatggaataccagctttttctaatagctgcggcatcaacgcggtcattcccaaaatgcccatatcttctgcctccatcccccaattactccaaataaaaaacggtgtgctgcacaataagagccgtaaattatcttttgatggatcacatacatcagaaataaaacttggcgaatgatctcctaccatcataataattaccggtcttgactccttttcaaaatactctgtcagcttcttaaatgcattatcagaatttttaatacatgtcagatattcattcatctcctcagtgtattccccctcagcatttaacacatgtacagtatcatacactgaatcatttaaattccaccctccatgattttgaattgtcagcatatacataaatataggttctgcatcctcgcattgcacttcataccatctaattaaattatcatataatgaagaatcttctgcaaaataccggtcgtgataaaactccagctcttcaaagtcctccaaaaaatgtatttgatcaaatcccatttctgcatatgctctatttcttgaatagttagaacctgctccactgtgcgctgcaatcgttttataacccaatccatttaaataacttactacactttctgctccattcatatttaagacattaaatggtgtaatattgggcataatctctaacgaattacttgtcagcaactcgtattcagaactattcgttcctccccccgcagatggagctgcggcatatcctgaaacaagatttcccattgaatgtatctcctgcaaatagtcctcatctgtctctatatccgcacccagactcaaatcataaaaagtctcattcagaattacgataatatccggcaaattgtccaattctgttagaacatctttgtctgtttgttccccatacaaaatatcttcagcaattttctcatcataattatcaggtttctgtattacattaaatgattttgctgcaatttcaactgtacatgccgcatatccataattgcagtacgcctcctgccacgaccatccaacaatctttgctggttttacgggatttgccgaaaagtaaccaaaatacatactactaacagatatgattacaagaataatattccgtattattttttccttagaaaatctggctctatgaatctcttttcctttctcaatcacacataatatacatattccaacagtcagcaaaaagattgtcgacgaaataaaatctggctttattttataggaatgcatcacatttaatgcggtagttatattgtgcaactccattgtagaaaacggaagtccatgatacataattgtataataattaactagcgatataacccctgtgaaaaccgaaaaaatgattcccgagatccataatctatctgttatgatcagcaatatcgtatacaaaacctgtaatgttaatacgttaagaatgatgtattttatatttaacgaaaaaagagtgtgtagctccgtggaactcagacttaattccgtacttattcctgagaccactatcaccaatatagaaaaaagcattccaatacttttcgatttcaatacttttttacacactgcttgtcacctcgtatcatttttctcttgacacatgccactgggcttttataacaaatatttactgttctgacatatcgatattatatttttgattaaactcttcgcttggtataagtgtaatatttatcattcgcgatataattccatgcttatacagactctgactaaagtggtttcctccatataaagcaatcggccaattatcctcattcgtcaaactttttggcacatataattccatttccgtcttaccactgcggacagcatcttgtatttgagcaataatatcattgtcaataagatatgccgtgttccagtcaatttctccctgattagaatctttatatgtcctcccgggaacattgatttcaaaaaacataatgcaaaccatcaacggtattattaaagcaatcttctctctcttttttatcccataagaaaaacaaaacaccattgcatataacaaccagaatgatattcccaacaatacatctgtcctgcagatatagtctggtgatgtctttgcgcatattagtactacgtataataccgccaaaatgaaattcaaaaaaatttcaacgtataacttcttaaactcctctttcgttgaacggttgatactgaagaaaatcgccatacacacagtcacaattagcattcctacaaataatccattgcatttttccttcaaaaaggagacaaataacttcagtgtggttattaaattatgtatataggagtcttcttgtaaactgtccgctcttcctccactcaactcataaatcatggatataaaccagaatcctagaattaataaataacccgtcatattttttaacgagattttcatatttctttttggagactttatttgctcgaatagctcaaacaatacacgcactcccgcccatattgcaagaatataagaacaaaataaattagaaaagatacacaaataaattgccagtattataaatgaataattccaaacatccttttgtccatctaccctcaccagttcaggtttcaaaatcagtatcaaaacaataataatattaaatattgttggaattgtataataaaaataattcgtacagctaaaggagtgaaacatatatacattatctgaatcactgcttctaaaaatgaggaaattaagtaataaaaacaccacagaaacacacgcggaccatcgcaatgacaactttattttaacagtcaggcttttcattacaaaataaacgtataacgtaatgcatacacttaatataaccccatacataaacgctatagaaccaacataatcatgtgtaaatggataaattaaatataccccaagtgatgccataaatggcattactatttcaggaaaaatccttgatggattccaatccccccagagtggaactgcctttcttgcatatgctacatacagccaatcatccgtatcataaattatcagaggatgaattcttatgaaaaaaataaacagtcccaaaaaaacaagtattacatatcctgccataaaaagccttcttctgttcttcataaaccaatcctccgtaatcagcatctgataaattatgatttcagcactattataaatatttttcagtcatcttatgaaatactctatttaacatcggttccagaaaatagcaggagactatagccacaccaagagatattacaaaatggattccccatatttctaaagttgaataatcaaagcattggtatcttctatttatcaaatcaaaaaccatatctgtcggaaaattccataaataaatagaaaatgaggcttttcccaaaatgcggaaaatcttcagaccggctattttactcaatataactgatgttttggcaagcactataagactggtacaaacgcacaaagaaaatgttgtattaatattccctactaaattaaaatgaaatgcatatccccacacacccagagagaaaatgctcataaaaatcagcacagatttttcatatccccgttcttcaaacctttcaaaaattatagccagtataatcccccaaaagaatcccaggtatcctcttccaaacgcattatttaaaaagggcatggaaaccacatcttcattataaaccagccatattcctaagattaccatgaaaaaactggtatatagcagcttttctttatctaaagcttttgtaaaaatataaaatagagcgtaacagacaaatatcacggttaaaaaccatgccggagcattaaaagactgacctaaaataagtcctggcattgcctgtagacccaaaatattcattactaaatgatgaagatcattgatccacgttatataatattctccatacttcatataattgtattgctgcaccacaagtgctactgccgttgtaatccagaaaagcggaaatattttgcttattcttttaaagaaaaacgcagaaaatttaacactcccactatgtatctttgcaaaatacgcataatacataataaacccagatattacaaaaaataactctactcctaaatacccatacaaataaatattagaaaggaaattgtgtccactccaggtctgtaaaagtgtgactcctggtttttctcctccaaattcatttttataatgatagaaatatgcaattgcaacagctgcaattcccttataagcatttatagtatttttccactgaacatctttagtgccattccctcttgccatagttgtttgttcctctacaaattcataaattcatcataccttttaagaacagcatccgtatcaccaatctccaccagacttccatcattaatccagataatacggttgcaaaatttctttagcgtgtccgttgcatgtgaaacaatcaaaaccgttcgattgctaagcataagctccgtcatttttttgtaactcttttttcggaaatgctcatcacctacacttaaaacttcatccactaacataatatctgtatccagaatagccgtcaccgcaaacgaaagctttgaatacataccgcttgaatatgtccgaaccgggcggtctataaaatcccccaactctgaaaattcgataatctcttccatatgttccttcacataatcaggcttacatcccaagagcatccccgacttcagtatgttctcacgcccagtgttatttccattaaatccaattccaatcgccatcagagaaactctacgattttttgtgtcaatcgttccctcatccggctgaaatattcccgcaatagaacggagtaatgttgtcttaccacttccatttctaccaatgattccaacaatctcaccttcttcaacggaaaatgaaacatcattcaccgcgcggacaatatctgccttttttacacctttgtttaaaaaactctggtgtagtgacatatgcataagattcttataatctatactgacatgatttacatctaaaactatttctcccatttataccacctttacatatgcattttcattcttatatacaatatggattccaataatgctgagaactatccctataaggaaccatattccaatctgtagtaaattagcagcgtaattatacagcagagcattgcgcatggtgtcaattacaattgcaatcggattacaatacatcatcactatgttaaacggctctggcaatgttgtgtttacctcgtaaaaaataccagacaaaaacatcagcatgtttaaaagaataccgactgcatatgacaaatcatctacaaatactccaaagtgcataaatatcattcccaaaccaaatgcaagaagaatcataactacataagctggaattacccagaaaagattgattccaacctgtactcggaaaacaagcatcatacaaacaagtacaatgagtgaaaatagcagcttaaacatatttaaaaacatattcgacaacagaatcacaaacttcgggatatatactttcgtgactatgtctttatttgtacgtacaagcttcacactatagttaaccgttttattgaaaaaattccacatcagtaatgcactaaagacaaacgtcgcgtaattttcgatgttattacccatcatctgcccaaaaaccaacacgtatacgatcatattaaagaacggttccaaaagccaccacaagcggttcagataggagtttgctacctctgctttcaaatctgtctgtgctgaatatatcatataatatgcgtattttttgatatctcccaaaaaacgtctggtttcatttacaacaccatggttgtctatggtatctttctcaacaaaacttttccctaaaatatacacaaacgccatgattaccataaaaatctgaagtaacatgattcgctcttgaacgagagtagctgacaatgcctgcaattcttttactaattgatcattaatcacaaacgcaattccaccgctgcccttaagggtaacgcttgcctcattccactcaatatcaccatccttaacctcagtaatattgcgacagaattcaccatacgtataagtttttaaataaatagacctagtatagactttaatctggacaagatcaatttgctccagcccttgaatatcaaaattctctgaatctccatatttgatgtcataattgctctttgacacaatatattcatttttatccgtatccacaaaataaaaatccagattccgattatcaaacggatatactactattaccgcacaaccgattaatacaagcagtaaaaacacaaatcgaattatttgaaacttttttttatttttcatgtgtttttctctctttccttctttactaattatttctgattcagttcagtctgaatcaaggccttaatctgagtagaacttgtgccttctgtatacggaaaaaactccatattcgatcctaccgcgcgaagtctttcacagatctcattccagtcttccccgtgatcgcttcccgaaaaatgacaatcatagtgataaagattccatgcatccattttatctgtattgctaaagtcaactggaaccactttatctacatacttaagtgctgcaacaatttctgcccgttcctgataaggaatatagggacgcttatgcttataatactccaccaattcatccgtaagcacacccacaatcaaatattctgaacgctccttgcaacgccggatcaagttcagatgtccaatatgaaacaaatcaaaaacacccggtacatatcctgttttatacgctttttgtatgttatctgtgttctgcagaatcattctgttttcctcttaactcttactttatattgccctactcctgaaatacacccgaagcccactctgaatgactgggttttctcttatcttccggcggcaaagacatataatcccaataatgcattttcaagaattcctcataattctttggtgcctgtatcatatgaccatgcactggaagtgtcgttccctcggcaaaccactcttttgggaatcgccatggaatacaataaatccatccattggattcaaaatagtcctttccctcttttttgctataccatcttctggctctttcatacatccagaatatcaacccaagcggaatgtactttcctattgtactaactcttttaatcagtttctgacgtttttcctcttctgtcttatattcatcatagtttacatacgcacgatgtcccatcgccagaccatacaatccctgaataaacatcgtaagcctcttatgcttcttctcatcatctggcgcattgtctaaaatataaatatctatcggcatatgattgtctatatctgtccgtcccttaccacgaatttttcggaagacgtttacaggaagttcctctcccatataaactaatcgtgtcataaagtcaaggaatacgccttttccaagttcattataatccacaaacacaaaatccccttcagaccattcctctttaaaatgtttttttaccttatcaaagtctgccctggtcattgcaacatcaacatcatcatcccacggaataaaatcctgatgacgtactgctccgagcaatgatccacagatcaaataatactgtacatcatacttcttgcagacacgatcaaactccaaaagcagctttagtaaaacctcgtgtgctttctctaaatattcttcctgattcataaatatatcctctttctattcattattttccaacagccaccaaggattatatacatatatctggtagtcacaaatctcatgctgccgcaaacatttctcaattttgccaaaataacggtcacaaattataatctgcctctgttccacagaaatgctctgtaattcttcataggataataccggatatccccagaactgctgttccagataaccctcatccactaccccaataatctttatatcattttgatatttaccgataaatgttgctgccaaatctgaagtacccatgataatatagcttttttccgttgatttgtctacataatttaccaatcttctaagataaagttcatatttctcatttggtctgcataatatttcatgcttaaatacctgttctggcttatctggtatatccatatagtgctcaccataaaaccattgtaaaagaatatctgcacgatccggaatgcgaatatgatctccttcaaaaggtacaatttttccctctccaaaaaagtctctcttaaatccgatgtactttccccatggctgatatctggtcataattgtaacttcatccgacggaagtgctcctttacacttttcatttaatttatcacacagttcttcgtacttatacgtctcagcaatttttttatatcttgaaaattcttctggatccatgccccgaaatgtttcttcttcattataaaccttcgcaaacatgatcttctggatttccgaaatttctttccagactttctccaccttatcaggctctggcatatcatctaatggcataatatccatccagattccctgttttttttgcgtattccaatggtatatttcaattgctgtcgacttcacataccgcaatctgctatacccgccataaaatccctgatcatccgactgcattgtctgcaggaaaaagtcttctccaaattcttcttccgccacagcaagcagcttgtcgtaatccgatctgaacatcaaaacatcagtgtcatcatcccacggcacaaatccaccatgtcttactgcccccagcagtgttccaaaaaatgcataatactttaatccgtatttttcacacacctcagacatcttttccaacaatcggagctgtaccgtctgtgcctgtttaacccatagcggaatatcacgaatcttcttctcatcaatatttgtggcaagtctgtgtgcgttgtgatatattttaaattcatctgtagcactccagcaatataactggtgattttctctgacatttcgaatacttcctataaatctttcttcttcgcgttcaaattttttcaaacacttttcaagcccgtattttcgtatcagtttttccttgggaatcagttcctgcaattcccacatggacatatatgtatattttattgcgcgataaagcacatactttgccgaatactcttcttttacaaactcctgatcaaaaaataccagtttatgatctatcacaaagcagtttacaggtgtcatatcaaaataacatttctttaatatcggatactcctcattttccaagcaattctcaacaatatcagacgatttcaagatctcatgatacaataaatcaaacaattcaaaaaaatattctttgtcatttaccgccgcctctctcaaaacagctgacaacgtcggtgcctgaacttcaggcatcataatggaacctttttccatttgatgctcaaccacatgaattccacgattcatcagttcgtttatattttgacaacactgagccgcaacagcttctccctccataaatactggtgtctttctcacaatgtgcctgttttctatggcagttgcgaagcttctcgcttttccccgatccattgccacaaaagcttccttaatatttgtttgcgctacattaacagatgcctccacaaggaaatcgtttgccatatatccaagtgctccattcttcataaaatcacgcatcaggcacttttctctggcaacaagtgtatctggatctctgtcataaaatgtaagacgctcttcaaaatcatcccagtccctgctctcatctgttgcaacagcctgcggataatctgcatctggaagcggataatagaactttttatgtgcaaatccactattttccagcaggcttgacacttcccccttctcaaatccatatgcaggtgttccgtctggatactgattgattccctcatatggatatcctgtaaatttttctcttttaccacagaaatactgcaggccatacctgttattaaccactagcagcaatatccctgtaggtttcaacatcttctgaatcagattcagatattccaaatacgctttctgttctttatacccatacccctttcgttctaataccccgtttattacaatataatcaaagcggtcataaaactttgtataatcaaaatcttccaatgctccggcatatactgtcaggttctccctgtcgttatatcttttggcaattgcttttgctctttcataacaggtttctgtcactgctacttttttgcatttgtcgcaaaataatcctgtcaatgccccatactctgcatcaatctcaagtaattccgcctctttcttaaacggataccatgcaaataacccctgccgcatgacactcaggtgataataataccaccaatccttttcctgactcaacaatttatccagcggctggtcttcctctatccatttacatattttttcacgctgtaaaatgctctcacctgtatagcgttccgctgttccaatcgtatgtggattctgttcctctcttctttgttgataaaacgctgtctcaaatgttgccatttactactgctcctcttctgcatagttcggaagccattctgatgccagttccaccaactcctttaagttaatggctcgttcacctccatacagcacatcatcgaactttacatcactaaaaatagtcctgtcatcatcattgttatagcgcaaaaatccctccataggaagcgccatttccgcgcatttatatgggaggtaatccaacacttccccaaaattatgatagaattccttcacaaaatccagcgctcctttgtgaattgtttctatcaaacctctctctttttctgtcatatcatcctgatcgagaaccggatgatattccgctccttcataaatataacctacgcaggttggtgctggtgcagaaagaagatactctctcaggacatctgacatttgcggtacaaaatcaaaaaaactatatatcttaaactttcccctgcgctctaatctgtcgtgcaatttagaatcactgtgcacaaacataacatcgatcccatctcccgccaattccgaaatcgccgcctgtattcttccactataccccatgtcgaacattatactatccgaacgaatgcgatcataataccccctgatgaatgtaatacttcgcatatgcttttccctgctataaaactcatccaggaatatagtgatcagtgaaatcatctgtgcatcactttcaaacagatcatctatagggatttcttttttttcacaaatctgcctccattgctctatatctttgtccgttgcgaactcgagcaattcaaataatttccgtggtgaataacgtgctctgtcaatcggcaaatcgtaaaaatccatcttttctttcaacatcgcagacagtacacactgacgcgaagtgtaaaaatattcttcttctggcaactctgttcggtattctttcataatccggtatgccagcatagggagatatccatctcttgaggtaaaataaatcttgctgtactttcctctaacagtttcctcgatccatttattcaacgctatcaaatatgagccaaccagataatatccgacaacatacggatcctgattcaacaatgaccgtgcactataatgtatatatggattatcaaaacatttatttgcaacctgcgcaagcatacagcgataacctatggaatccatcatcttttcataagaaataaatccgccacatagttttttagtcattacacttgcaacattttttccttttatataatcatgatcatcaaatctggataatgcagatggaaaatgatatgcagaaatcccttcctccatcgcacactgcacatcttttacataattatctccaatatgcagaatttcttctggtttcacctgtaattcctttattacacacttatataaattacctgttcccttaagctttctgtattctgaagaaagaaacagttttaaatatccatcatatccgtttttcaacagaattttttcgactgtagcatgatccaaatacatatcagaaataaaaataatctgtttctgagcccttctggcaagttcaaaaatttcttttccagtatctctgcacgacgtatattttatttccagttctctttcaaatgcttttagtttatctgccagttctggtgctatacgaaacatttccactacattatcgtatatttcatcaattgtaatatcctctgtcatccccgtgatcttctggcgcaaatctgcctctgcaagtttcctgatttttgcaaagctgatattggtttttgcatttttttcgtattctatatccagaagatcaaataaatcctgtggatcataaaacggtctctgcacaaccgtatcaaaaacatcaaagctgatatacttatattgggggtcgaatactgctcgttttaattcgtccaaccgactgtcatagtctcttacaccagtgaactccagatctaattgcccacaacggtgataagacgcatcatatgtgtgacatattttcatggcatcccagtttattctcgcctgaaaaattttattccagacagccgaatctactatgccaatttgtttttccagaatcgtcccaccacaaaccacatctgctttatcactgtgttctatcgcctctatcatctgctttagataatcaatttcgatccagtcacttccatcaatacatactgtatatttgctggcagaacattttgtatcatatccctgtccaaacatcatattatcatttgcattttcggtggaagtcatgaccgaaaatcttccatctatcaatgactctatctcgtctctgttaacggcagaattttctcgaagcataataaaacattcatataattcgtgtgtctgacacgttacactttccagacatcgtctaagctgctccgtattaccatttccaaaaataatcactgtgatcttaatatctgaatacatacattttcctttcacaatctaaattgaggctctagtatcaatttaaatacatgttttgcaacctcgtctttgccaagttctgctctgactttctcgcaatccttaaaatcatctaagtagcgattgatcttccagctgattcggtcaagataatgttcaatcgcatatcccactcctttgtcacgtcccttatgattccaataatccagaatttcaacataggtaagaaccagtcccgtaatatggcgtgcagaaattccactggatgtaatcgcattttgtcgtatgcgataataatgcagggtttcattgatacaggcgacacgctctgcctccataagggaaataaacgtaaacaataaatcttcatgcaaaattccctcatagtatttaagaccaattcgctctaaaaaacctcggttccagaattgaagccagactggctccctaatatcatcattcttcctcatttctcccaaaaactctgctcccgtcatcaagtcaggatactggacttttgcctgaaataaatctgttggttgatccacatccgcattctcataaaacataacagaatcaaaaaaaatcaaatctgcttgtcttttctgtgccaccgtatacaaacgttccagtgcatttgcagcgattttatcatccgaatcaagaaaataaatatattctcctgctgctattttcatcccctcatttcgggcgcctgacaatcccatatttctttggttcttcagtacaatgattctggaatcttttgcagcgtattcctccaagatagcttccgatccatccggagactgatcattcacacaaataatttcaatttccctcaatgtctgtgccaggacactgtctaaacactccccaagatacttctctacattataaatcggaataattactgatactttcttcatattctcactcacctgctattatatattgatctattccattatccactaacgtttgtttcacttcatcgattaacttcgctcccacgcctatcaatatcacataattatcctgttgacgttttaattcatccaatccatagacagcaattccttccagctcatccggattattttccctgtctgttacaatcacgccattaaagccgactcctatctgtctaagataatttatgtattttcttgcaaacttccctgcaccataaacatatcgtttttcagcctgtgctaatctgataagattctcctctgtaaatattctgtcctgtatgtataatttctggcttgcttctggctttgcagcttcctgctcctgtttaatgaccggtcggtaaataataccaagataatgactataaatgctgtcttccccccattcctgctgtagctgttccaccgtttccgacatcttctttaaaaactcattgatctgccactccagaccgcatatgatttttctggaaatccggttgacatccggtgtctgatgcgcattccagtacgctgtaatttcctcaataataataagcatactttttatattatcagctctgactttccccaatgtaatcgtatctgtatgccgtctgtatttatggtatgtttttggtatacatgctaccctttccgccatcatcatagactggtacgtaaataactcatcttcatatatcagcctattataaaattgcatgtcagcatctttaagaaaagcgtgcttccagaactggagccagacaggaaccctgtagtcattacacttctgcattttatctgccagttcaatcccattatacacacgctcttccccataattttttttggagcaaaacaatctgtgatcctgctttgatgcatctccttcaatcgtcatctccgaatcaaagaacaaaacatctgtatctagtttttttgctttggcatatagttcttccattgcttctggcacaatactgtcatctgagtccagaaaatatatatattctccctctgccactttcattccgtgatttcttgtatatgacaagccaccgttttgcttgttatttaaaagaactattctggaatcttttctggcatattcctctaatattgcttctgaatgatctgttgatgcatcgttcacacatattatctgtatatcctttaacgtctgattcaaaacactgtccagacattcccctaaatagcgctctgaattatatacaggaattattattgaaactttcatcttcctacactccttcattctcccaaaactgtatattattcaactctaatcgtaccggctttttccatataatatatttttcgtcaattccggcacccgtaagggtctttttcccttccatgtacacttcttccgtaggcgctgccataataacagtatcatatgtccgctctgttattatggcatgcagttgtttttgctgttctttctgtggttctgctgaatcgatccatgcgatcagttctctttctgacaacaccgaaagctgctttttaaaatcttttgcaacatcacccgttccatatagaatgatctgacgtgctgtttccagctcatacaacggcaacgcccacatttctcttctcgcataaataaaatcataatattttttctgccactgcccaatttgaagttcaagccattcactctgctgcagattgtatggtatatcaaacagcagctttcccgcatgattcatcagacttatcatatagttttttaactgctttaacaggatatctgcacactcatgctctgcaaatatatgatataaatactcataaaggtaatacatattatccagcagaagcttatttcttcttcccgacactgatgttgcattcatatacctgtaatagtataatgcctctcttaatataaccacttttcttgtctgcagcacagtctcaaaaacggttgccgcatcttctccataaaaaatgcgctgatccagatttgtaatgctttttcttaccatttcagtcagaaaaagctttccccacagagtcggccatatcccccattcttctaaggcacccttataaaacatcttttcaaagaaacttttgttcccctgcagctcatatacaccagcctccagggacgcatagtgttcttcttctctgttttcctctacctgcataaatccacaggaaacaaaatcagccccctgttcctcagcaatttcaaccagccgctcgacggcattctccggaatccaatcatctgcatctacaaacaaagtgtatttaccgcttgcaacattcaagcctgctttccgggcacttgtcacgccgccattctctttgtcaataaaacggattcgctgatcttttttgccgtactccctgcagatttccgttgtatgatctgtcgaaccatcatttataataataatatccagtgccgtatatgtctgattcaacacgctctctatacattttttcaaatactgttccccattataaactggtattataactgaaactcttatcatcactctgtcttcctctaaatcataccattctctaattctacagctgcaaacatactgtcagagccctttaccggctctttccatacgatttccgattcccatatgccaagctttttcaaatcgttctttacttcctgtacaacatccggattttttattgccaccagaatatagtcatactcacaatcgtgcagattttccggacgctttaccccttccgcctctacgtttttatcaatccacattgcaagagtacaataacttgataattggagttgatggacatatgcctttcctatattcccggcaccgtaaacaacaattctgctgcctgctggaaacatttcaaaaggaaatttccacaagacccgttcgtaatgaatctgaaacatatctgcgattgccttattattcaaaaccagtacatattttctcaactgatgaatcaatgcatgtctgtcttcatgttgcagaaacctctggtacagtccatcatagaacagacaattattttggaagatacgttcatcttttcttgcggaaacggatgtatctcttgtgacataatgataccaacatgcatcctgcataacaatgcacttcgcatccagacagcacaaaaatacgcacgctgcatcctcgccataatatattcttggatctatcgtctctaaatttttcaataataactgtgtacggtatattttgcacaccatacccaatattatgccatgtgtatcttctgaagaaaatatcatcttagaatagaagcgatgcaatgactttcctttatatactccctgctgaattccgtttctccacacccatggacgaaccggctcatcaacatacatcccggaagctacaatatctgcctgctcacgctctgctgcctccatcatttccccgatcattgccggttcaatccagtcatcactgtctacaaaacatatgtaatcacttgttgccgctctggctccagcaagtcttgcactgttgcttcctccattttccttgtggattacccggattctattatcttttccggcatatgtgtcacaaatccgaccgctggcatctttagacccatcgtccactaaaataatctccatgttctcataggtctgtgccaaaatactgtccacacacttttccaaatactcctgtacattatacaccggtacaactactgaaacacattctcccataaccctttcctctcaatgcacttttttataatcaaactaccccaattcaatgacctttcatgaatcagggtagaacctatacctaacatgcctttattctttttgtaaattcaatatcacaaagtctcccgtctgtccagctgactcaatccattcctttaaatcttcatttacctcatcattttcaagtatctcttcggacaattctgacggtatacaaacataatcggattgtccaaaataattatagacttcttccacactggtgcaccggttcagatatccttgtattgtatccggcctatataccataagccaataatcgtattcactgtcatcacgtataattactgcagacttttccggcaccaccgaatactgttccgtatacttctgttcatttgcaagataagaattttccccctgctcaaaaccatttatacacattgtaatgcagccgcctgccaatatcagcatcaacaacccttttagtaaattttccctgctctttttactctcttttctttcaccgatggtctctaacaatcccacacagataagaaatgttgccggttcaaaaaagcgataagaaaacgtatccattgatgaaaaataacggaatacaatgattacaacataatatactgctcccgtaacacaaattaccgatgcttctgaattccatgtacatctcttccctacatatctaatcaaggagtatacgataacggcaacaatagcaaatttaaacacgaaccatatatttgtaacaagaggtgacgcatttattccaaacacatgaaatatctctgtaagcagactatctgccagatcttttgtaagctgcagataatcttcattcggatttattccgcgattcacaccggaagccattccgttcattttcttattcattgccagatatgccagaccaagacatcctgccacgccagccgatgcaatcagtcccgccattttacgaaccttctgctgatctctgttttttatatagcaaaagccataatataatatgtatattccagctacaaaccacacatacaatcctatataccgcgtaagaaatgcacatgtacctaaaacgcccaatcctgcataccaaatgacacctgcatgttcctttgaaacaatatgtgcaagaacaagcgaaaagccaaataaaaataaaataaacgtgcattcactccatgtatattccgcgagattgataaatccaagattaagcacacataaagaataaacccacgccttttctctgtactgcaggcgcattatcaccaaaataacagcgatcaccaacattgctgctattttagatgccagatacacatttgttttggcagcaaccataactaacgctatcgtcaatggatacataatcggccagttggcaaaccatgtaccatacccggcaataccatcacagcgaaagccgtttccctgtgccagatttaatgcttctctcagatatccgcaggaatccggagacatcatcgtttcgtgcagatatgcatccacataaatccgcattgccatatacaaaaaaacaaacatcagaaacacatcgcctgcatgtttctccaaaattgtgccaaacctcttcattacgccagttcctccgcaagcttcattgcacgctcaactactacatctgaattaaaatgggaatgttctccccatcgtcctaatccataaattccattctgctttgctgcttttaacagcttatccataatctgcggcttatcaatggtattcaatggatatgcatactcgttcaaataatgatattctttattttcaatgtactccgaggtacgctcttttctagtttccagccagtatcccttactatctgtacaaaaattatgtcttactaaaatcctgtgatacggttttgttttatccggaatatagatccattgtgcatctgtgtctaaatcttccggtacatacctggtttcaatcgcactgtgttttaacctctttacatcagcactcatttcatccgatatgccatgaatattcacaaaagaattccatggcgtagtctgaataatcacctctgctcttatcttttctccattatcgagtgtaaccactctgctttcaaaatcaatttcagatgcacttacgccgtacatcatctgatccgctatagcttctgccatccgaagccataactccccatatccataagaccgtggataataaaactgtgcatgtcccggttgcgttccatacggcttatgcatcagacacgatctaagcgtctcagaaaagcttacatttggcagtttttccagccagtaagttcccagatcattcagttcatccgcaaacatttttttattgtatgggatcatatagtcctcagcgattttatctccaagcttccacacaatccaatcaacaaaatgctccggcatctcctgttcctgattacatcctgcttttgcaatcgactccagataagcgatctgctcatccactccaaactgccaaatatttgcctccaacggatgacctaccactgttccatttacatcaatgacactgtttctctcaaataagttccattcgtcctgcggcatgaactgaaacaaaaattcatttaccttcggtcttcttacatcaaggaaatgtcctccaccgatatcaaatgcgctcccatcgacctccacgctcctgcaaaggcctcctgcttctcgctccttttcaactactctgaaattattttcacctctctgctttattctattagcaaaagcaagtcctgccggtcctgcccccagaactaaatacttaacattttccatcttttgtctcccttgtcatccactttatttgtgttttaccatgctctcatttttctttaatttgaacaggattttcaatgcctctgtcaccgagcttcccttcaggcttgatgaaccaccaatataatgaattggcacctctattgcacgtttatttctgcaataatatctcatttctgtctgatacatatgaccatgagataaaaatgcatccaagtccatctcctccagcaccggtctctgaaatgcttcaaatccgcttgtcatgtccttgagtctggttcccaaaacaatattcgataaaatggttcctcctttactcaaaagccttctatataagggatgattctcaattcctcctccacttacaaagcgagagccccagacacactcatatccttcctctaacttttcaataaactgtggtatttccttcggactatggcttccgcctccatccatttcaataatacattctgcaccatcctccagtgctctgcggaatccctccagataacagcttataactcctcttgattctttataaaaaatacattttaccttatctgttattttttcccgttctctgataatttgttccgtgcgatccttagaataattatcaataacaggatatatgtataaattatcatacggaagcgctagtatctcatccagcaccgctcccattgtttcttcttcatttgctaccggcattactataatcgtcttcttcattttacttatacctctttttgtctcatttatttatctctagaatcaaataccataacgttctcaaatccctgttccttcagaacccgcagcatgctcccatgatgtcgttctactgctgccaacagaaccattgcattcttattccaggattttaaactgcatatattctttatatcatacccctttattgttgtcgagttgttttccgggttggtaaccgctacagcacttatcctgatcccctcctgctccaaaagttctattgcttctcctcccacaatacccgctccatatatgattacttttgaggcatttttcaatcgctgtattttatcttcgcttaaaaaagcgtacgaaaatgctgactgcctctggagccacattttttcatacaaataggcatctgccgggcttcccagagagattctctcatatttttcaaaatatatttttttctgcaaaaatttgcgatagatactatctaaatatgtcctgatagcatcatctgtctcatctgagaacctgtgttccttccaataatgcagaatttcatcaaatattataaacagcgattccacctgtctgtaactgtgggaatacataattgacccatctctcttgcgatatatataatactccctctttaaataagcaattttatctacctccatccatgcatagaaagagaatagattatcttcatgaatcaaccccgggtaaaattgaatgccagtctgtaaaagcttctctcttttccaaaaatatctgcacgcttccactttccagtcacggatctttgaaaaagcacccagcaattctcctctgttataaattccggtttctatgtcctgtgtatactgaccctctgtattttcaagcttctccctggctgctctgccttctaaaacggtagtcatattaaaaagaattgcattgacctcatgctttgacatatagtcacacaattctatcaatgcattctctgccagcagatcatcagaatctacgaacatcagatagctgcctctggctgctaacattcctctgtttctcgaataagataatccctcattttttttatttttcaaaatgacaatgcgtttatcttcctgtgcacatgcttcaagaacttccaaagagccgtctgtagagcaatcctccacacaaataatctctatttcttcaatattttgcttctgtacactctgcagacatgctttcagatagttttccacattgtatacaggaataataacgcttacacaaatatcctgattgcctgtttctctgtgagacattctcaatttcctttcagcagcctgtgactttactgatattccctatgtgtccgatacacatactctgcgaactcaaagtctatcggattatcaatatccgttgcctcaatctcatcaatcccccaaataagcggactctttccaactacattcttacattctatcatccggtctctctcaataatattcagcgcaaaattcaatgcgtaaatatcgggaagatcctggctcctcggctgccttcccaagtcataattgattggtttaccatctctgaacataaattccttgatcaaatgtgcggaattaagcgaatcataatcttctgaccgcatcatatatgtgttgatcgcattctcaatcgtaaggctacgcagcaacggattggtaacattcgcatacaccacaatatctccgtcaaagttttcagccatattcttatatacctctgacattgatacactatttgacgcaaaatactcatctctttttaccgtttcacatcccatacgcgccgctgcttccagcatcttatcatcatttgaatttacaaccaccccatccagcgatctgatacttaaaagctgccgtaattttatttcaagcagactgctttctgcaaatgggcgcacatttttattctgcaccctctgtgacccggaacgcactgcaaccaacgcttttattttcataataatcctccgtcaaaatattttttgaggttctatccagtagatttttttctcatctatgttgtactttttcaaattcgtcctaatattctgaaccacattttcacgtaacactgctattagtatatagtcaaatgatacatcttctatcgccgcaaccggcattacatccaagccttcctcctgatattttctatcatttgtgtctacccacaggataactttcttctccggcatctggtcaaactgtttataaaaatttctgccaacatttccagcaccatacaaaataatgctgttaccttccggcagcctgtccaccggacaatagtatctggggatcaaatccttttcaaacaaccctatcttcctgtttaatccgtaaataacgctatccaccatatatctgtctaactgcctgagcagatattcctttttttcgtgctgttcaaacagttttttcgtgtatgtaaaaaaatatgtcatcttaatcaaaaactgttcatctgccgaggtgcataagctttcctcgtgaatcaaataataatattgctcactctcgataaaaactgttttccacgcattcaacatggaccagaacataagtgcacggtcttcagcatattgtatctgatcgtctatatcctgcattcccttttctataaattctcttttatataatttaccaaccagatacggcagcacaccaaattcactggtttctttatagtagaacatatttgttattatagtctcagcattatgtaagtatgttccagcatgtattttattctttattgaaatctccccgtacgggaaaactttcttcacattcgcacatacaatatctgcatcccctattgctgacaccatatcgctgatataggataatccaacataatcatctgcatccacaaatgcaatgtattcccctcccgcacattctactcccttacgtctcgcactggtatttccaccattttccttgtgtattaccttgattcttgcatctttttcttcgtatctatcacagacatcctctgatccatcctctgatccatcatccactaaaacaatctctatattgtcatacaactgcttccgaatactatcaatgcacctctccagatacggttttgcattatataccggaacaattatgctaaccaagtttttcctcatttccagcttccctcaatatttcttccagactctttcttttaaatacttctaactttccaccacgagtcgcattatatattttaatgccatgtgctgctgcatattcttccgctgctctatatgcaagttccgctttctctttaaaataactgtctggctttatatttcccttatagtaatccttgtgaaaatgatttgacgtatcagtctgtttccgttcataattatggtctgtacccagtaaataaatttccttaaatcccatatagcatgcaatctgaatacatgtataaacaacggttcttgccgaatatgctctgcgttcaatattttccgaaaacttaggtatatccggaaaaaattccaaaatatgatcatgcaagcgataaacattttccatatttcttttaattcccacctgatcgccaagaaatttaaccttagcatcacatgcgtatatttcttcccggtaagttgtcatgattttatcatctattacaacaagaaaatccgggcgccattctgtctgttcaaacgcaaggtatatcctgtttaccccaaaacttttgcagccactcttcttcaccagatccagatcacccgatgtaatgctcggtcctgttgcaacaataaagcacttttccccctcacagattcccttaaacttttcaagctttggattataataatcctctataacattagaaaaatcaaatatctgctctatttctttctggcttttaaatccacatatttttctgcatgcccagagaacggtctcttcagcctgtatctgtctttcttttacaaaggaatacttctgcgaaaaacaatgacttctcatattcttttcttccgggataatatccaatccttcaaatccgtattttttcatcaaaaattcccgcaggagcattgtatacagattgagtcctaaaaggacatatgtattctctttttttagattaactggcaatttatcaacccatgttccttttccatagccaacgatttccggtggacagtcttccagcaaatggtaattgtatattccatccctttcgagactctgtataatttcagcattatcatctactgcaattacaatatcataatctttaaacatccctttatactgttcataagagatcattggtatatcagtctcttctgatttatcattccactttttatctatgatagaaacaatatgacccggaggacagttcctcataaatcgcttgccacgcttcccataaccccataatacaaattgatacatgtcttttcccccgcttatatccactcacttatttttcttttactgattccccattctaaatcataggtatatcctgctatattacaatatcggcaaaacggtatcggctttttgagaaaatccaatatttctttttcgttttcaacttcgtagagactgatagaatttctatctccaacatatagatttttgtcaaaatactcattaaagtaatgtgcatgtgccgctatgggacaagtgtaaattctcccttctctgacagtaatgcactcatttgcatgccaacacctgatgtagttttctgttccatccaattctccatcttccactaatggcaggtgatatgtcgtctttaacaccatggacgacaaagtataaaaatattttacaccttcctttttcattttttcatctatcaatgcataatctacatcaataggatattttgtaagcgtcaattcaatgcctgtagctctcaatgcttgccagaattcttctttctgctttagtaataacgttccatttgtgtctaacgtgatatgtgtatctgggaaaaattttcttgcagaatacaaaaatgctacaatatcaggatgcagcaatggttcaccgccaattaaccagattcgtccgatatttccctctgtcaaaactgcaattctcgccatatccttttcaaaatcttccagctttaagaaaaacggtgttgctattggagaaaaatgattacaacacttgcaattcaaattgcaatgatccacaatattaatttcaaaatcaagtcttgttctacgaatctgcctgataaaaaacgtaacatactcttcatctgttaattgcatgtttcccgctgtttctttcatattccctgggatacccaattcttcgtattgaaatatttcttttaaagtctttattccaacatattttttttctgacacgttctctaaattcttattgatatcctctaagaacttttcctttacagaaacaataattgttacttcttctaattgaaattccgacatacacttaatcggtattcccataaaatcattcatatgatccgcatgttctgaaaccataaaaccaagaatgttcttttcaagtcccagttttttcagaacacaatatagtccctgacccaaaacaccagcaccatatatcacaatattctttctttggctaacaagcgattttaattcttttctgcttaattcttccatttttcccaccatctatgctactgtaaatatgctttttctatcgtctttatctgtgtctgtatgtcatatccactctttcggataacatcatacatattctctctctcatatgtgtggatattttttaaaagttcctgaacccacacttgtttattcaatgcgcaatactcgactcttcctgtaatatctgcttcatcagtaacagctgcgctgcatatgcattttaagcctgatgcctgtgcctcaatcaatgtaataggcaacccttcaaaccgggaaggcagcacgaacaaatccatcatttgatataattcatttgtatccgtccgtttgccaagcatcatcactctatctctcacccccagtctgcccgcctgatcctctatttcatttctaagttcgccgtctcccacaagcaccaatacagcttccggcttctccacacatatctctgaaaacacatccagcagaaattcatgatttttctgatagaccattctgccaactgttccaatcacaaatcgaccttccagattatatttttttctaagttctgtcctccgtttctcattatacagaaacttctctgtttcaatcgcgttattcataattctgatcttgtctttaggaacctgttctccaaacagccattcagccgctttccatgaacaagcccaaaaatccgttgcataacgctcgccaaattccttccgaactctataatgttcttccgtttccctctttcttttttcttcatcattcgcatcacatcttgtagaatgtgaatgaacgataattctgggtactcctctttcctcacagatctgttctaccagaaaactcttccactgctttgtgtgaagatgcaccacatcatatccctgatccagaatttgatttacttcttttataaattgttctctattttcttctgcataacaagaaatatagtgaattttacttccagtaactgtaatctcatctgcaaaatccaactttttgctcatcgtagcaaaatccacctgaaattgttccttattcatccatttccaattttctaatgcataatgagtaattcccccatatgaattagcaatcgggaactgtaatatttttatttttttcatgcagccctccctgcagaaacaagtaagccaaactatttttattcaatattgcatactttctctgatgcacacgctaaccgtctcaccccatctacgaacatccgaaaactgaccgaagtattattctccatattcatatacttagcaatccgctgtgcaccaataatctgttgatgttccggtaataatttttgtaattctctcttcggattcactatatcatctggcactctgtattttttcttatttttgattactcgcaaatccttattatacgcctttgaaactgcgtccagatccccaaaataccacgcctccaattcatggcaggcaattctaatcaatatttccttattactatatggcatacaaatatcttccaactgtctttttaactgtctgcaatcatttgaatcctgatcctgtacaattacaaattttgtgtcaggcatattccatccttgtaatttgttcggaattgatttctgcaaatcagatttcccctcatgcgggatcgttataaatctaacaccatctggaagtatatatggtaatattccatccaaaaggtacttcattgatttctcttccagtaaaaaaacaattatcatcttacacccccgtaagaagtccctgtttccataatgctccaggcaaatcccctgcctcatacaaacttctcaccaattcattatctgatgccttgcatatggtggtatatccttcttttttttcaaaataatagatttcttccagattaatagcatttaaaaaatctggcgaatgagttgatacaaatacctgaccacctgtattggcatactcacgaaattcctctgccagttcttctaacaattccggatacaactgattttcaggctcctccacacacaaaagcgcatgctgcaccggatcatgcagcagtaacaaataggtaaacatttttatcgtcccatctgatacaaattttgatgaaaacggatttttaaatttcccatcctgaaatcgtaatacaatatatccatcttgtgtttcctgtgcttcaaccatatccacgccagggactctctgtttcattttttttaatattgtctcaaatgtgtccggataattgtcatatatatattttgttaccgaagataaattatctccagtcctcgacaactgttcactataccctgcttcctgacgcgctcttgcagcatcaattctaaaatctgccacataccagtcttcaatcaacctgcggaatgtcgaaaccgcttcaaactctttaaactgtcccaaacctttaattgccagtatatccggagaatccaatttctgtcgccttcttgttgccagactcacatcttcataagaattcaatgctccctcagctgcaattccctcaccatatgaaaactccaaaactttccatggtgcacccttctgtcctcttctgaatcttaacacttctttttttacaaccgcctttgccgcatcatccaaaccgattgaaacttcatacgtcataagaggttcatcatgcgaaggtctaaatttaataataaacgcaatatctcctgtctgatctcttgatattacttctttgaatccacctctctttgccaaggctgcctttacattactatttaagcaatcatgtaaaaagccaaacacgtcgaaaaaagttgtttttccaacaccatttttccccaagaaaacagccatattgggaatgtctttgatttccactttccgaaacactttataattttgaattctaatagattctattttcatatgcagccctcacaacctgatatcactcactggatgtacctttctctgttcctccggtggcagttccatataatttccaaacttaaatgccaaatacgcatcataatcttttattcccggaaatttaactccctcaaattcaatatctgccgaatgctgataccagcgtgcccggtatccgtacgccttattcggagtaggaaatgtaagaatccttacccagcctgttttctttcgatctgtatgctctacaaaacgatcaaaactcttcttgagtgttctctccggaaccttgctcatcagcttatacacgccacgcagaaaagcactttgatctgccacccgccccacttctgaccagaaaaactttcgataaataaaacatttgaagttgtgcaatctgcgaagtccataattatccggcacataatcaagcggaaatacatctataaaaactccctgatcatatggcatatgttcctgatgttcccgcaaaaacagtgtgtctttccggcgaagctttccatacccccatcgatacccgggtgtattgcggtgatcctgaaaataaaacctgcttgtatcaagttctgtctcacacgccttgcgaaacttctcatactccggtcgaagtaacgccacatctgcatcatcatcccacggaataaaaccgccatgccgcactgctccaagcagcgttccggcaataatgttatagtggatgttgcatttcttgcatatgcgatccacttcttccagcaattcaagttctgtcatctgtaattgtctgagctgtgtttcatttaaatgtatcatagtcttatctccagggcataaatagcgcattatttattttatcttatcataatgcttaaaaatactcaagcattgtccttgtctcaagtaaaaagccatctgacatgcctttgtcagatggcttttctgcttaacattcttcatttgaaaaatcattcttccataatccttctggcacgatccggataattcgtaatcaccgcatttacccccatcgcttttaatctgcgcatatcttcctctgtgttcacagtccagacattcacatttacattcttttccctgcacatccgcatctcatcctgcagagttgtacacagcacagatggattgaccgcatataccttattcataagtgcatactccgccacatgagacagctgttccatatacaaaaatgcaatctttgcatccggatcatattcccttacctttaaaaccgagcaatgattgaacgaagagtacagaattctattctgccaccccatctcatgcaccagctccaccactttcttttcgattcctgaataaaaattaacacccgtttttaattcaatattaattgtcatccctgtatcctgcaacaattcaagaacttcccgaagcgtcggaattttgcacacatccgcatattccggatgtgtcttattaaaattaaattgttttaattcttccaaagtataatcaaccactcttcctgtgccatcactgacccggctgatttgttcatcgtgtgttacaaccaactgaccatcttttgtaagctggacatccaattccacaccatccgccttcatatccaccgcaagtgtaaacgcttccaacgtattctccggtgcatagccagatgcacctcggtgtgcccacacctttacctcaggccggacactgcggtcttcaccagcgccaaaccgtacaaattctaatctgcgcttttccggtgtgacaaccagcacatcccacaaatcctgtgtcacatcaccgagcttccgcatataacgcgtagatccttctggtttcttatccgggaaatactctaccttgctgcagccaacagagataatcggaaaactccgcttgtcataaacataatccgcatgtgtatgtccatgaatatatgctaagacttctcttccttccatttcatgatatttctccaaaatgttcattatacgctcaccgttgcgaatatcttctgcccaatagtccagttccgcaagcggcgcatcatgtccaaatatcagcactttatatccatccggagtttcatccagcactctctgaagccactgcacttcctcttccgaaaaaccatatctgatattttcatgatgatcaaacgatgtcaaaaaaatcatgcggagttctacatgatcatagtctgtataataataccccttcattccctgccgctttacatagcggtcgttaaacctgccataaatggcatattgttcttcttccgtgagccattctgtgtttcccctaaaatagtttgtatcatgattgccaatcgccaaatatatcggctcgcatatttttcgcatgtcattaatacaggatgtggcaattctgctgcaggttcttttgtccagcatcccatctgacagatcacccaagtgaatgatcccgtcaagtcctactctttcatgaacagcagcaatatttgaaaccgtgtcattccatgttccattaaccgtacaatgcgaatccgccaaaagcgcaaacaccagcgactttccgttcacctgctgttccataaccttatcagcggttttatatacctcttctgtaaaatataccggtctgtgagagaccttctcgtcaaaagagcgaaatgttaatatatcacttacccttgcagcatcttccggattgcatctgctgccatccaactttttcaggcaaatgcggaaccaacagtctttatcaaacacgtactcctcattggaaaatgcctcccatgaaaaatcacccgaataactgctccagttctgttcctcctgatacatatatgtatacatatattcctccggaatattacatccaaaggttgcaatactaagaccaaacgccggatcttttactactaaacgatctccttttttggcataatacaatgccctggatgccatgtgaaacggttgttcctgtatatattttcctgttcttgcatcaatcgcgctgcctgcacacacttcaaaatatttgcacatttccctctgcattcctatctctgatatactgctgttacagtccttctctccgctccgcttcacgttttgccaggaactgttccatcactcccgcaatagcaatggactcttcctctgtaaacttataagatctcccctgatgtccatgaatcatatacacaaaatcactgatctcatagcgaagcccctgtcccaggaattttgaaaagtaccggtctttcttggacggatcctcatatcgcacttcaaaatactgtgtcagccaccatggcgattctgccagaatataccctttcgttccggagattaacagctgtccttccgactttacacccactccactcttagagagtgccattccatgatcgtacacaaaagatgcctttgtgtacagatcaatcccgttctcatctttgatgctgtcaaatcggacttctttgtaattcgttcccatcagcttcatgattggcagcagcgtatggcttccaaactcggtaaagccgcctccataagctgtatccgttctctcccgcagtcccggatctgtaagtctggtaaagcatgcttccacatcgcagatccgtccgatcacaccactctttgcaattcccacgagctgtacaaaccccggacagtatgctgtcttaatcgcctctaaaagcacaacaccatgctctctcgcaattgcaaaaagttcttccgcctctgcgcgcttaaatgcaagtggcttctcgcacaatacatgttttccctgttctaacgcccgctttgcatattcataatgtgtttgatgcggggaggcgatgtaaattgcatccacctccttcataaatgcattaaaatcatctgttgccagatccagttcaaactgatctccaaattccttcgcgctttcaatctttggattataaacactgttcaccattacgccactgacatactttgcttccggcacaaagcgcactgcgatacgtcctgttcccactacaccgatccggataattggatggcttgcattgcgcacctgggtggacgaaatattcttcgtacgctccagataaaccacctcgcagaactgcttcatatgatcaaaagcccctgtccaatctgagccaaccgtaaaaatatcgattccatacttctgcacatcctccaccttctgtcccggatggtcttccacaataatctcatccgcaaacccggtctgtcttacattttcaatccgcttgtccagtgaatctacgatattaagtttgcctctggattcatcatactgctctgtcgtcactccgacgatcaaataatctcccagtgcctttgcacgtttcagcagattataatgtccttcatgaaacaaatcaaatgaaccatatgtgattactttcttcatgctcctgcgtcctcactcacggtcagtattctgccgcttctccttcttttccgctccgttatccaaatccgattcatcaaaattaagtcgtttctcctccacgaccaatggtctgtgaatgacccgcgtattgatattcaaaatatattctcccaaaagtccgataaaaaacaactgaatggagcctataagaaaaataccgataaccatcggtgcatttccggcctggaatgtataccaatgtgtcagcttataaataagataaaataaagcaatgcacatactgattgcccctgcaccgaatcccaaaaatgttgccaggcgaagtcctacttttgtgtaagaagtaaagctcagcatcgctgcatcatacagactgtaaaaattgttatgcgtcttgcccgcacgccgcttcggctgctcatattccacctcaatacggttaaatccatgtccgtattctgccacaattccacgaataaatggtacgggatcatccaactgacgcaataattcaataaaagtcttatcataaaggccaaagccggtaaactgctcaatcatttccgtcgtggacatcgacttgatcagcttataatataccgaccgcaggaaatagaccagagggttctccttactgctggtcttgatgccgctgacaatcttatgtccattctcccattccttaacaaatctcgggataagttccaccggatcctgaaaatcacagcacatacagatcgtgcagtcccccgtggactgacacatcgcgtaaaacggcgaattaaactgtccaaaattggtcacattaaaaatagcttttatctttttattttttgcacacagcttctcaagctccgttctcgtcccgtccgtagaacagttatcgataaacagaatctcataatcatactgcggcagagcttcctccaatacatttatcactgcaaagctcatgagttctacattttcgacctcattaaagcatggaatgacaatactaatttttttcatatttaaaatccgatctattctctattagtttcttacaaatctatcttattgcactatctccattataaacgctatctataattccgtcaatcgtacgccggattccctcctcaaaatctacttccggcacaaaacctgtatcattcgtcaattcggtcagatccgcaccaaggaacattacctgtcctttgggatatgggagttcaccaatccctacacttcctgctttcaaatacttattttgtccttccggtacccgtaatgtgtccatccgctcacacactgcctcacgaatgctatcaatatattctcgcagcggacgtacctgtccgcttccaagcacatagatttttccactttttccatgctctgcaaccagaaataatgcccgcgctgcatcttcgctgtaaagataatcccactgctgttctgccggcgtgaaagccgcatgctctccgcaaagcagcttgcggagcgtcgctgaaaccatcgtattcgggccatcaaaaggtccatatacactcaaaatccgtacccagacgtgttttatccccagttcctgacaccgtatccggctcatttgaccggcacataattttgccataccgtatccattttccggaaacaccggcgtttctggcgagagaagctgttctgtccttccatattccgcctgggaaccggcgccaacaaacgtattgcagccaagttttgctgcgagttctgctgcctgcaaagcagatgcaatattacgcgtctgcaacggcatgtcattccgtgccgcccccgttgtcccctcccatgcaaaatgataaaacacatcatatctgccttctataacctgctccagctgccccaattctgacagttccgtctccagtaccttcacacgcggatgcacaggaatactgcttattctggctgaccctctgtggcagacagcaagcacttcccagccttcccggatgcattgtgtaattagcgccatgccgattgcaccggtaggaccggtaatcaccgcacgtttcatatgctttacctcttctcccttaaaaatgcctctatctgtctctccgtgcagtccctgacattttttccctgcacatattctgcataccactctactgtccgttctaccgccatttttgctgtccatgagggtgtccagtcaaaagtgcgtttcagtcttgtacaatccagttttaaaaaattagcctcatgtggctgttttatattttcttctttgcccagatccatccaatccgcttcttttcctgtatggttcttccacgctttacaaaattctgttgtgatcctgcctgtctcccagcagtcagcctcatccggaccgacattatagcatcctgcaagttccggctgttcccactgtcgtttcaagatcatcagatatgccgctaccggctccagcacatgctggtacggacggacggaatacggattgcgcacccttatcttttctccactgctgactgcacgtacgcagtctggaatgatacggtctgccgcaaaatcacccccgccaatcacatttccggcacgtgccgtcgtaattggcaaaacacgtagtccactgttcccaaaaaaagaattgcggtagctgtctgtaacaagctccgaacaggacttggaattggagtacgggtcatatccattcaattcctcattttcccggtatccccattcccactcacgatttttatataccttatctgttgtcacattcagaaaagaattcacgctgtctgtctggcggatgcactccaacacatttaccgttcccattacgttcgtctcgtacgtttcaactggattccggtaactctcacgcacaatcggctgtgctgccatatgcaccacaaactctggtttcacacggagaaaaacgctgcggagcgcatccagatcccggacatccccctcaatcgactccatctctgttttcagaccacacagtccaaacatcgaaggatctgtcggcggctgtttcgcgtagccatagacttccgcgccttcacgcaaaagaagctggctcatccagcttcctttaaatccggtatgaccggtgatcaatactttctttcctctgtaaaatgataaatccatcatacacctcattcaggcatttcccgcctgctttactttgcaacatacttccagaacaacgtgtcggtactgccgctgaaattaccaccaaagtaaatccgctctggctcaacaacataattttcatactgcacacgtgtattagaatagctcctcttaatctcatgaagcggtgttaccgcaccgatcaccagaagtccgaccagaagatatgttcttatctgcccccatttctgatctatcacctgaatgcaccagaacattacccgaagcagcgcaggtattgaagcccgcatacaaaagtcgcaggagctgcctataattatcagcggaatgatatacaataaaatcgaggtcatccagaagagcttatttcgctttaatacaggatacaggcatatcagataaactcctgcttccaatacataaaatactgtcaggttcagccaccagaaaagcggtgtctgccaatcgcaatacgcaagatgaccgatccgcatgaccacaaacacaattccacacatgcacacgctgtatttcaacactttgggccaatgcagtgcaatggctgccacacaccagaataatcccagcattaccccgatcaataatataattgccgctaaaaccagaagtattcccaatgcattattcttcaaaaaagaaacacttcccaacagtgcatcattgctcataaaatacagaccgctgatcaataaaatcgcaaaaccggcaagcatattctgcaggcttgcccagtgtttccagcaatcccgcataatctgtgctgctttggtgtaatcatttctccaatgaactctgcttatcatataatagataacaaacggcagcattcccacaaatggaaatgttgaagtcagcattacgagcgaccacaaataaatcatgtttttaggcttttcgcaaaaaaacaacaatgcacatgccagccataccggtatcgcctgattaaatacccaaaacagctgcgtcgtcatggacgaatactggaaatgttccgcccacgcctccatatgcaaatccgaaaaaatatgaatctcccaggactggcttatcagcgccccaaccacatccagaccgctgaaaaatacaattacgaataacggccaaaccataacttttttgcgccagaggcagatcaatgcataaaaaacacagataccgaatactgcccacacatactgtgccacatatcccgccgcaattccgaagaatttaccgattgctgcagccggcagccagaaaccgatataatagaccatacctcttccgtcagtacctgtatccgacgtaaaggtggcagttaccggccacttttccgtcacaagcagttcgtaaatctcattgcgccaccaatgatccgagttctgccacatcagaccacctactccggatagtgccacccacatcatgataagaacgacaattcccacaaccttccatgcatcctgttttctgaacataagttccagctttaacggtctatcccagtgttcctttatacataaggccatgccgcctgccacaattactgccacaggaatcccgatataccacttacaccagcccaggcagaataatatcattggcaatgccaaataaaaatatcctgccacaatcacaattcggaatactctttttgtctgttctctcatcatctgaactgcccttttcttttctattgcaggattcctgttgtctcatcaaaataataattctgtccgtcaatctctgcatttcccttcgccattgctccggtaatcaggtcaaagtaatatgtacctgcatctgtcctctgccagccttttatcatatgcccgttggcatcatagcgcacccactttccagtaccatccgcgcggtccgcataagcacctgcccaggattcctgatagacatccttgctggttgcttttttcccactgtccactgcatccagccagtaccatgcatcacttgccgggtcatagatttccttgccgcgtccatccagtccctgccgtctgccgccctcataccagtaagtaacaccattctcctcattccactgacagtcaagtccgattccggtcgaccagctgaatgcacacgggacaccgtcaatcgttgtatttccctttgccattgcaccggttgtcagatcaaaataatataccccagcagctgttgtctgccagcccttgaccatctcaccgtctgcatcgtagcgcacccatttgccggtgccgtcctccctgtccgcatattcccctgcataggataactggtatacatccttggatactgccatcgttccatctgcatcaaaccagcgccatgcaccgttcacatatgcttctttcgatgttgccatcacgccattttcataataatagtaatagtcgccaatcttgtacagaccgttcagaacttccgtctccgcctgggctgtcgccacgctgctgtcccgtcttgcattgcacacagcaactgcctgcacattttccagtgctccggaaaccgttcccgtatacttgacagactttgtggctgccggtgatggtgtcgttccatccgttgtatagtagatgaccgctccacttgttccacaggtaatctctgtcgtctgtgccgttttattcactgtaatcaccggtgtatccgtcacagcagtaatcgtcggcaatgtcccgggaacagatgcatccgttccctgctctgcatccaatgtacaaagcggaagataatcttcccagaaagcttcttcccggtgatttgaagcactgtaggcactctcagtatcgtaatacgtgtcatttctctcaaaataggtatatgatgacgtatcatcatcccacgtcacatccacattataccaggaatcttcaatgcgcaccttattccattcatgagatgtactcgtgactgccatcgcatccactcccgcaccgttgcacagcatttcaaacgcaagagcatatccggcgcagactgtctgatccgtacagaacacactgtagcaggactgggaatactgcgtgtcttcatcaaaattcttttcatcataaatggcttcattgtagcttaccttttctgcaatcaggtcatgtattttctgcaccttctccgcagttgatccgcaggcggcaaccatattctcccagtctgtaacctgtgcttttactgcctctgttgccgtcttccttgcgcttccaccggcaaatgcagaatataccccataggcataatacgtttttccattctgttccattctaaaaacagtatagttcaggaaataatactgcggatttgagtgacggaacatctcgacgatatttctcatttcatcgttgccaagctcctcgcttgtcaccatatcgagataattgtaggtaccgtctgtgttagcatctgtttctgtggtcagatacttcatgcacaccgcatccagcgcatcccagtaactcttctccgcatccgacaactgattgtatacataataattcttgtacacatcccacgatgaatcatatatctgcgcataatacaatgccgtctcgctcaataattcatcactactctcatacagttcggaatcatctgccttaatggcaatctcttccacaggaagcagaccggtcggcagctcctccgtctgtacatctgccagcacactgaacggtgttaccattacggacaacaccatgcctgtcattgccaaaaataaacctgtttttttcacgctaccgttcctcccgggattattcctcgtaactttgcgccgcctgtcggaccgcgcgctttttctttttgttaaaatatatcatatatccggcaaacagaagcacacctgcgatactgcaggcaatcccctgtttcagcggtgtatacacataatcgaaccggatcgtattgtcaccggcatcaatacgtaccgccatcagcccgttgatattgataacttccctgctctccccgttgacggtcgccctccagcattcatcatatggtacactgaagaatgcatagcggtctcccgacgcatgaatctctgatataaaataattctttccctgcgtaaagctttcgctgctttccttacggcgggcaccaagcacctcttccagccggtccatggtaattccaccgtattcctcataggtgtacttcttcaggcaggaacttacctgctcctcatctgcatcatctacaaccaatgtggtcagcattgtaagcgcccgcagctgtggatcaatctgttcaaactggctcttcgtcatgtatgtgtcataggcaaatccaatcggaagtgccctctcattctcataataatacatttcctggccgttgtcattcgtgaatgtggaaatataggccgcatccggctgttcgatgtccgacacaatataacgcgcagacagaagttcctgcagcccatcgcctccggcatttgtccatgttccccgtccaatcccgacagcatcatagaactccatcacagacggatggatcgtactgatgaaagaattgatggatggaagggaggccgtcatcgccagattgtaataagtatgcccgatcccctcatcaaaataataacggtatggcagtacatccctatccagttcacccggaatctctgtcatatagtttaccacattctcagcataactgttcggataagttttaaaatccagattagaattatctgtagtaacctgatatccacgaattgcaagcaaaagtgtccctgcactgaacagcatcgtcatagcagtaagtgcctgcgtgcggtatttttttccaaaccttacaataaaaagtgcaatgagtacacctgcaatggcaatcaaaatgccacgataataccactccgtcctgtataccacatgctcctcattcccgctccactttaccacattggtgagcacataaaacagaagcagcgctcctgcccagattcccgttgccgccggaaccgggtactcttctggctgttccagcacttttgctgtagccagtgccagaagcagaataaacatgtaataccatctgcggtatgtctccactccgaaaaacataaacatgttatttaacactggaactacggcaatgacggcacagatttttaagattctgccaagccagtcctttttgcgcattgcatatgccagcgcaaaaacaatccccacgagcggcagatatgccgcattggtcatccagtctgcctgcaccacactcgcaatctggttcatcggctctgccggcacaagaaatcccttaagcagccgcagccattccgaggttgacatgccaagccatgcttccccgggcagatgctcgttcacccggctgttcgccagtgttccatgaatggaaggaatcatcagaattcctgccgaaaaaaagccgatcgctccctctaaaaagcagctcccgataggcgccagataattcctgacaccgcgcctgcgctcccggatatccggcaccagatatttggcgatataatagatcacaagaaaaatgacttctcctacaaagaaaatataattgcagaatgcattcaaaacacacgccagtgccagccgtccttttttgttgtcttcaatcaggcactccagtcccagcagcatgagcgggaacagtgctaccgggtcctgaaaatgataaaataccacactgctgcactgaaaaccggaaaatgcatacagaagggatgccatcacaaccagccatcgctccttcacatgccgttcaagaaatgctgccgcacacgctccggctactgcaaacttcagaatgaccatccaccccataacccgcggtattaccttagccggaaacagcagtgtaaaccacaggaacacgcttcctacattatagaagctgaatgtctccagaaaattactgccaagatccagcccccaattccataacagattgccagacttaatcgtatcattcataaatatattaaaggcaatctcctgcgccgtaaaatcatgggacatggcgaaatatccatgatcgcggatcagaaacggcaccaccgcgagcatcgccgccagcagattgaccagaaatgccagctgccacacacggagttttgcaaatgcctcagttattttcttcatttccttcgttctcctttgatatgatacatctgatgacgctattctaatattattaaaaaaaacgcttcttttcaacccccaaaccttgagtttcatggacagtctttccaatttgtggtacaatcttcctatattatataaaaaggaggattattatgatgaagcgttccgtttcacgctttcttggcatggcgctgaccggctgtcttgcagcggcgggcttatctcttctgtctgcatccgacgtatctgccgccagctatccgagcgaagttctgctcggtaccttctgggaaagtgacaacaataccacagacacagtctactggtcaacggatggtgtgaatttctatgagctctctgaagcttatactgatgcaacgccaaacgatccaagcacttcatggattgtcggtacacgcaatgtatccacactccatgatccgagcatcatctacaaggatggctatttctacatgttatccggcttttcacagaacaaccgcatcattccgatgatcggcagttccaaagatctggtacactggagttatccaggttctggaagcagcgagaacgtgggggttacgactgcacctgccggttcggaaaaatacggttccacctgggatatggttgcaccggatttcatggtcgatgacgacggtaccgtatggatcgttgtctcccttggctactacgcaagctggcacaatgattccagccagaatgatatcatgcagccttatctgatcaaagcaaccggtctgaagcccggcgccgatccggcaagtaatccgggggcaccgccaattgtttcctactcggatgccgtaccgatcaatctgccgcagtatgactcttcccacacagttacaaaccgcattgacggttctctgtacaaagagggaaattattactacttcagcgtgaaaaaggacggtgtgaccaacgaaatctggcgcaccacgaatctctcgctggatgcagtacagaacacaagcaactgggaactggtaacagacgatgccgtaaccggattcgaggggccatccttaacaaagtacaatggtacctattacatgtatacggacaagcttaaagattacccaccggaaaacgcggacggaaaagcaggggtctacgtcagtgttgcctccaccgctactaccggagctctggattcctttaccggatggctggagcagaaccagttcaagatcattgcacactctgcaaacggcggcacaaaggagtgtcggcacggtactgtcattaccgtcaaagacagtaatgccataaagacgatctgggatcgccgtgcacagacaagatacaacaatacttccggcacctccaacaccccggcacttgcttctaccggctggtacaataaagaaagcttcaaggcaagctactacggcggtttcctctgcaattactggtatgagggcaatgtccgtcagggtcttactggacgcggcaaggagatctatgatccagccagcaatgcatggtactggctggattccaacgcagacggcaaaatggctgtcagcaaggatgtctaccagccatacaccattcagggacaggacgagatcggcaaatgggtgcgctatgatgagtacggtcatatgatcaagggtgaggatcaccgccacattgaaggcactgccgatgatgccgagtggggatactggtactttgaccagacgacaggcgctatgctctatggactgcagaccgttactacaatcaacgccggcacaggagaaagccagacaaagacggtatactatgacgatacaaccggtcttctgttaaagggctatcacaccatcggcgacacgctctatttcttcgatccatataccggcgaagttatcaacggctggtatgcagatcctgacacgggtgttctctactggtatgagaacagcgcacgtcagggatataatgtcaataaccctgattaccgtggcaaggagatctatgatcctaccacagatgcatggtactggctggataacgtacagcagggtgccgttgcaaagagcaaagatgtttatcaggaatcttatgccggccggtttgccgaccgcgaggatggtaccggaaaatgggtacgctacgaccagtggggcaagatgatcaaaggctgggactggggtgctctggacaacaacggaattcatcagtacttcgacgagaccaccggtgctatggcaaaaggtgatgtatggatcggtgatgagcactggtcattcgactggaataccggttacggtacacgactcaactaatcgccagtctacaatgcaaacactttgtattattacaaaacagggcgtgtgtatgaaaatatcatacacacgccctgtttctttattgcttttctgttttagaagaaatgtaccgtatagtccgcaatcactgttccatcctgtgtaatcgtaacttcataattttctcctgcctgaatcgaaatggaatccggtttaaaaataacgcatcccttctgtccataaccaccgttatccacattaaaataaccatcagaagctgcactggaaaaattccatgttctttctctgccagtggtcagacactgtaactttacattgacattaccgtttaagctgcttccgtaagaataactccatgccgatgagctctcaaaataccgcttcggcatctccgttgcaggccatgccacaccagttacatccgtgttatgataatcataatcaaatacatacacactggaatatgcggcaccgctattgcttaccgcatagccgaatccggtctgctgcattgtaggattcaaaatccatctgcggtgtcccagccggtcgatattggaagaatcactgtcatccatccacatcatcaaggactttaacagagaagaccgccagcttgtcatcgcaatgttggaactggatgtaccggaatatcccagttcatataattcatcactcatgccggatggtctggacggatagtgagacaactgattgttcgccgcattgagcatggatcccgtctgtgccatctgggtataagtatcgtttaatgtgactccagcatccagaccggcaatatagcgaatctggttgagcatggcaagtgcctgtccaagcgattcatccgatacttttccggctgcatatggtgctgacagaacaggatcggacgccatcgttgtcgttccggatatgagcgcatctgtaattccgctggacgccatatactgctcaatgtcgctctggctgtgatatgtgactcccagcccataggttttcactccataaccgcacagtacgcccgtcgtctcatcaaacgcatatgctgcgccgtcaatctccaccgttccctttgccatagcgccggtcacaggatcaaaataatagcggtttccgttctgctcattccatccttttaccatatgtccgttctcgtcatagcgcacccacttgccaccgctggactcctgatacacatccttactgactgccatcttaccctggtctactgaatccagccagtaccatgcatcacttgcaggatcatagatctccttgccgcgtccttccagtccctggcgtctgccgccttcgtaccagtacttcacaccgtcaatctctatccattgacagtctgcaccgataccggttgtctggtcaaacgaacacggaacaccatcgatcgtggtattgccttttgccattgtcccgtaggtcatatcgaaataatatgttccggcatcattcgtctgccagccctttaccatatgaccatccgcgtcataacgcacccacttgccgatccgctctccggcatcattcgtggcatctccccactcgcctgccagtgattcctgatagacatccttgccgactgccttcctgcccccgtcgaccgaatccagccagtaccaggcgtcgctcgcaggatcatagatctccttaccgcgtccctcggttccctgcttcacaccattctcataccaatagaggttaccgtcctcctcacgccactcacctgcttcgtcagcaagtgcagtgagaggcgccatggtcattaccattgcccccgcaagcatcataccggtcagctttgccagaatttctcttctcttcataacttttcccccttcttctcttaccggcggataccagtcacttcatcgtaatagtatctatttccattcggaagcgtcgtccatccatgtgccataattcctgtcacagaatcataatagtaccagtttccgtttctctgatattcaccatgtaccatctttcctgtataatcatcaaaatagtaccagtttccatctatgcagctctctccatggtgcatctgtccagtaatggtatcataataaacccatttgccatccggattgccctgttcctggatattcgtaaatcctttatacatttcacctgttgtgagatccagccagtaccagccgccataacggtaatcttcaccctttaccatatatccgttcgcatcatagcgtacccatttcccctctgtacgctctgcatttgtcggaatgaacacatccttatcgcgtgccatcgttccatccgcatcaaaccagtgccactcatccgaatccggatcatagacttccttatcacgtgccatcacaccgttgtcataccagtaatactgtccattctccactttccatcctgtctgtgccgcctcatcgaaggaatgctcctccgctttcacaaactgaaaacgctgctgtgtagctccgtttccttcgtacagcttcagattggttccgctctccacacttccgtctgccgttatgtacagaccgctgtttgatactatattataggaaccatctcccgcatccttgatgtaccagcgctgattcaacgcgccgttattctcatactggattacatttgttccattggttgttccaccgttctccgcatccagatacttgccggaatttcttgggctgatggtatagataccgccgccaatatgctttacggaaaacttctggttggttccgccgaggttctcccacagcccgatgtttccaccattcgcctccgaagcgccggaaacatcaaataccgcattggtattggattctgcctcaatcttatacacaccattttcaatcgtctgcgcatactccgtgttggaaaagcggaatttctggctgtcttttgcctggaactgattgatatagatattggcaccattgtatgcattgccgccctctacctccagacagagattcttgtccgccacagaacggatatagtaatatccgtttccggcatcctgaatataccaatgctgattgcttccattgagccagtcatactggatcaggttcgcgcctgcggaagttcctccctctgcatcgatgctcttgccggaacacatagccacaatcgcatactcaccacccgagcggtaaatgatcttaaaatcctgtgcgctgcgctttgtcttttcatacagacggatattggctctgtttgatcttgaagaatctgtcacatccagcgtatatcctgtatttaacgcactgttgatggtatagatgccatccgataccgtctgtgtaaatccatctgtatcatcataccagaaatcacagtctacattcccctcaataccgctgacatatccattgctccggtactgccagtaatcataatctccggcataggaagtctgtgacgtatagttcgccagccagatctttgcattgatgccgctggcattcatatagttttcaagcatggtcttattcgcataaatcatgggcgtatagccagagcagctgaccgtataagcaaatccgttcactactgttgttgccgcatctttgctgagtcccgcctgataaagcctgcctcttccgcctgaaatgaactcaaagtccataacaaccggcatcgtaatgttatacccggaaatcttactcagagcaaaacgtgcctcctctgccgcctcatctgcattgaccgcctgggaaaacatataaaccccgacctttaagcccgccgtaagcgctccgttaatattagccgctgcgttcggatcctccttcaatgctccgttggaatatccacgatatcccacacggacaaatacaaagtctatcccgctgttcttcaccgcattccagtcaatgcttccctgataataagaaacatctattccattgcgcactgtacgtccgttaaactttgcattgtgcgtatacccgtcccagtttgctccgcgaagatgcccctccacagataagccatccgccgtctgtgcttcctgctgcagttttatgtattccggatcatccggcagcggagccagttctccgactgtttccagtccctcatccgcttcttcggtctcttccgtctcttccgtctcttcggtctcaccggcagcttcggtctcctccacagtcgtttccgtctcttcggctgcttccgtctcttccgtctcaccggcagcttcggtctcctccacagtcgtttccgtctcttcggctgtttccgtctcttcggccgcttccgtctctttggtctcaccggcggcttcggtctcctccacagttgtttccgtctctttcccagactccgtctcagctttcttcatttcctgcgtcacggtttctgccgcttctgtcggaatattctcctgtgcatatacatgcgcctggccgacccccaggtcaagcaccattaccatggctaatactgctaccaatgttcttttcatttcaatcatcctcttttttttgtgttctgtcactgataatgtatcttggtctgtgttttacttccatgtagatcttaccgatatactctccaagcacaccgatgcagattaactgcacgccgccgataaagcagataatgcttgtcatgctcgcccagcctgccactgcgtgcccggtcacctgcacaatgattgaccagatgactgcgcaaaagcttaacagtgcaataccgcagcccattcctgtaatcatatgtagcggcttgacactaaggcttgtgattccgtcaaatgcaagcgagagcatctttttcagcggataatggctttcgccggcaatacgctcatgcctctcgtagtacacgctggtactcttgaaacccacaagcggaatcatgccacgcaggaaaatatttacctctttaaagttggcaaattcctgcagcacacggcttgataccaggcggtagtctgcatgattgaacactacctcagctcccatccagttcatgagcttatagaatccctccgcggtaaaacgtttgaaaaaagtgtccgtatcccgcttgctgcggacaccatagacaatctcgcatccatccgcataggcatccaccatatcattcatcgcgttgatgtcatcctgtccgtcacaatcaatggaaatcgtgatatcacatacatccttcgcttccatcagcccggcaagcactgcattctgatgtccccggttacggctctgacagattccctgataatgcttatcctgctgcgccagttcgcagataatctcccatgttctatccttgctgccatcattcacaaaaagaatgcggctgtcatcactgattttttgtgcatccaccagttccctgatcttgtccagaaacatcccgctggttatcggcagaactttttcttcgttataacagggaatgatgatataaagtatcggtaacatttcgttcctccttacctcctgttccttattgcagctggaaattcagggttcccacattggtgttattccccactgcactgttaaagtaatcgctgaagttctcgacagaaaactgttcgcaatccataatcacattatcgatcaggtcgttgcagtaatcatcctgtgcaatatagattcccgaataatggtgcccggaaatgacattccgtgcgacgatattctcataatctgccgtaaagtccagaccttttaccggctcgtccggctcacttgcatgtccaagctccacgccaaaaccatggtaagcttcattctctcccgcgttattgtcggtaatcagattggaaagtatcagattccggtaaccggatcttaccatcttcaccccacttcctgaattttcattgatgttattattatatactatattatacgccgagttatcaatggaaattcctggaagctttgccgtggaagatccgtccgcgagtcttcctgcgcccaaaatgaaatctgcctcaagatcttcatcggtctgacggtttctgtcaccgttgcgccggatcgtattgccactcacataggttccaaatgttccgtaatcgaggcacattccttctttttcattgtcctcaatacagttatcaatcacataattcatatatgcaccgtcagaataaaatcccgaagaatagtttccctgaatcaggttgtccttgacgacattgtggttcggtgtctctttcagatcatacagatattcatccagaaattcattgtatgctgtatatttgtctttgacaatcatggaagaaaaaacaataccggctgtcaggtttctggttccacggttctgataaactgtattcccctgtataatgcagccggttatctctccgttaaaaaagatcgctccgtttccattgtcatgaaccgaattattaatcagattgatctgcgtatttgcatccatcacacagataccctttaacgcagcattggcaacctcattatcacggattaacacctggttggaattgataatatagatgccatagtcaaaaccgcttttaagctgcataccgctcactgccgcatgcccggcatcctcaatcagaattccgtaagttacgttgtcttctccgtctcccgtcagtgctgtgtctgttccgctaagccatacatcagacggcacgtcaatcgtctcatccagtgtcagttctgctgccgtcacctccacgcgtacctgacttctgccttccagaaaagcgttcagttccgatgcggtcgttccgttaaattccactgtctcgtcaaaatccagcgcatcctttaccgccacgagcgactcattatatattgctttccagttatattccggtgtataaaaatctgtcttgtcgataccgagcacttctattttctttaacacctgcagatcagccattttatccgccgcatcttccgcgctcatgcgttcaagctccggcatatcgtaacgtgagagaatgcttaacttatcctcggagagaactttcagttcgtccgtctccacatacacatccgactgtcccgcttctgcatatgcaagctgattgtccgtaatagcaaaactcttctgtgcaatggcaagatcagtttcgctctgtgtctcttctgtgtccgccgttactgccgcatcctctgtctggctttccggcttgccgaaggctcctgccgcaaccgcaaccgaaagtcccagatataccgcaatccctgctccaacagctatcttcctcttcataaatgctccttaattcaatcccaaaaatccgttccagaattccagcgttctgagctttaagccttctgtgcgccaagcattctgtgccttctttaatttaaatcttaccgtaaatgtgagtctgagcgcagaaaacaggcatcgcatcgatgtcttaaatgatttctccgttacaaatcccttgcggctggtcacgtcatactgcagtactttctttttgcggtagaataacgccggtctcgctgccgccatcggcaccacattgtttccttttgcacgcaggaaaagtccgttcaacgtcaaaagcctcttgatttttgagatcttgctgtctacatatttgtaacttttctcaaaggtcggatagtcaaacggaacatccagtgtatttaattcctgtccccggtagcccgcagccatcacgctcttgtgcaatgcctcaccatcctgctccatcagccagcccggtccttttaagaaatctttgattccctgcagatacagatccacattcttatagcggtagaatgtaacctcccggaagcaatgtccaagaatggcacgattcagttgtctcgccccataccactggcaatggaacgaattgtcaatcaactggtttctcataatataatactccaagaacgaggaatacttgttctcaaacggctcatgccatacgcagataccgttcatgagaatcagtgtcttcatattgcgcagaccgtattccagatcatctccacggataaagagcggcatcggcagattttccggtgtgacaatcttcatcgggaaacagcaataccaccacgcattgaactctgtatattcctcgatctcgttatagagacagtagtcacacctgcgcagatccagatcatgttttaaggattttaaccagccgccgttccacgaagctcctgactcgacctgaattgcctgcttatcaagacgcagcatcgctcctccaataaaagcatcttcatactcatccttcagcaatgtgagaatctggtaggtcttaaccagtgcctccggctcaatcacaatatcatcatccatcagaagagcatgtgtgacacacagttcctcgttgtgtgtcataatttcaatcagatctctggtaaaaccacctgccccacctaggttgcggttcggattgatatgaattttatcactgctcagacgctcacgatccagcgactgcccattatctgccacaaacacttccaaatgtccatgcagcggagaggcaggattatttaaaatagtctcatttaaaatgcggagattcttctcaataaacggttcccgtttaaatgtacagatggcgataccgatcttgacatcgcgcacttttccctctgccacagcagcatgataacttccacccgcaaagatgctcccatcttccagtgccgtaagcataaatgtatacatgcctttcgcgtctgcaaacgtatacgggaactctacctctgctgcctgctcattttccacgaccgtctcgctgacaacatgcgtcagtacatcatccttgatcttttcctttgtcaaaagagtcactctgaacctgccggacaataccagctttacggacacatcgccaataactgtatatttcttccatttttcaattgaaaaaccattgaaataagtgtcaaacgttacaacagcacctttctgcatccggatcttcttttcctccggcagatattcgatctttttattattttcaaccgctgccagcgcttttttctcattttcaaaaagtgtctgctcatccggaatatctcctgacacactgctgcattcctgttccgtcctgaaataaagttccttctcagtacatcttcctacttccgggaataaaatcttctgaatctccatattactctcctgcttatttccactctgtctcacacattttcggtgtcttttagttcagctctgcctcgcatatttccagtgctgcagcaattaccttatccatatcatagtacttgtatccgcccagacgtccaccgaagatcaccttgttctccttgtctgccagctccttgtacttctgatataactcattgttcttgtcattattgaccgggtaatacggctcatctcccttttcccattccttggaatattcgcgggaaattactgttgttggctgcttgccgaactcaaaatgcttgtgttcaatgattctggtgtacggtacctcccgatccgtatagttgacaactgcatttccctgatagttctcgcaatccagctcctctgtctcaaaacgaaccgtccggtactcaagcacgccaagcttaaatccgtagaactcatcaatcattccggtaaatactgtctttggtgcaatatcggcatgctcctgaacaaatgtaaaatagtcggtatccaaaagcacatcaataccatcgagcatcttctccacgattgccgtgtaacctccgattggaattccctgatagcgatcattaaaatagttgttatcatagatgaaacgaagcggcagtctcttgatgatgaatgccggaagatctttgcagtcacgtccccactgtttttcggtatatccctttatcagcttctcataaacatctgttccgacgagtgagagcgcctgttcctccagatttttcggctctgtaatatgaagttctgcaatctgctccgcaatcttcttctgtgcttcctccggtgtgcggatgccccacatcttactgaatgtattcatattaaacggcagattgtagagttcatctttgtatacagcaaccggtgaattgatataattgttgaactccgcaaactggtttacataatcccagatttttttgtccgatgtgtgaaaaatgtgtgcgccatatttgtgaacattgattccatgtacattctcacaatatacatttccggcaatatggcttctcttgtcaatcaccagacaagtcttccccttcttctttgcctcatatgcaaatactgcaccatataaacctgcaccaactacaagataatcataatttgctttcatagttactctcctttttctcttaaatactgattccagaactccatggacgtcatctccgggaatgcactccggtatgcactctgcactgctgcatattccttcttcaaccggaagcccagccgtagccactcccccagcagtataaatagctgtctgacttccttacctgtataaaaacccagttgtgtgtccggatcataaatccagacttttttcttcctataatagcaatgcggactttctcccgccatgacaggcaccggttttccccgcctcgccggcaggaaccatccgttcagtgaaagaagctttttcttatcaatattgctggaattacttcgtccggcgagaatatcggcaagctgtgtatgtgccctgtccggaagcttcccgcaaaacgtttccgaataacggtatcctgcacgcatcagttcaccgtgaagctgctcagcatccacatccatcagccactgcggtccccgcagataatcctctaccgcccttgtcacaagccggatatcccgataacggtagcggaacagattcaccaatgtccgtcttataaccatcgcaaacgcctgacggcttgagtaccctgtaacataaagtccattgacaatcaacgcgttgcgcacatcataatattcattgacagacggtcgtttctgttcaaatgcatcatgccacacgcagattccattcatccgtatgggttctcttccgctgcgcagtccgtactccacatcatcacaatgtaaaaacaccggaagtggaaatcccttttcccggatcacggatattgggatacaacaataccaccatgcattgtaatccgcacgctcatccttctcattgcaccagatattctccgcttccctcagatccagacctctgtgaagcgaccggatcttgccattctgataacttccccctgactcctgctgtacaaatgtatagtcgctgcgaagcatcgcaccgcctaccatacggtctgtatgctcttcttttagcagcgaaagcaatgtataagttttttcaagtgccgacggcttgacctctacatcgtcatccatcaacagcacatgcgtagcatgcccctcccgcatcgtctcgagcattcctctggcaaaacccgcggcgccgcctgcatttttatttggacatattttaagccatggttcgcagcgttcttctcccaacgtccttccattatccgccacaaccacgcggattttatgacagagtaccgaagtacggttctcccatagttgttcctttatgagttttaagttccgctccagatacttttcacgccgatacgtgcagatggcaactgtcagcgaaatctcccgtaaaggagccgcagaagtatcataagtacactccgaaataacacattgtccgtcttctcccgtctcgatctccgcgtagaacacaccacgcatctgcgttccttctgttttattccaaagttccagttccacattctgttcatcatcagactctattctgcgcgctgacagaagttttttctcacaaccgccatccggcagtccgcttacgccatacaaccgcaggatgccgcttccccgcatccgtgcatggaaactcaggtccggtatcgtcgtataaagcagccacttttctatcgggcatgcattaaaataggtatcaaaccggatcagagtattctcccctatctgaatgctctgatctgcgatctgatacgctccctttaaacatctgatatacagtttttctcttgcactttcgcccccctgtggaagctccattctctgtatctgcatccacttaaaccccttttacgtacgcttccgtaacctccatgacttctccgctctgtcttaattctccatgatcaatccatgctgcgtgcgtacacattctgcggatatcctcgatggaatgtgataccataagaagtgtcgttcccgccgacagcatctgtgtcatacgctctttgcacttctcctgaaacttgaaatctcctaccgccaatatctcatccacgatcagaatatccgggcgcaccatcgtcgcaattgaaaaaccgatgcgggcctgcataccggaagaataatttttaagcggcacatccaggaaatcccacaattctgcgaagtccacaatctcatcaaaatgttcttccatgaactttctggaatgtccaagcagcgttccgttaagaaaaatattttcccgtgcagtaagttccatatcaaatccggctcccagctcaatcagcggcgcaatcgttccgttgactgtgaccgtccccttatatggggtcagaatcccgctgatcagttttaacatggtggattttcctgctccgtttgttccgaccagtccccacgcctcgcccggtcgtatctggagtgttatatttttaagtgcaagaaactcttcaaacatcagctgacgcttgaccagtttcacaaaatattctttcagattatcgatcttttcggttgccatattaaaccgcactgtaacattctctaaatcgatgatataattttcttccatactgttcctcttaaatatataatatgaacttatcctggctcttgcggaatgtcagaattccaaaagcaaggaatagcagtgatatgatacaacccctggagacaagtgtcatggaaggcactgtccgctccagcacgatcacacggaactgctcaatatagtaatacaacggattcagatgtgtcacaatccaccgaatcttgtccggcagcatcgtgactggatagaaaattggtgttgcatacatccatgccgtaaggaatacattgtagatatagcggatatcccggaaaaatacggatgcctgtgccagaaacatacccattcccaaagaaaacacataaatctgaatcgccacatacggcagcagaatcagataaacggaaaactgtgtccctgtaatgagcatgaccaataccatggccccgagcgaaaataaaaaatccaccagatcactcgtcacctttgacaatgggaaaatgtacttgggaacataaaccttctttaacaatgctccattatccgttactgaataaatggcatgtacggttgcattattcacataattgtagatcgtctgtccgataatcagatacaccggataatgatctatatcaaaacgaaagatgctggaaaaaacaattaccattaccagcatgatcatgagcggattcaagatactccagagatatcccagaaagcttctgcggtatttcagcttcacatcctttgttaccagctcgatcagaagatcacggtatcccatccacccctgttttctatatttgttcatcgtatataaataacctttccatcctattctgtatcctgccacaacacattcaatattatagactattcgggttttcttgacaacttaatttgctatttttcatcctgccagagcggaatcagcatattgtctgcaagttcttctctcggcaaaaaaggagccagatcctcaagcggcggacttaccagtctgccgtctggcagacgtcttgtcgcgctcttcggttcaaacttctgttctgttgaaacaaatatttcacaaatagcgcatccctcctgtatgagtgtctcgctcacagcacgcatcatatctgcatttgtatgcgcactccggtaaggatagccaaaagctgccgcaatctttccaaaatcaggaaatgacagatcaccactctccggtccgattcctaccttctctctttctccaaacaaattgttctgcgtctggcgaattgagtgataaccctgattattaatcaaaaatatctttatcggcagccggttggttaaaatcgtctgcagttcctgtagattcatcatgatgctgccatcgccttccagacatatcgttgtctttcggttataagcaatacatgcacctatagcagccggaagtccgtatcccatgctcgccaccccgctattgatcaaaaagcgggaatcttttcctattatatagttatggcttcctacgacgcaggcgcttccattcgatacaactgtcatactgctttccggcagactgctgcttaaatatctgacaaaagcatagacatttgcgtatcttccatcctctttccactgtctctctgtcgtcacaggatacttttgtttccattccgcacaccggctgcgccatgccatttgcttcttaagtactttctcctgttccattacttttttttcttcttcacgacatagctctgcctctttccggttcattgcagcaagaaattcacatgcgtcggcacagatcggaagttccacatgaagcgttgtctttttcaattctgccggatcaatgtccaccatgataacataagcttctcttgcccagctcttccagttataacctacctgacggatcgacagccggtttccaaccgccagaatcagatctgcattctgtaccgcgaaattaccggcacgatcacccatgataccgcctcttcccacataaagcggatgtgtatcctcaataaggtcaatcgaatcccagcctgtcaccaccggcagcttcatctgctccacaaatctacggaattcttcatagcctcctgaaagccgaattccatttcctgcgtaaaaaaccggtcgtttcgcatgcttaatccgttctaacacctcttcgatggtgtattcttctattggcgttctacgctctgcattttcctctgccggatgatatccgcgaagatgttccgtctctatcacaagtccctgaaaatcgaccggaatgtcaacccaggaaggtcctcttcttcctgtcgtggcaagatgatatgctctctccagaatataccggatatcctccggcttctccaacatcactgcatatttacacattgatgctgctgcctttgtaatatcaaactcctgatcgccaacagcccgtatgggcagaccatttgtaaactgctgcatataacgcgccgtcgtgtcataacgcacctgaccggaaacaacaagcatcggtatagaatccagccagccgcccagcacccccgtaagtgcgtttgtcccacccggacctgttgtcacacacactgcagcaattctgttattaacacgcgcatatgcttctgctgccatagcgcatgcctgttcatgatgattataagtgcagtgaagtccttccttatgaccaagggcatcattcagatgcattgccccaccgccaaccaccataaaacagtctgttattcctttttttaccagaaaatccgctacataatccgctaatctctgtctcatattcttctcctgccagccatcacctctcagcttcttactttctgacagcctctgcaataatctccgccatataatcaatcatctcatccgtcattcctggatatacaccaacccaaaaagtatctctcatgatacggtctgtggttttaagttcccccacaatgcgataaccgctctttgctgcgcgcatctggtcaaaacaaggatgcttcgtcagattcccggcaaacaacattctcgtctgaatgccatgctcctctatatacggcacaacctttgttctctccaccccttctctgcaggtaatcaaaaaaccaaaccagcttgggtctgctccctctgtggcctcaggcagaataatcctatcctgacagtcaagcagtcctgcacgtaaccgttcaaaattgtggcgcctgcgtgctgtaaagccatccatcttatgcagttgcgcgcatccaattgcagcctgcatatccgtagcttttaagttataaccaaaatgtgaatagacatacttgtgatcatatcccttcggcagttccccgtattgcccatcaaatcggtgcccacacagattgtcctgtccggacgcacacacacagtcacgtccccagtccctgaaagagcgcacacagcggtgaagcagtggattgtttgtataaactgcgccaccttctcccattgtcatatgatgcggcggataaaaagatgatgttccaatatccccgatcgtacccgtcatctgctcttttcccttgtaatagtaggtacttccaagtgcgtcacaattatcctctatcagccagagttcatgcctgtcacaaaaatcacgaaccgctgacagatcaaaaggattaccgagtgtatgtgccgccatgaccgcctttgttttatcagaaagcgccttctccagcatacacacatccatattgtactgtggaatcgtcacatcaataaacaccggtactgccccatattgaattgccggtgtcacggttgtcggaaaccctgcggccactgtaataatctcatctcccggccttatctgccgctccccaagaagcggtgatgtaagtgccataaatgccagcagattggcagatgaacccgaattaaccaacgaacagtatttaacccccacatattctgcaaattctttttcaaactgcgtggtatatctcccggatgtcagccagaattccaatgcactgtccaccaggctgcacatctcctcatgatcatacacgcgcgaagcatatggaatccgttctcccggtgcaaatgcatttttctttccatgatacttatcgcaatatgcctctaccatattaagaatttcttttctggcttcttcctctgtcttatgttcaaacatctttctaccctgcatctttcttattctgatcaatgattctgccaaaccatccacggagcacgatttgacgcaatcatgctctcaagctgatccttttctctcttggtatccatacactgccaaaacccgtcatggcggtaggcatccaattccccatcgctcacaagccgtgatattgtctctttttcaaaaacagtgtcatctccttcgatataatcaaagattcccggctccaataccatatagcctgcattgattctggatccgtcaacttctgttttttcccggaaggctcgcacagtctcatccgagtgatcaatctcaagcacgccaaaacgctgctccacatgtactgctgtaagcgttgcaatcttaccgtgctttttatggaactccagtaattccgacatattgatatctgatacgccgtctccgtacgtcatcataaacggctcatctcccacataaggctgaatccgtttgatgcgccctcctgtcatggtattaagtcccgtatcaattatcgtaaccgaccatggctccgcaatattattatgcacagtcagttttccatcattccgaaagtcaatcgtgatgtcgctgttataaagataatagtccgcaaaccattctttaataatatgctgtttataccctgcacaaatgataaaatcatgaaatccataataggaatattctttcatgatatgccataaaataggtttgccaccgatttcaaccattggctttggttttaaatggctttcctcactgatccgtgttccgaatccccctgccagaattactaccttcattcatgttccccgcctttatctgtttttaaaaatctgatacaccattgctccgatcggaagaatccgatatccggtttttctgagcatcgttatgcttttctttctggttgcagcatagattcccggataatgttcttttaatccaagatcccattcccttaattctctctgtatctctttctgccgccccatgctgatataaatctgaaactgattttccacaacctgcgcaatgcagcgttcaatataataaagcgttccctccgtcagtccttccaatccatcataaaaagaaagcagactattgagcacacgcatatgctgctcgcggtttttctgcatactcttaatatccatactctgcccgtttcttccaaggcggtacatgtagatgaacttcggatagaaataaactgttttcacataaggaatcggataggtaatatactcacaatccacataataacaatgctcatcaatgacaatgtcatactcttgcagaatcctggttcgaatcgtaagggcatgcatttttatcacatctgtcacaccgcccgctgtaagatccacggtacatccatattgctccctgctggatgtggcatgtttttcacttaaagtctgctctgttccatcctgaacacacaaaaaatccgctgccacaacatctgtgtccacctgtgccagcaattccacaaacgccgggagttcctctgtgttcagccagtcatccccgtccacgaccttaaaatattttcctctcgcataacggattccgtaattgataccggacccgtgtcccccgttttccttattatataggaaatacgaacccggatatttgtcgcaataacgctgcgcaatcgccgcagtcttatcctttgatccgtcattgataactaacacttcgatccgttctaaaatttctgcgacctcaaacgatgccagacagcgttccagatacttttcaacattgtatgccggaataacaatacttaatatcttttccatgatcccctctctcatcgccggagcattctccggtaaatgattttcctcacaaaatttggctgcagggtgacacccatcgttaaaagcaacgccgtcagatactctctgccacaaagccaccccatttttttctgctcccgccggaaagaagcatactgtctgaaataatcctttcctccgcgccgttcatagacactgttgttgttgcgcatatgtaccagcacctcaggcagattataaaactccattccacgcaccagcatgcggctccacagatcataatcctccaacaggggcatatgtctgtaatttcccgcagcaagaaccgcctgtttccggaacatgaccgtcatgtgatttaccggattacggtatttcccatagcgccgtatttcttcattggactgcggcatctgtttgcgtctgctgtaagtcccctcatcattaaattcctgcatccatccgccacagacagccaccgtgggatgtgccgtcatgtaatcatgctgatgtctgaatctgtcatacacggctatatcatctgtgtccattcttgcgatgagctcatgtgagcataattctacacctttggcaagtgcacgcccgagctgcacattctcttcaaaggaatatgtcacaatctgcggatgctttttctttaattcagaaatagcctgttccagtccttccgtcagtggtccatcctccatcagcaccacttcatccggaacaagtgactggttgaatacgctctccatcgcctcttgcagatactctggtttttcttttttatatactgacattagtaccgaaaatcccattccgctcttcccatcttcaaaatctctttttactccttcagtgccgtctgctgcgtttcatccacgccctcggtgttctccttctggaagagaatcttgaacgtcagcagcataatcttgacgtcgagccacagggaatagttctcaatgtatgtgatgtcaaacttcagcttgtcatacggcgtggtattgtattttccatatacctgcgcgtatccggtcagtccggccttcaccttggtgcggagcatgaactccggaatctcctcggcatactgatctgcgatcaccttgcgctccggtctcggtcctaccatggacatatcgccctttaagatgttaaacaactgcggcagttcatcaaaatgaatattgcggatgatctttccgaccggcgtcacacgcttgtcgccctttgccgcaagtctggcaccgtttttctcggaatccatgctcatgctgcggaacttgtagatcataaacggcttctcatccctggtcagacgctcctgcttgtagaacaccggacctccgtcgtacagcttgaccgccattgcaatgattaacatgaacggcgatgcgatcacaataccaatcagtgacagcataatgtcgcaggttctcttgatgatacgctgatcgatcgacagtccctgattgcgtgacagcagcagcggcgtgtcaaacagatggatgtcatccgccccgcggaaaataatgtccgagatcttcggtgtgacataggtccggatcgattcctggtaacagaacttcataatctggtttctcgcctgtgccggcagatcacagagcaccaccgcattgtattcgcggatcatcggataaagcttctcatgaccaatctcatagctgaccgatccgcagatattgtacttgtcgcggcgcgtattgatcttcgagatcagctcgtccggcgcataatgcccgtagatcacgagcatctgccgcggcggatacagcttggtgtagagttttcttatgatgtagatccacggcaggatgaagactgtctcaactgccatgacgccaagcataggtgccggctccacataatcacggcagatcagacagagttccagatatccgacgatcccactcagtaaaatggataaaatatgggacaatgcaatatccgtcatccgcatataaccgatattatacccgccaaataccttcgtaaaaaagaagatcaccagcacatacagtccgacgaccgcccagtttccacggcgccagaaaccaaactgctcctcgtaaacactgtaccagatgtagccaaagcagactccctccaccagcagtgtgatcagattcgctccgtaatttaatagatgcttatattgctctcttaatctcattcagttagattcctttgctattattccctaaagtatatcacatatgaaccggctatgccatagcagtcgtatccggcgctctccatcaacgtctgatcgtcataatccgcttccaggatcacacagttgctgttatacttttccgccatggcaatctggttgtcgactgccgccggcaccgccacaatgcttgcacagtcctcgataaactgcttctctgtctcatcttcggtcacagtatcctgtgcgatcatccgctcgatcaaatcctctccgtagagcagattcaccgaggcgtccagttcgcggatctgtgcgcagaccgcacgcggcgcaatcatattctgtatgcttctgccggactcccgcagcgcatcgtcgagttctgcaatctcatgctccacatggtacgcattctccggcacggcaagctttggcgccgcaaactgaaaactcatactaaccgccacgagcgccgcacacaccagcacgccgagcgctcccgtcgacacatgctttgtccccaccgcaagctccgtcaccgggattgcaaccgcgaccgccggaagcagcaggaaaaacattttccaataagacgtctccatccagaaggtgctgatgtcattgtatccgaacggattccccacaagtaccagcatacacgcggcgtaggccgtatacatgcggcacccacggctaagccgcttccactctgccatcagaaagagaagcgctgtgagagtcagtaccagactgatgcccccggtcccgaactgccggaattcactttttaacagttgatagactgcctccatctctccacctctttatcagtgccgcagccagagccgctccccacacaaatgtcacaaaaaagaatcctttttcatacaacagctgtcccgcagccgcactcaccacataatacagaatcacatacggctgtccgaacgcctcgatctcccgcagctgtttcttctcacccagaacaaggagcaccgtaagcgggagttctcccaggaagaaaagcgtctccccgttccagcagttctgatataatccaaatgccacagaccagtctgtgatcagcgaaaccgcatataaaagccacaccacgatctggaagcaccattttttcttcgtgtcgcgttcaaacaaatattctgcccacgcggcatacaccgccatataaaacggaagtaaaaacaccggcagcagaatacggacaaactttgccggatgcagattgctcattctgacatacacagcatagtaagccgcaaccggcgccaccttctgcgcatcaagcgtttccttctcaaagtccatcatatcggcacggcttttccctgtcatggcgtcatactcatacaacgaatccgtcatgtacatggtcatgacctgctccaccgtatgctcctccgtccggttcgctgcaaatccgcccgcgaccgcaaggataagcactgctgcaagcactgtaataaccagattcgttctgtttgtcctccggatcagatcccgcatatgccatctgtaaattataacgcctgccgacaggattgtcaaaacagcgagcaggacgcaaaagacccgcgtaagcttcgtcagtgaccattttccgtcaagcgcgatccgcaccagtccgtaaaacagcgcccagatcgtaagactccccatcagatatgctgaccggcgcttccggtactccctctgcgggagcagtccgaacagacacccggtcagtatcggaagaaccagccacgcaaaagcaagcattactgttttcagaattgtaagcatcgtcctcgttcctccttactctctcgcacaccggtatacttcatatccgtccaccgcgccgacataggtgagatccagctgctgcagatattccgcagagtaatactgggtgttacgcacaaaaaaatctacctgacgctctctaaaaacctcattcataatcgatgcgtcaacctcgacgcccttcacgaacagggaaactgccgtgctgtgatcgtcatactgcccgtctaccggaagttcttccgtatctatgaacatataacgcaccatctccgtattgttgaccgcctcgatcacggtcggatcatactgccttatgctgctgtacatctcctgatcgacaagaattaccggattctccttctctgaagtctccgcgatcagttccgatgtctcgatcacccaggaatctattttgtacacattttcatccggaatgtactttaccagactactcccgcacaaaagcaccatacagagcaccaccgccccgatggcaaattgcacttcccgctttgccttccggttcatcagacgcgccaacagataggcacacagaaactctgccggaagcagccagtaaaaacgcatatagcggtcctcccaccccatcttctcgatgatcgggcgcatcagaaacggattgtataccgtcaccagcagcgtcagaaacggccagacaaacaagtctgtcagctttctgtcctttttgtatacaaggtacaccaggcctcccagatacggtgccagatacagcgctccgttccaatatttccaaaaattctgataaaagaaatctatttccgccattcttttccctcaacctacaaaaagctcatcacaccggcagccagacacggcagcaccgacagcaccgcatacccccagaatttcagcttcttccagcgaagcagcaccgggagaagtccgacacctaaaagcattggtatcatgaacacaccactcatcgacatcgttgccccagcgaacccaaagacgccaagtatgatccagcactgctttttctccgtctcttccgctgccagcacaatggcaagcaccgcaagcggaagatatacattcgccagcatggatttagactccgccatgcgcgtccacagatagtagcccggaacctcgcccagattccagcactgcacgctgatgagcgcacggatgattgccgtccacactgtaactgcgcggtttccttttgagagccgcagggcaatctcatagaccgccagattggctgccacgatctcgatcacgcccataatccggttgaccaccaccagcggatgcatgaaaagaagcttcgctaaaaacgcaaccagcatggaatagctgtcgtgccaagccaccgcttttcctacatagacaccggtatacgcatcgtactgatacatggtgtccgtatagagcgcgttgattgcattcccgttgtaataactggtatcatagcggctcacatacaactggttacccatgccgtaccagatctgaaccaccagcagcacaacaaacagcagcagccacacatcgcatacaggataccggatcatccggaatcctcctttatttttcccggttctgaccagatataccacgcacaacgcaagcacaagcacaaactcgccgagtgctgtgtaaaaaagcacatgaaacgccacaccgcccgcctcagccagaatatccacaacggagaaaagtccgagaaaaaccgccatgccgagaagccacaaaaaacccaggtcttcctgccgcttcataaggcggcagacgcccgcccccaatatccagaatatgcaacttaacagcgccaatccaatgacgatacccaaagcagaattcatacgttttttcctttttctattctttatgccactttataacttcatattttccggtcttgcacaaaacatccatctcatcctcgaaaccatgtccggattcccagttctggaaagtctgtgcatctgcctttgtgtttgtaatcagaattgtaatatccttctgctcaccaatctgtgtgtctgcaagcaatgcatccaatttctcttctccatacgtcaacacataaacactctcataacggccgagtaacggaaagcactcgtacccttccgcatgctcccggatcagaagcagccgatccgtatctgctgcttcaagcgccgcctcaacctgatcacttacccgcacttccgtattcttgttataataagtatacaccagactgctgccgatgaaaactaccgcaagtatggaatatatcattctgatcctgcggggtctttggattatctccgccaaaaatcccaactccatcacaatcacaagaaacatcagcggatatgccaccttaaaatagggaaaacgggtagtcaggacaatcaatgcacaatagcccgccagaagccattccagccagaccagccgggtatcttttttctccgcttttctaacggcttgaacaagatttatgacaaacaaaatgaaaaatcccaccatccacaatacatttccaaacaccgcaccggcaaatcccgagacactctccttaattgcctgtgccagtgatgttccagttcccgaaagctttgaaaacaaccccagcacagacatcggatcaagcagaatgccgattccaattgccagaatgccacagatgacatagcgtctcatattcttttttctcgcctgccctgtcagatttttccccagccagaccagtgttgcaataccaagcactgccgcccagactccggttgtataatgtgcaatatatcccagcggatagagtatcagcagccccacaatatcccgccgcacggctttttccatcccattccgtatcgcctgatataattttaagtgcaccagcaaaagtgcgagttgaaatgccatggcaagcatataagcacgcagatatgtacttaaatccagacatcccaccgaacacccaaacaacagacacaccataagtttcctttttgtatccgcagtaaagtatccggcaatgccatacaacaaaaccaataccgccacaagtgccgctgcattgaccagaaaagcactccattttgttgcactgatcccggggaatattgagccagacagatgcaccagttcataatacagataggaattggcatcatcccccatcgcgttcaggtagacatcccccagatgaaagcgctcatcctcacgaatcgagaaccatccgctgatctgctctttcccataccagccgcattcttccggtctgggatacgaaaaataagcggctccccgcctgttttttgcgagatccaatccgaatgctgtaatgttttgaattgtctgcggtacagagtccgtgagaatctcttcttcaaaatatgcacggattcgtccggtcgacagcatccatcctttatccgtactgttcgccatgccataggtaacgacctcatccccgaccagataacggtcaatcgccatatatcctcccgtaatagcaagaatcaatataatcactgccagcagtgccacaccatgcctgatttgcttttcatctgttttcatatgttttccctttatccatagtttctagcgattttgtaaccgttcaagccctttgtgcaacagctccatcacggtgtcgttccggaaaaggagcagacagccgaaatagaccgctgccgccgccgcaatcagaacaaacagcatgaccggcaccgtccatgtcagacgtttcagcaaaaacaccacagccgtcatcgctgccagcgccgcgcccagactgatgacatagttcctgccgatcgcaaggtgatagctgcatcttgcatgccacaccagcactgtggtcacggcgatctccgacagaacggatgcaatcgcggcaccgctctgctgcatggacggaatcagcaggaagttgactgctgcattgattaccgcccccgcaatcgttgcgtgaagaattttttgttcctgcccggttgcgatcagcacgatgtgtcccaggaaatacgccaccgagaacaccagcaccagcacgctcaagatccgcagtgttccgatcgacggcagaaatgcctctccgaacagaaacggcacgatatactctgccgtaatgccaattccaaccgtacacggcagtgccagaagaagcataatcttaaaaccccggctgagcagttcgttgcatctgtcatattctttctgcttgtagtgatagctgatgcgcggataaaaaaccgccacaagcgcgatcaccaccgtgtaggtcatacgtacgatcttcaccggattggaataatatcccacgcacgtctccccgtggtaatattccagcatgatggtatccaacatcgtgtagatctccgtcgcgatcgtggacgccagcaggatcagcaccggctttaaatgcctgcccggatgcagacccgcgtccggttttccgatatatttccgcagattccacgcatttagcaggttgtttcccgccgtcgccacgcagaggataaaagcgtagatcacataatcttttgccttctttacaaacagaagcatcgccacaaacgaaagaattttcacgatgatgcttctggtcgcaatataactgtactcctccattccctgatagaaccagtcaatgttaaaaatatttaaaatcagcatcagacccatgatctgaaacagcagcttccggtccgcaaaatgcggaaaattgtccacaaacacatagtacgccacaatgcacatcagtgtcgcggcaagattgataaaaaacagttcccagaaggtgcggcttcgcccctcctttgtctcaccgctctgcgcgatcgcctttacgccgtaggtcggaatcccgagcgacgcaatcagcacaaaatatgccacaatcgtgttggcatacccgacgcgtcccacgcccgccggaagaagaactctcgagatataggaagtggtaataagcggaaaaagggccgtaaagcccttatagatcatattaaatatagagttttttaccagtgatttcttctctgccatacgttcttcctctatgattctgtctatcccagccgcccgaggcggatcagaagttccctcttccaataaaacacattccggtgccagaccccggttttactgctgccgcacacggttctgatacattgcattccggcgtagcgctttgccagccggcggaaattctcgttgtatgcgtgattgatatgccccgtcgagtgatggatcagcgccacgtcacagacatagacattcccgccgtgccatctggtatgcagacagcgctccacgccgtacagatgccagttatcacacagcttttcatcgaacggattctttttgaaatgtgtcgtgtgcccgccgaaaaaacattcatccagcgaatcgcacgccctcatcccggaaaatgcctgctcgccggctgcggcaagttctccttcgccgtgctgtactccggataaaacgattccctcggcctcgccaaagtacttcttccttcccggaatcgcccccggcacaatcccggcaacacccagcagatccgcctccccggtctgcgccaggtatccggcaaaccgcgcgagcgtatcctcctttggaagttcgacgtcctggtgggcgtagatcacatactccgtctccacgcgcgccgtcgcggcattcagtgcaaggctgcacgatgcatactgcccgtggcaattgtccatgccgatcagctcatacccggtattctgttttgcaagggatgcctgtagcctctcgtattgtttcctgtcgttgtagcagcagacgatcgttatcttatttttcatattttttcatcagaccgagaaacgcccggtacgatttggtgatctgtgtatagtaaaaaatcttggcgtcgcatacatcgctatacagcttccttgtcgtcacagcctctttatgaatgcagatgacctccggcgaatacagcatccgcagtccgctctttgccgccagatagtagagaatctcctcctccgcatacaaaaaggtgccttcccagaagccatcatacactttgaagaaatctcttgaaaacacaaggcagcatccgtggagcagcactccctcgcgctcctcgccgactctgctgtccgccgctaccgcctcgccgtccacctcgcgggtcgctccggtgctccgcgacagatcgcctccattcttcttccccaaaagcagcctggacatccggtagctcatcgcccggatccaggatgatacgatctgctttcgcatatagttcaaggtataactgcgcttctccgccaccgggttaaagtgctgcgtgcgggtcgcgtccacaacatccgcgcccagtatcgcatacggctttctgtcgtagatctcaaacaggcgctcacaaaaatccggctgttcaaacaggatgtcgctgtttgcagcgacgatcagatccggatcatagtgctctctcgcatagcggatgcctagattgttccctctggcaaatccgagattctctcccgacgcgatcacgcgcacccgtttttcatcgataaaatgctccacaagccactcctcgctcccgtttccggaaccgttgtccacgatgacaatgtgcatgtttttccaggtctgcgtcgaaaggatcgactctgcacatgcggcggcttcctcgtatgttttgtaatttaagatgacatagcaaatcgttctcatcggcactgtctccctgaattcttatgcgcccgagtatctggtcttcgtgccaaggataatgcggacatacggggtgatggaacgcacgattgccgttccgagtccaaaatacttgtgcaggaaatggaaccagtcccggaacggcagtccctttctgctctccttgagcttcatgcgctgcatccttggcagtgactcgtcctgccaggttccctttaggctgccgtcgttgcactgcccgatgaacttcgggaaaatacggatctcatatcccatccggctgatggcgagtccgtaatcaaagtcaccgatactgtgctgataaaacgggtcaatcgacactttcatgaaaatgtcatgcggaatgaccgcgcagttcgcgttaaacgtgtcaaaacagatgtcctgcgcctctgggccgtattttttgtacttgatgcccttgacgtacttgatgccgccgtagctcatcctgccgtcatccccacacatcgccccgaccatgaccttatccggcgcaaacaatggaagcatctcgtcaaaaatgcccggcacaaacttcgtgtcgtcgttcatcagcatataatactcgtaatcgggatgcacctttttggcgtgctcgatcgcctcatacatgccacggttccagaacagtccgccgtcgccgttgattaaatcgatctcatacggcatcgccgccagcatctcatccgtgccgtccgtgctgccgtcattgacaatcacataatcaaaggtgacatttttgttctgcccgagcagctccatactctgcctggtcagctctcttcggttataacaggtaaatatcgctaatactttcatctgattctctccacgttctgcactctgtgtcttgctgcgcaatcctatatttgaccgatatagtttctgcgaaacacaatgtgatagatatgttttaacaggttcggctccgattcatgcagcagcgcccgcttcatcagccggtgtacctcgggacgctccgccacctcatccgggaattccgtgaccgcgtgatccgtcgccagatggtggtcaaagaccggttccctgctctctccacagtgaacgccgcttccgtcccatccctcgttgctcaccagcgagcgcagcggtgagaggatgtagccgtcccgtttaaaattcgtccagtaccagcggatcgcccaggaattcgtccccgcatccgtctgctggtccttcataatcttatagaaattgtaagtgttatcgtaattaaagcggcggcgcagctttgcatcctctttcatccgcgtccagtcgctgcatgtcgcatcaaaatgccgccaacggtctgcccaggtcgcccatgaccagcttgtcccggtcagcgtgtgaaaataggattcacacggcagtgtgaccgtatccgcaaaatgggaaaaaccggtcacgccggtcaccttgggattcttctcgtagcgcgagagcgcatcattcataaaccgcaggaaatagcggttcgtcacaagatcatcctccagaacgatcacggtaccatagcgctctatgatctccgtcacaccctcgatcacgtttctggcaagcccgtaattttcctcccgcgcaatcagcgtcactttgaaaaagccgcctgcctgcgccacgtagtcgcggatttcctgtactttgccccgatccgcctctttttttgccgcgtcggagaacacgaacagttccgtgtcctgcgccagttcatttttcgccagcgcttctatggtgcgtctggtgtgctccggtctgttgtaggtaaataaaatcaccggcgccgtttttttctcagccatgtctctcctcctgccgatgtccgtctactcctgctctctcgcccattccacgtatgcttctatgccgtcggaaagtgccatgtgtttctcatatcccagctttttcaacagggagatatccgctctccagttgcgcgggtcgccctccttgaccatgccgttaaaggatacgacgtccgcatccgcgcccagctttccggcatagatctccgccagctcgcggatcgatacttcctccccgttcgcgacattgatgacgttctccggtccgtcataggcaaggatcagttcgatcgcacgtacaatatcggagacatgaatgaaatctcgcgtctcctcgccggttccgaacagttcgattcttccggtgttctgatatttctgatagatgtcccacagcagctgcttgcgcagtccgttgccgtaagcagaaaaaatacggatgctgcggatgcgatagccgtgaatccggttgtaatactcgcagagctcctccgccatgtgcttgtgcagcccatagggggacatcggcgccgcagcgtctgactcgcgcaccggaagctgtctcggattgccgtagattccggcactcgagaggaaaatgatctgcggtcttttttcaaatgacttcaatgccagaagcagctgatagagactgtgcagattgccatcgagatctgccatcggattgaccaccgaagccccgacattggcgcttcccgcgcagtgcagaatcacatccggctgcacgccggtaaagatcgccgccatctccgcggactcctgcgacatgttgcactgatagtaggccatggtgtcacccggctgcctgtctccacagtaatttgccgccagatccagtcctgtgatctcgtattctttttcaaaatattcctttgcgtgtctcccgataaatccgttgacaccggttatcaccattttcttcatattcatcctccggcacaaggccatcttccattacacgaaaatcttctccaatgccttcgcgtactctcccgcctcgcggtacatgtttgccattcccgccatcatatctcctgcaaaatatgcagcttcttccggccggtctgccctctctgccgtctccacgatcagatctgccagtgcatccggatcgtgcggatcaaagagtgtgcatttttcattcttctgctctctgtgtaccggaatgtccgacaacagcactgccttatctaacaccttggcgtcctccagcaccgttccccagccttcgcagagggacggctgcacgataaaggcggcatttttcataatacaaagctgctccgtgcgctccacaaagcccaaaagccggatgcttcccgccaccggttcagtctccatgatcgcttttagctcattgatgtattccgggttgcggtagtcttccagattgccggtaaacacaaaatcataatccgcgagaagtccccgctttttgatgcgctcgatcgcgcgcaccgcgaccacatgattcttgtgcttccagaactggttcggcagatagacgtactttttatgcagtccgaatttgtccgccaccccgcgctctaactccggcgtgatcgtgcgcagttccggctctatataggagacaaaatgcaccacctgcgtcctgcatttgtgttccggataaaaacgctccagatcatggcgtgcatcctcactgcttaataccagcgtattcggaagttctgtcatcttccggtccgtgacgtccttgcgcgccagttcctccggctggaagaattccggcagcgtcttgtgctggaaatccggaatccagaaaatgccgcgtgaggcaaacagactgccgatcttgttgagttccagcgcgtagcagtatttcacgccatgcagccagatcagattcatctcgtagagcgccagctttgccttgttcgttccgtcgtagatatgcaggtcgatgcggttcccaaagcaggtaaaaatatccgcatgtgcggagtcgatcaataccacaatacggtattccttttttatcttctcactctccagacagctgaatatgatattttttaagtagtacaaaccgccgatccatccgcggtttccaagtccgttgaacaatatttttttcatctgacagcctttcccatcacatagcagagagcatcgatacagccctttgccacctcttcaaatgcaaatgcatgcgcgcgctcgtagctgcgcgttcccatctccttaagacggttttcgtccgcaaaaatctgatcgatcttctctgcaaacgcatgtgtatcctccgggtcgacgatgtagccgttctccccctccgccaccaggtcaaacgcaccgtcggcgtactttgaggagatcaccggaagcgacgcacacatcgcctctaagatcacgagtccgaaacaatcctctctggtcggcaggatgaagacatccgcgttgtggtacagttcgcgcagcggctccccctccacatatcctaaaaagcggatacggtcggtaattccaagctttcccgcctgttccgtaagaagctcccgctcctgtccctcgccaacaatcgtaaggtgaatgtcctcgctcgtctctgccagcgccggaagcagaaggtccagcccctttctctggatcaggcttcccacatacagaagttcccttccgctgtagtcttccttttcgcgcagatatttctgaatgtcgaccgtcagataggagagaaaacatttcttctcatccgccccgtatgcaatctgcgcctgcttcgatgcggtgctgctcgccacgaacgccgccgcacgctttatgatgtaactccgggaaagccgctgcaccttcccgatatttttttctgaattcaaggttccatccgtccagctgatgaatggaatccgcttttttctgcaccaatgtaccgctctaaggatcgtcgggttgtattccatggcaaatacaagatccggctttatttccgccagcagcttctccacgccgaccggaaggaacacataccggtcgtcaaaacgcttgcggataatcagtgtctttgatttcaagaaatggtaatggctcagttccgccagttccacactccatttgcggttctccatgcccgccccggaaaaaatgatatgaaattcatactccggataatgcttctgcagatatgcaaaaaagtccacccggtacggcgacggaatgttcgtgataaatacagcttttatcattttgatatatcctcataaatcctgatcagtttctggtaattgtcctccgggcgaagacgctcggcataaaaggctctggcgttctttttgagcaccgacagatccatcgcatcaaacgcgctgatcttgtctgcgagatcctccgcggaattgtaggtaaacttcacaccggtaatgccgtcctgcaccatgccgtccatgtttccgactcttcccgcaatcaccggcacgccgtaggagtacgcctccgcgatcgtcatcgcaaacgcctcgtagcactgcgatgtcatgatgaccgccttcgcctgatagaacttctccgacatctcgtccttctgcagatagcccagaaactttacattctccatatgatgttccctgacatagcgctgcatctcttccatcatcggcccgtttcccgccacatacagcttcttgtccggcagtttttcaaaggctctgactgcaatatcgattccctttaaggcttccacgcgcccggcaaacaggaaatattcttcgtccgagcgcacctcgttcggcacgatctcctccgcgaaagtaaaattcggcttgatgtaaacccgttccggattcacgatctctttctttgtatccagcgattccaacagcttcttccggttgaactcggtcagacagataaaattcaccctgcggtatgtccccacaaaccggtgaatctgcaggatggcggcgctgacaaaagactgcagcttgctgttccggtagcacttgtgccggatggcgcagcccattccgtgctgcacacactcctcgcagatcacattgtcccggaaaaaagatcccgccggacagagcatgcggaaattatgcagcgtctgcaccaccggcaccttgcagcggaatgctgcgtaaaagacggacgggctgaccatcgtcagcgtgttgtgtacatgcacgatgtcgatctggttctcccggatcaacttttttacctcgcggtaagtcttaagcgagaacaccgcggtaaacggcaggaacagctttcccacaatgcccttcttcgccagctcgctgttggagcggtagtacgtgtagaccttgtgtccgtgttcctcgagcaggcgcttttcattgcgcaccaccacatcttccccgcccgggatctgataaaaattgtgtatctgtaaaatgcgataattcttcatagacttcctcattccgccgcacatacatcatcccgcttcttctccagcagatccggatagagcagaattccgcacagcaacacaaacggattcataaaaccattcatgataaactgttccagcacaccgtaaagtgcaaacgccgcgatcatgaccagttctttgtaatagccgccgcggtaaagccgaaacagcgttttcgtcacacaccacaggaaaaacagcgccacaatcgcaccacagtacaggaacacaaacatgtacgtgttgtcaatcagcccgtaatactgtccgtaaaacagctcctgcgcccgcgggatcagtgagactccctgtgtcttataatagctgctcatgatatagattcttcccgacaccagatggtttaaaagacgcatcacagaattgccgccatcgtagaacagcatcgtgcacagactgaataccgcaccgaccggaactgacagcgcgagaaccaccttccaccggtcctttgcaatcttttcaaaaataatcagtgcccagacaaagaaaaagactgcgattcccgttctgcagtaggtaaatttgtagaacaaaagcgcggttgccgatgttccggcgaaccaccagacattcagttttttataattataatatagcagtagcagcaatgtcaaaaagaccgcaagaaacgccgtgttcggctcattcatggcaaagctgtacaccggaatctccacgtagctgctgtccggcgtcgttttgtaaccaatatcaaagaccccgaacgttgacccgatcaccagcatagccagacagaagacccggatgtacaccgccatctgaatcatcagctcgaacctgcagttcttcatggcaatgatcgtcatgaaaagcagcagccacgtattttgcttcgtaatcacggagagcccgagtccaagagccagcagcaccgcaatccacgcaatctcacggagcgtgtagcgcgtggtcacaatcttgatcgcccagaagctcatggcaaagataaagaaaaatttgtatatattatcgccgtgatcgtacgccagcgctttcatcaggatattgatcgcaaaatacccgtaaaacgccgcaactcccacgctctcccaatcacttgtccgaaaaaatgtcttgattctatccataccgtcctttctgccttcctgctaccgcgctatgatccgattctggaatacaccgcatatacgtcttcgatcacagcaatcttttcatatccgtattccgtcagatcctcggggatctggtgaaaagaagtattaaacactatatatctgcagttcttatttttcgcaatctccgtgacacgcgccacatccggatgctcgctgctcatttcctcgtagacctgctgttcttcctccccgatgttggagataaagccctccgcatttcttccgtacagcagacatgcggctgcggaatattgtctgacactgcataaaagctcgttcggcacgataagcgtctcctgccagtcaaccagccggctctgcaccagatccgcaatctcaaccgccgcctgcggcagttcgtacacattcgaccgctccccgtaagtctccgccgataaaaccggcttcccggtcacgaagatacagacacatgccaccgccaccacgacaatgcgcagtgcctgctttccaagccggtacgccatccttaccaccgcataggcgatcacgaacgtccacggaagcatccacagcagccgccaatacaccccgcttaagaagcgggttcccacatatttgtagaacaccgggttgaaaaagaaaattcccaccagcaccgacggccagaacaatctgtgccgctcctccttccccaggaagaagcagcagaccagcgccgccgcaaacagcagcagatggacgagaccggcacgtccgccggtaaattttacaaattccccccacaaagccagtacatagcccattcttttactcctacatcaggtaatatcctaaaaagatcacacacggaaccgctgccagccagatggcaagcgtctttctccagttcctgtaatagcaaaaatccagcacgccatagacggcaagcagaaccggcgctgtcacgataccaattccggaaagcatgcacgtgcccacacccgccacatagagaagcggaatccagcgtttccacgcctctttcttcatgatctggtaaaacagatagaaaaacagcggaagcgcgaagcttgcgcagactgcctttccctgccagatgcgcagcagaagcatggacgccagcgtgtgcgtcgacgtgtagcccgcaaggtgaagcacggagagcacgattccgaaaagaaatgtcttctcccagtctccgccaaacagcacctgcccgatcagcagatacagggcatagcagatcagaatcaggaaaaacggcagatacgcatgcgacaacgccgccggcgccatatttccctctttggcatgcattgcgacaaacatcgcccacggcgaggtcagatctttacgtacctccccggtatcccagtacatgtagtctgccgtgatcgggtcctcccggtacatggtgtcatgtacgaccgccgatacttcctccgccacaaagcgtgagtcgtcatcgtcgctgtgctcgtaacgcgcggggatatatgcctgcagcagaatcagaaccgccgcaagaatcccaaagacaatcgtccacgttccggcttttccacgctcttttttttgcacgcctgcgccatccgccgtcccagcagccgcgtccgcaaccgtctccgcggcccccgcctggcgtcccagccagatgacaaacgacagcaccgcaaggatctgcagaatgatacgccacagcagaagtgcctgcgtcagtgttttctgcatcatcacaaacggcaccagcacaagctgtgctgtggcgagcattgtcgcaaagccgagcacccaggcgtgcagaagctgactggcgcgctctcttattttcaaaaagtccgtccacagaagaccgatccagaccggcacgaacacgaacatcccaaccatatagagcaggctcttacagctcatacaccagaactccttcaagcacgattccctgtactgccgcctcattcttaagacgatacagtgtctcgttattcactccgcctcttgcacacacaacaaagttcttgtcacagagctttcctgccgcaaaagcatctgcgctctctgcgacattcgggctgttgatgacaatgtattcataagtatcctgcatttctttcacataggaagcaaaacgctcgttcatgaccacgtcaaaattcttctcctcagccacatctctgcacagtacgtccagatagctgttctgcgtcgtcggtaccgggcggctctcgtcacccagaacataacggctgatggaattgcctgcttccttgccctccggctccttgaccagatcgatgagcagggtcttctttttctcatttgcaaagctcatggcaagctttaatccggcatcctttttgaaataaccgaccggcatacagttcacactcacgcccttgtgatccgctccgccctgtttttcttttaaaaacagcgctaatttcttatatacttcctcttcattcgcttttctggtcttcacgtcatcgatgaccggaatatccagacatgcacgcacttcctctgcgctcttcggcttccggtagagaatcagccagaaagtatacagtgctacctccgcaatgattccaagcagtgcacccgccgcgattccttttttcacgccgcccttgaaatcgtcctcagagataaagtaattctccgcttttctggtctcgctgttcggatacggtgcgtccagcacggtaaagcaggtctccccgtccgtgagctcgctgcccacctgaagtgtcgcatcaatgatctcctgtgtaaatgcaatggcgccgtcctcatcggcgatgctgaacgttccggtatcaatcggatactgcaggtagatcgtaaccatatctcccgcttcgccctgcagcacgtcgaagattccctgatacgtcttatagtccagatcgcatcccgtcttctgctgcacgcgttcatacgcgcggtagctctgcgccatcttaatgacattgttcgcgcgctccgtggaggcactggtgctgtagtctgccacatacagtgtggctgtcacctgttttacattttcatatacactctgctcgataaaaggcttcagagatttgtacttgtagccgccaagcaccgctgcgcacactgcggcacagatcagcgccagccaccatttgcgcagattgcactggatgatttccgcaatactgtattccctgtctaagcgatattcttgattcatatgattctccttccttattctccgcccttctcaaaaacaaccttgatcgtttttaagataatttttatgtcaagaccgatgctccagttatcaatatactgtacatccagctttaccacatcctcaaagtccttgatttcatttcttccgctcacctgccagagtcctgtaatacccggcttcgcgcttaagcggcgcttctgatgggattcatactgccggaactcatccactgtcggcggtcttgttccaacgaggctcatatctccctttaacacattgtagaactgcggaagttcatcgatgctggtcttgcggataaatttgcccacctttgtgatgcgcggatcttctttcatcttgaacatgaagccgttcatctcgttctggctctccagctccttcttgcgctcctccgcatccttgtacatggagcggaacttatagatcttgaagaagcggccgttctttcccacacgcttctgtgcgaaaaacagcggtcccggcgattcgatcagaagcggcggcgctaaaaataccgtaacaaccgcagtgatcgccagaccgacgatcgctcccgcgatatccatcagccgcttcacaaacagcatcttccagtcataatactggttggaaaacgtcacaaccggaacatttcccatcatattgaaattcttgtgataatcgtcaaaccgtttcaacagctcgattgtgatatgcacggtcgctcccatatcctcgaacgcttccaccacttttgccagggattccccggtatcgtacggaacgtttaagaacacttcgtccacaatctgttccttcgcatactggaacatggtgtcgtaggtcgccacgaccggaattccctcataccaggttccgatctggttgtcgtcgatgatcgcaatgccggtcagacggtgctcccagtcttttgcattctcgatctccgcaagcgtatccttcacgcggtccgtcgtggtgacaagaaacaactggttcgtcccccgcttgttgcggtagatgtgcagcagataatacttgatcgccgcgtgtgccacgaagaacagcaccaggttcatccctgcgatacagaaatatacgcctcgggaggcatccgcattgttgtgctgcaagaagatcgtcagcgctgtcacaaaaatcatgatgacgctcgcttcaagcgccgcccagaaatccctggcgagattgcgccggataaaattcttctccagatccgagaacagcaggatcagcatgtagatcacaagcacgatgccaaagctgtccatcagctcggacttcatgttctgcacggacacgttccggtatagaaccagccacagatagcccccaccgaaataactgatgacaaagcagatcagatccgccagaagcagcatgactgtctgaatcttttcttttgattggtacataataaaccctctcttttatccctcatagatgctttcccggttgcccagagaaaagtatatgcaaaagcgctgctccggcgccgcctgccacacacaatcaaagccgaactccggattttccacccgacggagtttaaacatctctgccacatccgcccgcgctcttcttgtaatctccgccgcaaactgctctccgcccggcgccgccacccggatgttgaccggaaggcatctcccgtcccaggtctttgcgaacgcccatccggaacagaccctgctgccgtcctggcactccgcccggtcgatatggtagagcagctttctcacgcgcagatacgccgactctctcacaatctctccgccgtccccggctccatcaagcagcgccgcaaacggaatgattctggttcccatccgccgctgcatgctgcgcaccggaaacgccccggctcttaaatactcctgaaaatgttcttccatccgcgcaaagcattctgtctcttcctccgtgagaccggcagacttcagccagtccgcaagactttttccctctgccttaaaaatctggtaataggcataatagactgcacggtagatcagatatttcttcggcaccggaaatgggaacgtccactcgtaatcgatgacggtccacctgctgtccgcggcggctttcccgctctccacgaaaatattggaaaatatcatatccacatcgctgactgtggcgcagggtattccttccggaagctttccctccccgaatacctccgcaaactccggcgtcctgtcaaaggggatctctcctccgctgccggacacacggtctgcatacgccgcgaccatctgttccaccgtctcccagtcgccggcttccaccgcctgttccatgagatgctgcagattgtccccctgcacaaacggcgacacgcttctgcatccccccggcacatcctctgtcgtacaggggcagaaggtgatgcggctgcccgcgtatgccgcgtccagctgctttccgagttcttcctgcctgcggatatggtctcccgcctgtatggtacaggcgtacttatatacttttttctctccggcttcatcggttactatatccgtccggatacggaaccgttccgcccgctcattggaatattttgaataaatcgttcgttccaaacgcgctatccctcctgcacagcttcgatcaaaaaggaattggagaacgtctgaaatacgccctcctccaacagggaatcaaacatcacacgctcgttgaagcatgccaccctgtcacggtcataattgctgcgcccctcggcgagttcgcctttctgcggcagccactcgtccgagtagatcacggacgggaacttgtgatcgggatagggataataaaacgtcagtcccccaaatcccgcctcctgcagcagccttgtgtactctgcccggctgtagcttctgccaaagcgtccaaccgccgccgcatccggataaccgtcaattccggtaaaatatccgccgcagtattcttcctgacatcccgcaagatatttcagcccgatccggttggcgtccgccacgtaaaactttcctcccggcgcaagcagctcccgtaacgccggaagctgtttttcccagcggtaaaaatggccggcaatcaggatcgcatcgaaccgcccgtgctccggaagctgtcttcttatgtcaagcttctccctctcctgcggttctttaaagcgctccctcaaaatcttctcctgcagttcactctccgcaagcgccgtcacgccgcccgccattgcgagcagctttccggtcagcgccccgcattccggattacattccagaacgcgcatacccctgccaagcggcagaaaaccaatcaggttctcccggatctgcgacaaatggtacagatacggatacgctgcccgcttctcaatgaccgcggcatattcttcacgcttattctgttttatcacctcatacagttctgtcagaatgtccgcatctgtcataggattctctattcctccacacgctccacggtcgtctccgaattcatatcatagaaaccaaccgtattcttgtccgatatgaccgtaacgcccaccacatcatacagccggtggtacgcacggaactcgccgcccacgtaaccggtacagctgatggacagcagatactcgccgccctgcagatccatattctgtttaaaggaagccacatagatctctcctgcccgcgccagcccgacgccgaccttctcgtacatggtgttcgttcccgtgacagcggttccctgcacagtcttaaacgtataggtaaaaatcggatcctgaatatcggtgtgaaactgcacctttgagcggatagtaaaagacgtccccttctggatacagctcgtatagcttccgtactcgtcaatcaccgcaaaatcaatgatttccgcttccccggttccgtattcattcacctgcggattcaactcatagttggatttccacagcttctttgtcccattttccttcgcgtccgcaagcacctgtccgctcgcaatattctgcgactgatttaacagcactttcttgtacaggttgatcgtgtccttgggatttccttccgacagcttgacgcccttgtttaaaagaatcacgcggtcacagtattttgccacactgctgatgtcgtggctgacaaaaataatcgtcttgccctccgccttgaaatcctcaaactttttataacattttgcctggaaaaacacgtctccgaccgacagcgcctcatcgacgatgaggatctccggatcaatgttgatcgccaccgcaaacgccagacgcacaaacatgccgctggaatacgtcttgcacggctggtttacaaattcgccgatatccgcaaatttcaaaatatcgtccagtcttgcatccatctcctccctggagaatcccatcatcatgccgttgagatatacgttttcgatgccggtgtattccatgttaaagcccgcgccaagctccagcagcgccgagattctcccgtcaatctcgacctcaccgcttgtgggtgagagcacgcctgtgataatttttaagatggtagatttgccggagccgttcgttccgatgattccgaccgtctcaccttttttcacatcgaacgtgacatggtcgagtgcccgatgttccttgaatctgccttttcccgcaagtcccagcgcgtcaaacagccgttccgagggtctgttgtatagccggtataccttgctgacatcttctaccctgattgctaactcatccattcagttacaaattcctctctataatacatccgcgaaatgcggtcgcagcctcttgaacacggttgttccgagaaacagtatcactgccgtcacaacccagaaatatacggtaattcccatatcctcccagaatccgatgtgattgatcagtgcgttccggtatcccgaaacaatgtagtacatcggattgagctttaacacggcaatcgcccaacccggtatctgcaccatcgtctcaaagttccacataatcggcgtcacccacatgccgatctgcaacaggattcccaccacttctttcatgtcgcggaaaaataccgtcaccgcactcgtcgcatacacaagccctgtcgcaaacagaatcatacagaaagaataatatacgacctgaagtgcataccagtccggcatatatcccatacagatgaaaagcacaatcgtaaacgccacaaaaaacagatgcgtaaacagcgccgatatcatttttaccactgggagcatatcgatctggaacacgactttttttaccagatagctgtactccaccagaacaccggtgccgccgttcagcgcttcctgaaaatagaaccacggcacaagtcccgctgtcagccacagcacgaacggaatctcaattccggtcctaagatccgtcgccttggaattcagtcccttctcaaacacgaaccagtacaaaagcaccgtgattaccggctggacgaacgcccagaccacaccaaagtaggagcctgcaaacttcttcttgatgtcattttttgccagattccataccaggcttctacttccgatcagatgatgaagcagtgatgtatccttcttctttcctgccatctatgttctcctaatctctttctatccctctgcaggcgcatgtttttccttactttatgccgtgcgccgccttatattctgcgaagcttttctgcactttatccttgtcggataagatcagatccaccgctgtcattccttccggcatcggccattccacgccgacctcggcatcattccacagaataccgccctcatcgttcggatggtagaagtccgttaccttgtagcagaactctgcctcctccgacagcacgataaatccgtgcgcaaaattcttcggcacgaaaaactgcttcttgttctccgcggaaagcagcacgccgtaccatttgccgaacgtcttcgatccctctcttaaatccaccgcaacgtcaaacacctcgccgtttaccacacggaccagcttgtcctgcggataattgatctgaaaatgaagcccgcggagcacgccctttttcgatgctgactggttgtcctgcacaaactggcagtcaatccctgcctccgcaaaatcgttgtaattgtaagtttccataaaatatccgcgcgcatcaccgaatactgccggctcaataaccttcagcccctcaatgccgttgcaattctctgttacctttatctttcccatgttctataatccctccgcgatttccatcagatatttgccgtaatccgtctttaagagtggctgtgccagcttgatgagctggtctctgtcgataaagccgcgcttgtacgcgatctcctcaatgcaggagatgtataagccctgacgtttctggaatgcagatacaaaatctgccgcggcaagcaacatgtcgtggtttcccgtatccagccatgcgaatcctcttccaagcgtctccacgttcaatgttccacgctccagataagcgttgttgaccgaggtgatctcgatctccccgcgtgcggacggcttgacgtttttcgcaatctccaccacgtcgttatcgtaaaagtaaagtcccggcaccgcgtaattggacttcggatactccggcttttcctcgatggacagcgccttgccgttctcatcgaattccacgacgccgtactctctcggatctctgacataatagccgaagatcgtcgctccatgctctttttccgtgcgctccgctgcgctctttaacactttggaaaagctctgtccgtagaaaatattatcgccgagtaccagtgccaccgcatcatttccgataaatttttcaccgatgataaatgcgtccgcgagtcctctcggctgctcctgcactgcataggaaaaactcatgccgagctggcttccgtctccgaaaagctcctcaaacaccggcagatcccgcggtgtggagatgattaacacctcgcggattcccgcaagcatcaacgttgataatggatagtagatcatcggcttgtcatacaccggcataatctgttttgaaatcgctttagtcagcggataaagtctggtaccggagcctccggcaagtattattcctttcatctgaaaatcctcccattttatccaatatacgccacgtccattaacatttgtaacggacacagcttaattttttcttaatttaaaacgcaaacaagcagtatcgcccaaaaggcggtactgctgcctgcatcaactatctgttctgatacatatcctcataatatttctgataatcaccgctggtgacattcttcatccagtcctcgtgctcgaaaaaccacgcgatcgtcttgcggatgccgtcctcgaactttgtctccggctcccagcctacctctgccttgatcttgtccggtgcaattgcatagcgtctgtcatgtcccttgcggtctgccacgtaagtgatcagatctttgcttaccagctttcttctcggatcgtccgccggaagcatctcctgtaaggtatcaataataatctcaataatctggatattctgtttttcgttgtgtccgccaatgttgtaagtctcaccgagacgtcccttttcctgcaccatgtcgatgcccttcgcatgatcgtcgacatacagccagtcacgcacattcttaccgtcgccgtacaccggaagcttcttgccctgcagtgcattgttgatgatcagcgggatcagcttctccgggaactggtacggtccgtaattgttggagcagtttgtgatgttcgccgggaacttgtaagtatcaatgtatgcctttaccaacatatctgaggatgccttgctggctgaatacggactgtgtggtgcgtacggagtcgtctcataaaaataagatccgtcatcctccagggagccgtatacctcatccgtcgatacgtgtaaaaacttcttgtccgccttaaatgttccgtccggaagttcccatgccgccttggcgcagtttaacatcactgccgttccgagcacgttcgtcttcacgaagacctccggattcttgatactgcggtctacatggctctctgcagcgaagtgaaccacacggtcaatgtcgttctccgcgaaaatcttcgcaatggcttccttatccgtaatgtccgcccgaataaacgtataatttggattgttctcaatgtccttcaggttctcaaggtttcccgcatacgtgaggacgtccacattgatgatgcggatcgtatctccgtatttgcggaacatgtagtgaatgtaattggaaccgataaaaccggctccccctgttaccaaataagttctcatattaacctccattatctccaatgctttctatctcaattcagtacaactttgttgccataagtctcttcattttatcatagattccgttccaacacaagcttgtatacacagaccgccggatctcatctaccaccagtctgtccgcatctgttctgtgatatccgacagccgtaccacaacacaatcctctgtcacaagaaccgatccctcttccggaaaattcttcatctgtgccgccagttccaccgcgtgtctcttctgctcttccgtcgcatcctcccgcagcacgttcccggtataagcctgtacaaaaccgcaaatacggtgtgtcgctccggtcgggttctccatactgtaatcccaaccgtagaacgaccagccatacatctcggtccgcctgcaccactccgggagatctgcctcctgatagcccacaaacaccaccggaagctgcagcagttcccctccgtctgccccggcgaggcgctctaacagctgctgggttttctgctcatcctccctgcagcgtatctcatcggtcacggcaaggcgcagatcatagccggtctggaccgcaatcacaaggcagatgcacaatctgcagacgagcagcagccagtaacccgtaccgcggtctctgccgttccagagttccgcaagccgctccgtcacatacattcccaggaacgctcccgccaccggaagcgcaaactgtgatctcgtcacgatcatctctcccatgtatgccgtcagaagcaacggcgcaagcaccagtcccgccattccaagcaatgaataccggattttcttcttctcccacggaagttcctgttttttccggcaggcaagcacacttcccgccagcacaagcagaagcactacgccgcatccgtagaacgaaaaatttctggggccatggccgagcagcagatttttcagcgtgcgcagcacattcttgatacatgcgagcgcaggcagtcttccccagcccatctggctgtccatataatccgaagacaccagaaacgtgctcatataccagtgatagcacagatacaccacaccgaaatgtacgatcatccagagaatctgccggagatatccgctctgctcccgctccgcagtcagctccgccaggaagaaaacgaggcacactgcgatgtagtaaaccgccagcgcctgatacgatcccagaccgataaataacagaacgcccgccgcaaaagcccggagcagattcgttacgattccggtgtcgatcccgctcatcaggaatgccgcctcaatcaacagcagcattgcaagtgccacttccgcctgctgcagggaaaaataaatctgatagcaccagatgttggacgtcacatagaggagcaggaaaatccagtaccggcttttctttttcccggagcgctcataaatgccgaacgtcagaagattggctcccagccagaaaaacaggaagaacaggatcccgctttttataacctgatgtgttccaagccccagaaggtgcttgagccacgccagctcccaccgtccgatcgcaagccatcccagactacttcccggatggttgattaactcttccgtatcaatgcggatgttgccacaaaaaacaagataaccgaaacagatcagcattgccgccattgacgcagcgagcagcccccagtatttcctcacatagtcacgcaaatcccgcattacaacactcttcatctgttccggttatcctttcacttttctgtcggtatctctctcagcccaaatgctgcatatattcatccagcgcgctctcccagtcagccatacgatagccgtctgtcaggcgcatcatgtaattatccagaatggaatacgccggtctcttcgccgaagcaggattcatcgccgcatactcctcacttgtcacatgtctgacgcgggtattcttcccggcacgcgcaaacactgcctccgcaaatgccgcccagttggtatccccctcgcaggttgcatggaacagtccgtaattctccgtcggttcatagtgatgaatcgcacgtgcaagttccactgcactggtcggcgaaccgagctgatcgcataccacgctcacttcctcatggttctctgcgagtctcaacatcgttttggcaaaatttttgccgtccccgtacagccatgccgtgcggaagataaaatactttttcgtgaacgccttcacgaagcgttctccctcaagctttgttttgccgtatgcactgaccggtcccggctcatcgaactccgtatacggtctcgttccgtttccggcgaacacataatccgtggacacatgtatcagctttgcgtcaacttccgcagcagcgatggccaggttgcgtggaccgatcgcgttaatgcgatacgccgcatcccactgtgtctcacaggcatccacattcgtgtgcgccgcacagttgatgataacctgcggacgctcggcgcggacaagcgccagcacggcatccacatcggcgatatcaagtgccgtaacgccatcgccctccgccacgtctgtattgataaatgtcacttcttcattcgcatattctgcgcggatcgcacgccccagctgaccgttgcagccggtaaccagtatcttcttcattccgtcttcctctcttactcttctattctccaagtccgttttcaatggcatgcacaagcgctgcaagcgcttcctgttcgtcttccccctcgcataccagttcaatctcatctcccgatttgatgcatgcgccgagtacgctcaacacgctcttggcattcgcggtattctcgcggtaccggaatgtgatgtgtgatttgaactgcatcgcctccttgcacaggattcctgccggtctaagatgcagccccgttggattcttgactgtgactttctgacttaccatgctctcttccctccaatgaataattttcctaacaaatcctctgtctctacagcataatgcgcgtaatcagatccgcaagcttcttcgcttcctcgtcaatcaccttctgatctttcccctcaatcataacgcgcaccagaggttcggtaccggacggccggatcagcacgcgtccctcaccgttaaactttttctccagttctgtgattgcatccgcaatctccggatactccataaaatgctcttttttgtgattcggcaccttggcattgacaagcgcctgcggcagaacctccatgatcgctgccagctctgacaacggctttccggtgtccaccatcacttccagaagatgcagggcgctcaaaagcccatctccggtcgtattgtcatccaggaaaataacgtgtccggactgctcacctccgatattgtatccgtgttcccgcatgttctccagaacataccggtctccgacttttgttttctctacgtggattccctctttttctcccatcagagtaaatcccaggttgctcatgatcgtcacaacaatcgtattcttcttcagtctgcccttctgcttcatgtagttgccgcagattgccatcatctgatcgccgtctaccagattgcccttttcatcgaccgcaagcatacgatccgcatcgccgtcaaacgcgataccggcatccgccttctcgtacacaacgcgtgccttcagctcatccatgtgggtagatccgcagttcgcattgatgttggttccgtccgggtcggtgtgaatcgccaccagttccgcgccaagatcgctgagcgccttgacggacgtgtaatacgacgcaccctccgcgcagtccaccacgatctttttgccgtgcagatcgaccggaacacatttttccataaatttcacatattcatccttcagatcaaaacggtattcgatctttcccacgccggatccgatcggaagtaccacgtccttcatgttgttgcggatcagcgcttcaatctcatcctccagtgcatcggaaagcttgtagccctcgccgttgaagaacttgattccgttaaattccatcggattgtgcgatgccgagatcacaacacccgcatctactttatgctttcttgtcagataggcaatcgccggcgtcggcataacccccacaaaaatggcgtttgcacccacggagcagattcccgccatcaacgcgctggcaagcattcctcccgatattctggtatcgcatccgacaatgattgtcgcctgatgttccgtctctttcgtcagcacatacgcgcctgcctgcccaagcttggttgccagttcgatcgtcagttccgatcccgccacgccgcgcacgccatccgtgccaaacattctagccatgttctatttcctccatgttttcacttttttacggattgttgctgcttctctccgcatcacttccagctgcaccgttctcagtggctgtcttatccgttttatcggttttatccgacttgtcagccgcatcgcctgcagcggcggtgccggctgtatcgttcgtcttgctctcactgtctgtcgtatccgtattatccgaagcacccgtttcggcggtgttgtggtcggtaattgtcaccggcagtgtcactgttccagtcacccagcagtgctcctgctccagcgtgatctgcacattcaggtgatgctcgcccgctccaaggttggatgcgtccgccgttccggtaatatcttttgcagagattcccgcaagctcgctctccgctccgctgatctctaccgcgaccgtgctctccatgtaatttgcattgtaaccgtcgcgcacattctgaatggtaaagtttgccactggcacctcgtaagtcgccttgacaaccggctccaccttcgcgatcacctctacttttgcatccgagttcagcacaagtgccgtttgactcggcagataggaactgatatccaccgttgtggtcagatcctcggtgataccggaaatgtccagcacctcctgcggaatggtgatcttgctgacggtattgagcgttgccgcctcgcccttgatacgcacattatccaggctgctttccacgccggtaagcacatagccgtccgccggttcgcccttcgcctcaaactccagcggcacatccttggtatttaagatctgtgccgaaatattgactgtggacagactgagtgtcagctttgtcgtgtcgatcacgttgccgtcggcatcatataacaccggcacaacggaatccgtcacatccgtggacataccttccacattgatcgtcgccaccgccgtatcaatctggctgacgatggatgccggtcccgaaacctttaacaggttggagcccacgatctgtaccgtgccgagtgcacagccgtccatcacggttcccttggttgccgccgtaatcgccttctggcaggtgccgcggtcttccagcgccacttccagatagagctgtttggagacgacggagactttattgctataccgcttcgcggtgatcgtcaccggcacgcggtaaattccgcttccctcatcgtactcaatattctccatgtccgccgttgcggaaaaatcggcattggataattcatcgtgcacgctgcgcgcagccgacacgcggaatgacactacgttgctgctgtccagcggttcataatatttgttctgcgatgtgatatagtccgtattctccgctacaacattggtggtataggtctttgacgtcgtcggatcgtcaatgttaatcacgactacccacagcacaaccgccagtatgaccgccagtattttgaggctaaaattatttgttatcgtttttccgagccgttttagcatctttcagcctcctcttccacaatgcaatcttcgataattcccgttcccgcctctggatgtacgtcagcttgttcttcagaaactcggcatctacattgcggtaaagttcaccgccgagcgcaatcgacactcttccggtctcctctgacacaacgattgtcagggaatcgctcacctcgctgattccgacagccgcacggtgtcttgttcccagatccttgctgatcgacagggaatccgtaagcggcaggtaacaggtcgccgccacgactctgtccccgcgcacaatcacagcaccgtcatggagtggtgtgtttttttcaaaaatattgatcagaagctgacttgtcagaataccgtccaccgcgattccggtgcgctcatattccgagagaacaatctcgtcctccaccacaatcagggctccggtcttcacctttcccatctcgtagcacgcctttaccatttcattgatggtcttatccgagaacttccccgtatcctcctttgaggaatcaaaggaaaacaggaacgccagaacgtttttccgcccgagattttcaagcgccttgcgcatctccggctgaaagattacaaccagtgcaatcaccagaacgtttaacgtattccttgcaatccagatgatcgtattcatctggaacagcgccgctagcagaacaaagagcaggatcaccatcaaaccgcgcagcagcatccatgctctggtattcttgatccacaccagcatatagtagatcagaaacgctatgattatgatctccacaatatcggttatggagatttttggaagattcatataaagagacgccttctgccagaaagcatcgagggtagctaacatgttctgcacgcggtccacttccttaatctaataattcttcgtcgatatccatctcttccgcaaaacgcttcttcgtgagacgttccttttcgtccttcccgccgaaacgctttacctgcttgttggtgccggataccacagccttcggtactgcttttacatagtagtaatattcatcatcctcaaactgcagccgctctgttcttgagtagtccaggttaaagaacaggaactgtatcacgaatgcaatcagaagtgaaatcacattgccgaccagcacactcaccgtcttgcctgaaattccaagcagcatatagcccgcaatcaaaccgattgtctcgaacaggataccggatgtgatcgcaatctgccatgcattcgcgatagacattctgcggatcagatatacaacaatcaacgtcacagccatgatgccgagcacaaggtacatttccctgttgccgagaagctggtttaatgccaccacgatcttggaattcgcctccgcactctcctccgccgcactgccgagcagcttttcattctgccggactccatcgaggaaaaagtacaccaccgtaccgcagatcactgcaaatacagaatatgcctcctccagcagtcccataccaaccggaatcacatacgggatattcagccggaagcagatcggcgtcagcaatacgcccattccctgtctgggagcaaaacggaaatagataaaatagatcagtacaaacaacagaagtgcgaccagacatacctcaatcgataatgcatacatatctgccagtataacggccgccgcgataaagatcgtgccacccaccggcaggatggcgcagagcagtcccaggatcagtgccaccggcgtcgaactgaccagttccatgtaaccaatgttcctgttgatcgtcatcagtgccacaaacgccacaataaatttgacgatcggtgtaatgtacacttcgtattttccgtagaagcgtactaatttttctttgagttccaatatggttgtcattccatgcctcccgctctaatcccagtctttatgatcggatgtccggaggcgatcttccctctcatacatctgattcacctttttcaggttgttgtaatacttcttcaccttacggcgtccctctgtgtatttcatgttaaagatcacccacgtggctccgaggtaaatcaccataaacaccagatacggcactaccgctatcatgacaagtccctggatatcgaacttgttcagctttgcaagcagctcttccgtcgcatacagcccccacattcccagcagaagcccatagcagatggttcctgtcacgaagctccccagcagacgcatggaaacataatcttttctcgcatactgcgtcatcggcttacactgcttcccgtcatttgtatcaaactgtgccatcttaatcaggtggcgcaatcgttcttcatttaccatacagtagttatcctttctccgccctgccgttttagcctgcgcaggtcaaaattgcacgcaattatgcattcttttcttattataacacagcactatttattttcaaagcaaaaaacagagcccgatacccaggccctgttgattctcttggtattatttgagaaaacgcatgcggttcttatcccgctctgtctcctgcggctgcggcggctccggcttatgaatcgactctgcaagcgcgttcgccatattgttcttgcacttctcacagaatcttcccgtacggatcggcttcccgcaggtctcacagacaatgccgtctgctcctgccacggaaagcgacagacgctcctcacgaatccactgtctgatctgcttcaccgacacatccagctcatcagcgaccgtctccacacttgaattcggattctcttccaggaaagcctttacctcctggaacttctcctcaagcttcttctgacacgccggacaaagcggcgctccccccatatagttaaacaggcgtccacagctcctgcaatttctcacttccatacttctcaatcctcctgaattcccctgtcaaaatcctgcaccgatactgacgcagatataatagatccgctctgcaccgcccttcagcagaacctccgaaacggtatctatcgtagttcccgtcgtataaatatcatccaccagtaatattttcttatattttactatatccgctgctaattgaaaagcattttttaaatttgccgctctttgtccgccatttaactccttctgcggcaccgtgttgcgcacacggcgcacaagcccggcgtccacaggaatccccagttccctgccaagcgcccgcgcgaatgtctcggcctgattgtatccgcgccgccgctttttccaccggtacataggcaccggaacgatcacttcgatttgatttttaaaaacccagtcctgataaagcgctgccgcctccctcgcataatacgccgcatattcgcgccggtttgcatatttaaaccggtacatggactgccggatatttccctgatacacaaacacggcttttccctggcagtacgcatgcctgcgctttccgcagtccagacagaattccgtccgctcatcatccagcggtttgccgcagcgcttgcacaccggttccacggcaagccgcacagcctccgcacaccttctgcacggaacacattccggcaccgtcacgcggtcgcagatcggacatctcggtggataaacgaggtcagcaatcgtctccgccacccgccgcagttcacgtcctgttttttcttttcctgttgccaaatcagcctgcattgcatttcccgctctccccggtcatctgattccgctttatcctagcatgtccgccctttttttgccataaacattttcttaattttttctttctttattttaaggaacggttgacgaatatacttttcctcattataattttgtctattaaaagcattaaagttttaatgtaataaaggaggagttgcttatgaaaaaagcacacaaactagtttcggcagtattagtctccacgatggtcttatctatgaccgcgtgcggcagtggagagaaaacgtataaggtaggtatcctgcagcagctggagcatccggcactggatcaggcaacgcagggatttcaggatgccctgaccaaactgatgggcgattccgtcaccttcgatgtgcagaacgcacagggcgagcaggcgaactgttccagcattgccaccacctttgtctccaacaattatgatctgatcctcgccaatgcgacaacagccctgcaggcttccgcggcggccaccagtacgatcccggtactcggaacctccgtgacggactacgcgaccgcgctcgacattgacgactggaccggcgccaccggaaaaaatatttccggtacctccgatcttgctccgttagaccagcaggaagatatgctcgtggaactgtttccagacgccaaaaatgtcggcatcctctactgttccgcagaaccgaactccgtatatcaggcaacagaattcggaaagtatctggatgaggacggaatctctcacacggagtacaccgtggcagattctaacgacatcgcctctgtcgtgcagagtgctgtcagcgaagtagacgtcatctacattccgaccgacaacaccatggcaggcaacactgaggcggtcgacaacatcacacgcccggcaggtattcccgtcatcgccggcgaggaaggaatctgttctggctgtggcgttgcgacgctctccatcagctattacgacatcggctacaaagcgggcgagatggcttatgacattctggtaaacggcaaagatatctccacgatggatattgaatatgccccgaatgtcaccaaagagtacaatgccgcgatctgttccgatttaggcatcacagttccggatgattacgtggcaatcgatgccgaataatatttttccttacaagggggtttttcctgatgaattattttatgtcgcttgacccgcttgccctcttccgttccatgcccggcgctttcgcccagggcatggtctggggtctgatggcactcggcgtctatattacttaccgtctgttggattttgcggatctgaccgtggacggttctcttgcaaccggaggtgcggttgccgtcatgctgatccgcggaggtatgaatccgtgggcagcacttattttttcctttctggcaggcatggccgccggtttcatcaccggcgtcctgcataccactcttggcattccgggcattctggcaagcattttaacccagatttccctgtattccatcaacctgaacatcatgggctgttccaaccaggccgtcagcgttgacaagtaccctctggtagtatcgctccgctacctgtccgactccaacagcacccgcgtgcagatttttgcaacatgcatcctgttctgttttgcaatagttgcgattctctactggtatttcggcacagagcagggacatgccatccgtgcaaccggatgtaatcagcagatggcgcgtgcgcagggaatcaacaccaaccttcacaccgtgatcgcactcatgatctccaacggtctggtcgggctttccggcggtctctacgcccagtatcagggtgcggcggacgtcaacatggggcgtggcgccatcgtcatcggtctcgccgccgtcatcatcggggaagtcattttcggcagactctgcgccggaaaaaatctggcgttcgcctacacgctgttttccgtgatcggcggagcgatcatctattatattgttatgaatgtggttttatggttaaagcttccttccgacgatctgaagcttttctccgcgattgttgtggcggttttccttgccattccttatctgaaatccacacgcaaaggaaaggagcggtaacaccatggcagaaatgttaaaaatagacaatatcaagaaaacgtttaatccgggcaccattaacgaaaaagttgcattaaacggcgtgaacctttctctcgaggagggagattttgttaccgtgatcggtggaaacggcgccggaaaatccaccaccttaaacgccatcgcaggcgtatggccggtggattccggaaaaatctatatcggaggcgacgatgtgacacgcctttccgagtacaagcgtgccaaatacctcggacgcgttttccaggatcctatgaccggaaccgcgacgacgatgtcgatcgaggaaaatatggcgatcgccgccagacgcggacagagccgcggtctcttctggggcatcacgaaaaaggagcgtgacgtctaccgcgagatgcttgccacgttagatctcggtctggaggatcggctttccagcaaagtagggctgttgtccggcggtcagcgccaggcgatcacactgctcatggcctccatccagaaaccgaggcttctgcttttagacgagcacaccgcggcgctcgatccgaagacagccgccaaggtgcttgagatttccgacaggatcattgcagatcatcacctgaccgccatgatggtcacccacaacatgaaggatgccatcgtacacggcaaccgcctcatcatgatgcatgaaggccgggtcatcttaaacattgccggagaagagaagaagaagctgacggtggaagatcttctccatcaatttgagaaggtcagcggtgaggagtttgcaaacgataaagcgctgctgtcgtaaccgaccgaaagagacataacgcagccgcaggatatttcgggatgagaagctgcccggatgaagagagcgcaggcggaagccttttgtgtttcaggatgtaacgggcacaatcccttctaatcgcaaaatcgtgtatttctaatccgtgcggccgttgcctttgcgatgatccgtgtctttccaagtttggagcacccccgcggaagctgtccgcaagctacagacaattttaggacttttgtgcagcacttacctgcactctaagcataaaacataaccgcgcgaagccgatgtctgagtcggcatctgccctgttttcaatagcagatgccggcgagtttcggttcgcgcggttttatgatgtctatgcgtgagtgcagttagtgctgccagaaagtccgctcattgtctgctgcttgacggacagcttccgcggggtgttcaaacgtggcagagacacggaacctaagccaacgatcgcacggaagaaatacgggattttgctccaaagaatggactgtgtccgttgtattctgaaacaaatgggcttctcgcctgcgttatcattctccgtattcccctctccaaacgcgaaatgttctgtaactgcggcagtgctatgcctctttcaagcggtcacacagcccgctgtatcgtttttgctgcgacgtgttctgtaccatctgtgcaaatgttacttcattgccgaccagcgtcacgcatttccgcgcacgggtgaccgctgtgtacagcagattccggttcataagcatcgacggtccggacaaaagcggaatgacgaccgccgggtattcgcttccctgcgatttatgtatggtaatcgcgtacgccagttccagctcatccagcagtttgtatggatattccaccattctgccctcatcaaattccacagtcatcgtctccgcgaaatcattgatctcccggacaattcccatgtctccgttgaatactcccgtccctttatccacagacagaccgtattttgtacggatttcccactctaactggtagttgttccgtgtctgcatgatcttgtccccctcgcggaacagaatatcgccgtgttccttttcacgcttctgcggagacggcggattcagatagcgctgcagtattccgtttaaccgctctacgcccagcagtcccttgcgcatcggcgtcaacacctgtatatcgtacggcgtcgcgtccacaaatttggggagtttctgcttgatcagctgcaataccacgctgataatcacatccgcgtcataccgcttcaggaaaaagaaatccatgcttttgttgtccaacgtcacttcttcgccctgattgatcttgtgcgcattcacaatgatgtcgctcgtggatgcctggcggaaaatcttcgtcagcatgaccacattgcactcgtgcgagcgaatgatgtcccgcagaacacttcccggtcccacactcggcagctgattgacatccccgaccagaatcagtctcgttccaacggcaaccgcctttaacagtgcatgcattaaggaaatatccaccatggacatctcgtcgataatcacaacgtccgtctcaagcggattctgctcattccgctcaaaccccgccgcaccgtccacaccgccgttcagttccagcatgcggtgtatggttcttgcctcaaacccggttgtctcactcatgcgcttcgccgcacgtccggtgggcgccgcgagaaaaatatcaagtccttccatctcaaaatacttgatgatcgtattgatcgtcgtcgtttttccggtacccggtcctccggtgataatcagaagtccgttgcgcaccgcctctttgaccgctgtcatctggtgctcatccagttccattccggtctgcttctcaattctgcgaacacgctcctcgatttccagatccggaacatcatagctgacattgagctgttttaacatggttgccgtatttgcctccatgtagtaaaaggacgccgcatagatctgcgtctggttttcgccctgcttcatgatgattttccgctcgatcgccagatccatatactgcttctcgatctgctcctccccgacctcaagaagctgtccggttcttctggtcagttcctcctccggcaggtaggtatgcccctctgtggatgcctgaagcagcacatataaaattccgctccggatccggaaatcagaatccatgcggattcctacccggacagcaatctcgtctgccgtgcggaatcccacaccctcaatgtcgtccgccagccgatacggattctcacggataatcccgtatacctcctgtccatactgctgatatactttcactgccaggttcatcgtgatgccgtactgctggaggaaaatcatcgcctgccgcagatcacgtttttcattcacctgatccgcaatctccatcgccttgcgctcgctgattccctttacttccgccagccgctccggctcctcctcgataatccgaaaggtatccgccttgaatctgcgcacaatccgcgctgccagcgccagaccgattccgcggatcgccccggaaccgagatagcgttcgatggcttcctcgtcttccggcgctttctcctcaaaactttcgaccttaaactgtttaccgtaagtaggatgatcggtatagtcgccggatgcctcaatgttctccccctctgcgatcgccgagaagattcccacgcaggtaatctcctcctccccgctcaccagattgagaaccgtatatccgttgtctgcatttctgtatataatatgttccacatatcctgctaacttttccaaatcattcctcccgccgaaaaaagcagagaacccgtcacctctaacggtgaccgccctctgcctcgttcattcttaactgccggcatctattctatgccatagttccgtttcatctgctcataaagctgctgcgtataattttctcccacctgatccacaatctcatctgccaccagttcgatcgtgctgtccatgtgaaaatctgtcagcgtactgagagaagaatccttatcctcgtcatcatccgaaatgagattctcctttacttcctttaatacctcttccacaaagtaggactcaaaatccttgcagaccgagagcagttcttcctcgctcgagccggaggacacactactgatcgaattcttcagtgccgacgcgctgcctgcggctgcgctgttctgtgcattgctgaccaatgacgaaataccgtctatcgaaaaactcatactttacgctccattccgcttatcatccgcttaccgttcgcttatcatctgcttatcgtttcaggttgttcgccatctccagcatctcatccgatgtcgtgattgccttggagttcaactgataggcacgctgtgcgataatcatattgaccatctcgtccgccacctgtacattggacgcctccagataattctggcgaacctggcttctggtaagacctgctgtcgtattctcattcattgccgcacccgaagctgctgtaacttccagaaggttgtcacccgttttctcaaggccgctcgggttgttaaactggaacagtccgatctgacggttcatattcacataagttccatttgctgtcgtgtaaccgattctgccgtcgctcgatactgtcacactgctggaacttatattggccggaagaacgatctgctggttattgctgtccagcaccggatagccgtccggattggtcagtgtaacgccgttggttcccactgcccacacaaaatctcccgctctggtatagcgtgtctcgccgtctgcgcagcgcactgcaaaaaatccgtctccgacgattgcaaaatcggtatcattctcactcgcctgcagcgctccctgtgtgtacacggatgtgactgccgcaactctcgttccgagtcccacctgtgccggaatcggtttctgctctccgtttgcactcgttgtcttcgtctgaatggtctggtaaagcagcgacttaaactctgccttctcctgcttgaatccaaccgtattcacattggaaagattgtttgaaatattgtccacgttcgtctgctgcgcaagcataccggttgccgcagtataaagtgccctcatcatatgtcagctacctccgtctatacatttccgacctgattgaccgccttatccagtgtctcatcaatcgtgttaataaccttctgtcctgcctgatatgctctggaaatcgtaatcatattgaccatctcagaaacaacattcacattggacgactccagcgttccctgcacgatcctgccgtccgccgccgtcaccgttcctccgttcacaaggtcgtacatattctcaccgtacttcgccagatagtcataatccgcaaaatcgacgatgccgatcgttccaacctgctgatcgttctgatagatattgccaagctcatccacggtgatcttctgggtcggatccacctgaatccgtccgttcacattgccgtttctggcgtcatttgcattcaggacataatcgccgtccttggtcaccagatagccctgggtgttgaccgtgaacgctccgtcccttgtatattttacggatgaatttccctgcttatccgtgtaggcaatcgcaaaaaatccatctcccttgattgcaaaatccgtactgttatcggtaaccttgaaacttccggtactgtaatccgtatacgtctcaccgatatgaacgcccatgctgattgtacccagcttctgcgcaagaccgtaagacgatgtatctttgatcttgattgccagctcatctgcaaatgtctgggacgttgtgccttctttcttataaccattcgtatctgcatttgcaagattgttggaaagcacatccagacgcttctgttcatttatcattcctgtatacgctgtatacaatccctttaccatagactgctcctttttctgttacctcttgtaacttctgcctgcttctcaccagaatccatcagacgctcccgcatcccaagggctctttgttgtttatatcgtcataactgccgtcaaacttaatcatcatcgcgctttccggacaggaactccacgaactttccggttccgactgccacacaggtcatcggctcctccgctgtcatggtattgattcccgtcttatcctcgatcagttcctcaagtccgcgaagcagtgatccgcctcccgtgagaacgattccgcggtctgccacgtccgccgcaagctcaggcggcgtcttctctaacaccgagtgtaccgcttccacgatctgcagtgtcggctccttcagcgcctcttccgtctcctcggaagaaacggttaccgtcttcggcagaccggttaccaggttacggcctctgacgtccatggtctcattctgtgccagtgggaaacaggaaccgatcttgatcttgatgtcctccgctgtgcgctcaccgatcaacagattgtgtttctttctcatgtaacggacaatcgcctcgtcaaaatcatctccggcgatcttgatggaagtgctgacaaccgatccccccagagaaatcacggcgatgtccgcggtaccgccgccgatatccacgatcatgttgccgcatggtcttgaaatatcgattccggctccgatcgctgccgcaatcggctcctcgataatcgccacctcacgcgcacctgcagaataggtcgcatcctcaaccgcttttttctcgacctcggtcactccgctcggcacacacacgctgatgcgcggcttgcggaatgtcttcttgccaagtgccttctggatgaaatacttgatcatcttctcggtgacagtataatcagaaataacaccctgacgcagcggacggactgctacaatgttgccgggcgttctgccgagcatcagtctcgcttcctctccgattgccttgattttgtttgtatcacgatcaaaagccactactgacggctcctttaacactacacctttgcctttaatatataccaggatacttgcagtaccaagatcgataccgatgtccgtactcatcatattctaatctgcccctttcttttctctgccaatggttcatctattcgttgaatctttcttcacgtccaaaaggacataaagatgcatttaatcatatttttacatatacagcattattatatacaaaaactgggatttttcaaagctttttttcgcccgcgccgccatttttgaaaaaaataagaatttcttcattttttgtccggaatatcatattttttcattttttcatcacgtattcatcacatttgcgggttatatttttttacgtactaaatggtgtaccaaacatacaccgccccggaaatattcctcaaatattccgcggttagtataatttttcataactcataccttccggcgcaaacaccaaacgccgggaggtactccccgggtataacgaattttcatccatatgaattttcgatgccatatatttcacaacatttctctgaccgcagatgtcaacacatctgttgtcaaaaaaggcactgtatgctgcgtgttttccacgtttgcatccagtgccttctccttatttccactatttttccagatatttcttgacatactgtccggtgtaggactccggtatctgcgccacctcttccggcgttccctgcgcaatgaccgttccgccgccgtctccgccttccggtcccatgtcgatgatgtaatccgccgtcttgatcacgtccagattgtgctcaataaccaccacggtattgccgccgtcggacaatctccgcaaaatctcgatcagcttgtgcacatccgcaaaatgaagtccggtcgtcggctcatccagaatgtagatcgtctttccggtgcttcgcttggagagttcggttgccagcttgattcgctgcgcctctcctcccgaaagctctgtggacggctgtcccagttttacataggaaagtcccacatcgtagagcgtctgaatcttgcggtggatggacggcacatttttaaaaaactccagcgcctcctccaccgtcatatccagcacatcataaatgctttttcctttatacttgacctcaagcgtctcccggttgtaacgttttccctcgcagacctcacacggcacatagacatccggcaggaaatgcatctcaatctttaagattccatcccctccgcacgcctcgcagcgtccgccttttacgttgaagctgaatcttccctttttgtagcccttcgcctttgcatccggggtcgccgcaaacagatcgcggatcatgtcaaacacgcccgtgtaggtcgccggattcgagcgcggcgttctgccgatcggcgactggtcaatgtcaatcaccttgtccagctgctccatgccgagaatcgcatcatgctctcccggaatgcagcgcgcccggttcaggtcgcgcgccagccgcttatagagaatctcattggtcagggagctctttcccgatccggacacgccggtaatgcaggtcataattccgagcggtatgttcacatcgatgtttttcaggttgttctcccgtgcgcctttgatcgtcagaaatcccgtcggttttctgcgctcatccggtaccgggatcttgattctgccgcttaagtacgctcccgtgatcgacttcggattcttcatgatctcctgtgccgtaccgcaggcgaccacttctccaccgtgtgagccggctcccggtccgatatccacaatatagtccgcggcaagcatcgtatcctcgtcgtgctccacgacaatcagcgtgttgccgagatcttttaaattcttcagcgcccccagcagcttatcgttatcgcgctgatgcagtccgatcgacggctcgtccagaatgtacgcaaccccgaccagcccggaaccgatctgcgtcgccagacggatacgctgtgcctctcctcccgagagggtaccggtcgctctggacagggacagataatccagtcccacttcattcaggaatccgacgcgtgcgcggatctcttttaaaatctgatcgccgatccggtgctgctgctcccccagcttcatctccgccagaaaggcattgagattcttcaccgacatggaagtcatctcataaatatttttatctgcaaccgtcactgccagagactctgctttcagccgctgtcccttacaggtctcgcagggggtaatccgcatgaactgctcatattcctgcttcatgacctccgaaccggtctcccggtacttgcgctgcacgtttttgatcagtccctcaaaggcaacatcataaacgccttccccgcgctgtcctctgtaatggactttcacttccctgccgtccgttccgtagatcaggacatggcggatttcctccgggtattcgcagtatggcgtctccagtgaaaaatgatactcctccgtcagcgcctttaaaatagcgtatgtgaaactggacggatctgtacaggactgccagcccatcacctggatggcgccttccgcgatggaaagccgtttatccggaatcatcagatcctcatcgaattccattttatagcccagtccgaaacaggtcgggcacgcgccgaacggattgttgaaggaaaagcttctcggttcaatctcgccgatgctgatcccgcagtccgggcaggaaaaactctccgagaactgaatcggttcaccgccgatcacatccacggtcatgagtccgtttgccagtgtaagcacattctcgatggaatccgccaggcgcttctcaattccttcctttaccatgagacggtccaccacgatctcgatattgtgctttttattcttgtccagtttgatctcttccgacagttcatacatgctgccgtcgacaatcacacgcacataaccacttcgcttcgcctgctcaaacagcttctgatgctcgccctttctgccgcgcacaaccggcgccagcagctggatcttcgtgcgctccggcagttccatgatctgatcgaccatctggtcaaccgtctgctttttgatctcttttccacacttcgggcaatgcggcacaccgatccgcgcatagagcagtcggaagtaatcgtagatctccgtcaccgttcccaccgtcgagcggggattgcggttcgtcgacttctgatcgatcgagattgccggcgacaatccctcaatcttctcgacattcggcttttccatctgccccaggaactgccttgcataggaagacagcgactccatatagcgccgctgtccttcggcatagattgtatcaaatgcgagggacgattttcccgatcccgacaatccggtcagcacgacaaattcgtctctcggaatatccacatcgatatttttgaggttgtgctcgttcgctcctctgattttaatatattttctttcggacgttttcttcattgtcttatcctttctacaggtcacgcagcatccctttgagttcgatcatcttgtcgcggtattccgccgccgcctcaaaattgagatccgccgccgctttttccatctttttctggatatcggcgatcagtttcgtcagttccgccttgttcatcgactccggagacttcttgaaattcatttcttcctttgcgatcttcttggaaacagagatcagttcccgcaccgacttctgaatcgtcgtcggtgtaatgccgtgtgcctcgttgtactcctgctggatcttgcggcgccgttccgtctcctcgatcgcaacacgcatggaatccgtaatggtatccgcatacatgatcacatgtccctcgctgttgcgcgccgccctgccgatggtctggatcagcgacgtctcagaacgcaggaagccttccttgtccgcatccaggattgccaccagggtaatctccggtatgtccagtccctcacgcagaaggttgatgcccaccagcacatcgaacacatccagacgcagatcgcggataatctccgcgcgctccaaggtatcaatatcggaatggagatatttgacgcggatccccagttcccgcatgtaatcggtcagatcctccgccatttttttcgtcagggtcgtaatcagcaccttgtggtggttcttgatctccttgttgacctcacccaccagatcatcaatctgcccctctaccgggcgcaccacaacctccggatcgagcagtcccgtcggccggataatctgctccgcgcgcaaaagttcatgctcatcctcgtatacgttcggcgtcgccgaaacgaacagcatctggtcgatcttgccctcaaattcctcaaaattcagcgggcggttatccttcgcagacggcagccggaacccgtaatccaccagcgtgctctttcgtgactgatcccccgcatacattccgcggatctgcggaattgtgatatgggactcatccacgataatcagataatcatccttaaagtaatccatcagcgtgtgcggcgtcgcccccgccggaagccccgccagatgcctggagtagttctctataccgctgcagaatcccgtctcttttaacatctcaatgtcaaaattcgtgcgctccgcgattctctgtgcctccagcagcttgtcctcgcccttaaaatatttcacgcgctcttccagctccgcctcgatattatcacacgctcttaaaatcttttcctgcggcacaacgtagtgggaagccggaaataccgcaaaatgctcgagccggcacttaatctcgccggtcagcacatcaatctccgttatgcgatcaatctcatccccgaaaaactccacgcggatcgccgtatcgccatagtttgccgggaatatctcaagcacatccccgcggacccggaacgtgccgcgatgaaaatccatctcatttcgcgtgtactgaatatcgatcagcgcacggatgacctcgtccctgtccttctccatgcccgggcgcagcgataccatcatgccaaggtaatcctccgggctgcccagaccatagatacaggaaaccgatgccacaacgatcacatctctccgctccacaagcgcagccgtggcagacaggcgcagtttatctatctcctcattgattgccgagtcttttgcgatataggtatccgtctgcggcacatacgcctccggctgataataatcatagtatgacacaaaatactcgactgcattctccgggaaaaattccttcatctccccgtagagctgcgccgccagtgttttattgtgagaaataatcagtgtcggccggttcagctgttcgatgacattcgccatcgtaaatgtcttgcccgaacccgtcacgccgagcagcgtctcaaactggttgccctcgcggaatccgcgcaccagttcttcaatcgcctgcggctggtctccagtcggcttgtatttggaatgtaatttaaaatgatccacttgcaaatctccttttatgttctcataaaaaatagaaagcgccctttcccggctgtgcagtacatgtccggaaaatctttgatgctgcaaatcggaaattaccaacgcttcatgttcttctcaaacttcccggtatatgcctgcttcaattcatctgccgtaattccgtaacagagcatgacatcattgtagtacataagaacatcaaccatttcctcaaccagatcttttctcaattcttcctgtgtcagggcattcactgcaccatgctttttgacaatatcaatcacttcacctatttcgccaaccatccaaagcatcttgttctgtcctatttccggacagatcggttcccatctgtccttgtacttatcctgcaagcttctctgcattttctgcatttcgtttatactaaaatcttccataccacattcctcccctgaaatagttctgcaaatcagaaattttcacttttttgcagcttaataagttgaaccttgccatccattttaacatccttggcaacaaaatcatacttctcaaacaatgaaattctgcaagtggaaagttataccgttatttcaatctgattttcctctattgcaacaacacagctttcataatagccatcgcctgttgtgcgtggaccactgtcgaccggatatcctgcttcttccagtttcattgtcaattcatccactttttctttactgccgacgctgaaagcaatatggattagacctgttcggttaagtgttttcttcacatcctccatatccggcttattcattatctcaagtctcgaaccgccctcaaaagcaagaaaatatggcctgatttttcagtctatctctcgttccaacagcccctaacaatcatgatttttccgattctgcaaacttgaatttcatgcgctatttgtttatcaaccattccatagtttcaaaattcaaatatagttctatttcttttccccatgtcaaaaattcaaaacaactgatttttaaaatattctctctccattcaacaaatttcaaattatcagcattaatgggaagaactatgttttccatatcgctaatcttagtatttgcaaacatctcaatgccatagccgtctgtaactaaaatttttccaaatggtgtgactgttatatctacatattctggttgtgaataatattccataatttcaccaccataaatatctagcacatacatataatcagaagtcaaaacaacaataattcctaatgttgtagaacaagatacccctctatatttacctcgaaattcaccacaccaaatatcgtcttcttcggtaaattttatccatgtccaatcagttgaattccatggactttttatatcataaattttttcaatatattcccctaaatatggttgttgaatatattctgctctagaaatcatttaaacgcatctccaaaataccgatttttattgctaacaagcagacattatctttcatataaaatatgtaaatctccatcaacaaatccaatacctattgcttgatatttttttaaacttccagcatatttcccaaaagaaaggtattcattcaataaaccaataaaaaatgtttccattgatttccaatcactttcacgctctatcataaaaggattatctcttgtagcaaatacttcatcacaagcccaatcgtcattatccctatcgaatgaaaatgtgccgactaattcaatagaccatttattatctgtatcttcatataaattaaagttaatcgcttttatttcactattcaattcattctttaagatcaaatctaaccattcaaagaaatctttgttgtttttattcggttttaatttatcaaataatcccatacttcgacctccacaaatatcgattgagatttcacctgttttagggaatttaataactgttatattttgttattaaattctctgcaaacccttgaaaacactggatttatcgcaggtgagctttcccttattgtttcccttgtgttatatcgtcccgtcagcgtttacgaactctgataagggcaaatacaagggcaagaaaaatctataaaacagtataacacaaaataaaagtgacatggtgaactgattgaaatgcttctgatttttgtaacaaatgactgattgaatgataaggagattctatacgatgagaacaatatttgcagaatacaatccacacagaaacagcattgatatttatacttctgctggttatatgctccgcattgactgttgggaagccgaaaaggatttaaaaaccacacccggatcagactgtgcattgaacgcacttgccattgataaaccgcttgaatatgcaaaattatatcttgatgaaacaatgcagatatgggtagatgcagaagattcattagaactatggtgattttttcaacagcactaaggttactttttcccaatctcatttattgagaatcgtctttttaccgtgcatatatattcaatatctttttatctattataatgaaatcaagggctggtctaatgccagccctacaaaaatgaaaattcacatagaaaataaatttacaatttttccgatataaacctgttatcaacaaatacaaacataatttatattatcgtatctattgatatgatatgtatttcaaagagttaccagaagtttttgaaaacttttcccttgtgatattatctaaagctcctaattttatacttttcccatgatggagcagcttatttgaccgtatctctagcaccaaagatgttgtattctatactgatacatcaatagaattgcgaactaacctattaccatttttgacaagcgtagattccactgattctcttgtaacgttatcaagaatgcttgtatcaaacttttgtcccggcttccaatttggattagccgatttcactgctgcatacatagcaactctatactgtccttcgtattgctctaaagtccatgtaccacttaaacgtttgtctttacttacgcttaactgataatccttaaaaatatctgaacgcttagttgtatcaccatttgaaataccgttttccttaataaattccctcttcacattatcaaacatcttttgacgatattcctcggatacactcgtgagctgctgccatgatgtaccttttccggtaacatccattcccgccactccatttgcattcagtaaatcgccatccgaatcaaattgcttcatcagattcttaataatggtatctcttccaccgaatgtttcatatatcaatctttcttctgctgacatcatggcttcattttgcataataccagataaccagcctttttctttcaaagccttatattgtttactatttgtgttgatgccattataggtattgcctaatccgctgatattcattgacatataaaacctccgtgtaaatacattctaaatccgtttgaattaactctatgctatatagtatagatcgtcataaatctccaaaaaataaaggaacccactttattaagtatttttgtttttagcatatttctaaagcacagaataccattgtctgttcatacgatcagcttcatactggtatgtaatcaactggttcatatcctttaagctgctctttccatatataatgcttaaagtcatatctggcacattgttccatcctctggttgaaatagttgaaaccaggtcatgtatccaattattcatttgctgcttaaactctttcggaacttttccggaactttcaactgcactatccactaagtctaatatattctctcccgactccgtataatatgtcccatttttttcctcaagtttgtctaattcatatcctgtataactataaacctgatgatatgcttcgtatttcatctttgattcctctgttacttgagaactctcacagccatcttgtgttgagcaataatagatatgcttatagagatttttcccattattacctacatttaaagcattctgcatcaacacctttgtttcttcatccacaccatctaccgttatctcgtaactgtatggatcgacagtaaaagtacactcttccttaatagaagatgtatctacaccagcctgctttaaaatatttgaaatctgtgaatttaccaatgctctttcaaattggattttatccgaatctacactgtcgccgtctacttcaattcccctgaacaaagaatcctgataatttacaccatttatttttcctgtccggcacatctgcatctcataattatatgcaatcctacgttctgtatcagtcaaattagtctcgtaatactctgaactcttatcaaaatacttggaatgaatataattttctgggttagaatgtgtttttgcttctgcggcaagcttagaatacttttccgttaatgccgccctaaatgctttacctgtactcatatattcacttgttttcgcattaatctgtgttcctgcattctcaatgagctcttgattcgttttttttgctgaagctatataggactttaagtcaatgctgctgtcaatacttgtgttatgtgttcttccacttgtactttttgtcagtttttcctttcccgatgcacttatcgttaaagtatctcttgtgcctctacaaccagtgttttgactgcttgccgctttttgttgttgaccaaacagaacattaagcaacgactgattagcattaattcggctgttaaaaaatatattcataatatcaccaaccttcttattatatatcggattatcctaaccttgtttgtaatcttttctttcttcaaaattatagaaattgatactatgcatatgtatcaaaacctaccttatttttagttgtcgcttctatagcaatcatattttctgtttttttatcttctttttctttatcctctttcattctctccagccatttgtcaatttctgaatccgtaccagtctctccaaaaatgccacaggttgtcatttcggttccattattcgtaaacttaaactccactgatatcagtttactaccatgacttattgccgccttctgtgcatttcgtataacatctggcataattgctaaattttcctcaagccatttcgcagttttttcatctccacatgcctttctcattacacttccgtcaatcaatacagaagcatttttgcatgtaattaaaaaaattacaaatcttatgcaaacatacaatatctacctaaattatcaactttatatgcattattttcctgagtggtgccataattatcaccataatatatctttattcctttcaaaatttttgtccatgcacttatgtctgcacaatcattttctgccgccaaacattttctggcagtagcataacaggaacccggcatatcaatttcccatgctttgctggaatcaccatcatacggaatatatgtaactccattaggagtcaaaaatgtaaaaccatctttttcgcgtttcagatttcctgatatctcaagtaaagcatataatcctgccgtagaccgctgtgaacttaccggatatttttgaaattcatcagctaatttattcagcgtctctatatctttatcggatgttatgattaccgaaactccttgtgcctcatttccctttatcgacaaataatttaaccctgtctttgaatcacggtttactaccaatcccccctgtagcggtatttcctttatatcaatatttcttttgtcagacaaatcattcaaaagatttttcagttcacttgtcatggttacattatacgaaaatggctgatccatattaatcaggaactccattcctgttttctcatctctttgaattgctaattgatcttctcttatataaaaatcttttcctgcctgcttatctacaatctcatatgctgctactccatttacatatgtagcatcttcgattttatatctttctgtttctattggtaattcaatatcttgagagatactattttgtgtataaattccaaagttactataatctgtactgtttacataggaatcccttgtgctaatcttattacttatacactcttgggctttattcattgtatcagaaaaatttcctactgcatttctattatttttactgcataacatactttgttgtaagtaaccattctctattctcatgattctccctcccaatcacttgggttttattgaatactccattataaactttaatcttttatctgaaatgtaccgtctgctataacaaactgtatatttaactcagacataatatctttgtgctgtatccggttatatgctaaaatttcccggatatcacttgcgtaatcctgataggtcagattcccacccggatgattcaacagatcatccagtgttttcggcagaccatgtatcgctgtattttccacggagaggtctccaagcgatacgctgccgccagatgccttatgtaaaaattttcccacatccaccgcagcttgcaacagatatttttctttatctgacaactcctgtatttttgaatccgtgcaaaaataaatatccatcagctcatccgaatactttgacagaacattctctatcttctgtttcattgcatgatcctgaataccgtccacacttacctgaccatccgccccaatttttatggaaaacgtggaatctgaaatatcaattcccgcttcctgcagatcagcagatatcctatcttttactgtggtattcatttttgcacttgcattcgcacgatccagctctgctgcagtacaaaagatatttaaaagagcattttcctgttccgtcagttctcctcctgctgcttttttttccagtaaattatgaatctgctcatcatccggcactgccccaccctgcataacatcttctgcctgtttctgatgcagtttctccatctgctctgtataataggctttgtacttctgccggatttccttaattgcacgcgtttcctcagtatcggttaagccttcctgcatctgcttcctgactgtcccttcatacttctgaacctctgccatttcctgataagctccatggcttttatccgcctgcgttgtctggaaggaaagatgatattcggcatccgggtttaccgtcgaaccgttctttgcctgtaccttcacggtataacctctgttgtccgaattccagttcggtatggtaatactaagaccgccgtttccattctctttcccaatgccgacctgattgccttcctcatcatacaaaaccatctcataatcacagccttccggtatatgatctaaagtgatcgtaatatccttattataggtatccttcgcgaaacttaatgcccggtactctgtaatattgaattcgtaatagtccacatcctccgtatccgataaacttccctttaaatatccgtccggcttattgataagtgccgtcagatccagtgttcttccaaacacatcctgatccgtatatttatttgttttccagaaataatcattggaaactttactattttctactgcaatatttttatcagtgggtaaaccttttttcttaaaatcatatcccacaagctgcgcatgcatctctactgtgcgggttattaccatcttttcattctccttgcgtacaattttccatatgtactatttgtcagattttcgtatcaagcgttgcctgtgcaggtgatttcccagactctgctgtttctcttgtaacactatctaatgcgccatctttgattggcttaccaatttcccagttaggatcagccttttttgcggcatcataaaatgcctgtctgtaaattctctcatatttttcaagagtgtatccggcagccagcctgtcctttttggacattttacgatataaattgttatatacgtctgtgcgttttgttgtatctccattgtggacaccgttttcacacaggaactctttttttgtcagttcatacatttcttctttgctactatccggaattgatatgatcctttttctcgaactttcattttcatctgtcactaaaagtcctgccagtccatttacagggttgatataatctccatccttgtcataatgactcatcagattttttattccctgaatattgccatacattgcaccatttccagcagacatcatttgttttactgcggctttatattgtttgctgtttgtgttaatcccggcagcttttaacttggacttaacagaactgctgttcaactgggacaactgaaaactgcctattgcatttactcctgatgtcccaaatgatttttgaaacaaaaagcataatccgttatttttgacataaaacatcctcccatattaaacctgttatcttacctatatccttacgctttcctatcaaaagacgttttctcttccaaatagttcggcagttctttcaattctgagctttgggcattcttttgcgtatggtattcattgaagtaaattccgtaaaattctctttccttttcccgctcagccggagttctttcgcatccccatccataactatctcccagataggtcaacacttttgttccttgataagaaatgtcggcaccatatccttcgcctgtcagaatcggacattccagtgtgcctcctcccgccagagcaaacttcttttgcgcaaggttgttatttttcccctctgccctctccagaaaatcgagcaatgataattctccgattcctttgcatttcggattaccattttgactttttaccgcatttttagcctgctgatataatgcctttctgtcaggggatacatcggatatgtattctgcacataaccttgttctctgcctgtgaatagattctaattccgttttactcgtagtgttggcagctctctgagccagttccttaatctcagagacaaactctgcctgtgacttattgcttttccctgcacttggaatcatagaccaatcaggttctccacttctcagcgatacactatattttgtaatagcagaactcgttgcatttgaaatcgaaattcccatgaatccacctcacatttttatcttctctgcatatatcttaacctctattatgcttatccatttatcaggttcattcctttcgaaatgccttcaactttcaccgaatcctcaaatgtaactgtcatctgcgtatcgtaagttttccattcaaactgcgaccagcttacaccgttaccggtatgatcataagccttgattgcatcgttatattgctttttttgtttttctgaatattccggcacattttcagtattatttatttccaacaacattcttaaactatccggcactccatctaacgcttttctccacgcttcactctgttgctttgcaaccgccatctcatgctgcataacataatcctgatatgccttttcccttgcggtgctggcttctttgtctgtctttaacaactgctgcttggtatcttccgtcaattccacctctttaccattgaccgtaacatatcctcttgcaactgccctgctgaccattgcagaatcagagaaatgcacaatataagaattttctttatctccttttgtgatacccaatacatcctttccagatgttgctgtgattttttcttgttcgcatacctttttactttctgcattctgttagctataatgcggatatttactatataaatttttctgtcggtcatagatggaatcaacctgtttatttaaaatgttcatagtccactgccctcccttgctttttccttattatttcaatatttctcaaacattttaatacccgcattaaacaataaaaccaattttttcaaacagaaattcacaatatttatgcatatcctgatttccgcttcttaaaacagaagaaaacaaagactttatatctatatttcctcccgttctttcatattgctccagataaagtgaacggaactctaaataagaatcttgaatatagtcacatgcctgatttatatcaaaggcatcaaacgattcatccaattttgtattctgaaatttctgcttattttctgcattttgcttttgacttttggcaaccattttgtcccattttatcagttcctcaaaacctttatttagcttttccaattcttcatccattgacaacagacgtctttttccactctctggattatcgcatacatacacttctcttgttccattcctatatccttctacaattttttgatacatagtagaataggcatatgcagctcccattccaatatcatcgaaaccatatccatttttactttcacggatactctttaaatatttagtctcttcatcccataattcttgaagataatcctttgaccaagtagttttaggcactgtttctctaatataatttgcgtaaccagcgtctaaggcaaacctatcatgtatatatgcgttttcctgattttccccatcggcttcatctgaatgccctatcctccggcatacgtccttgccggatgttacggtcattttttcttgcgattcatttgccttatgctttttatgagaaagctctatagttttcatatgatcgcctttttgatgaccgtacaatgaagatacggtattctggccaaaaccaatgtgcatacttctattcctccaatcagtttatctgaattgtaccgtctgctataacaaactgtacattcaactcagacataatatctttgtgctgtgtccggttatatgctaaaatttcccggatatcacttgcgtaatactgataggtcagattcccgcccggatttaactgaattttcaacgcctaatcccatattaactcctttccacggttcttctgtcagtcagaaccgtacctgctctctccatccgaagcccaagcagtaacctttaattgatttattggagtaagataacacttttggagttatcttactccttttgttttgccattacgataatcacaaccgcaacactccacaaaatatttcattattctgacctagttttcccttttcttcggtcttttcggctggtgataaatcgctgaacactctgccgtcctgccaagaactgttttttccacttcattccgggcaattctctccactaccttcaataccttgtttgtaatcttttctttcttcaaaattatagaaattgatactatgcatatgtatcaaaacctaccttagcaatcatattttctgtttttttatcttctttttctttatcctctttcattctctccagccatttgtcaatttctgaatccgtaccagtctctccaaaaatgccacaggttgtcatttcggttccattattcgtaaacttaaactccactgatatcagtttactaccatgacttattgccgccttctgtgcatttcgtataacatctggcataattgctaaattttcctcaagccatttcgcagttttttcatctccacatgccttttgcattacacttctgtcaatcaatacagaagcatttttgcatggagtcaaacatttatacttgttagtcaaatactttgaatagtctgatacatttttaaacttattggctgaattcatagtgtatcctgcataataattcttttcactattctttgatggctttacattttcattttttacatttccgtatgtgtatgtattggcatacgatgatactccattaattcccatactgcatctctcctttctatttagccttgattttttatttgcaggctattgggttttgttcgatacgcttactgccattgtaaaatttgcctcataagaagctactgcctgacttattgtgacagtcttagcagacgaactactctcagccaccaatcgagttctggcatcctgagcggataaccttttattttgcgcatattcttcataagctgttctttccgcttgttttttctgaatccgctttttttcctgttgtttctttacctgattttctattctctttttattttctattctgcgctcccaaaaactattttttgacttatcattaaaaatcttcccaccattcccattgttataaccagcactccacatctcagcatgacattcttcttttgatgctccataatatattgtagaaaacgctcctccgcatataccggaccatttatctggttgtgaccaacccacttgcaaatcatttaatacccatgcttcatactctggatcattcttcattgcttcaaaacccgcctctgaaattgtaacagatattgactcgcctgctcttgtggggtgcattggaatttgagatattttattgtaaatgtactgcttgtattccaccatcgtcatatccttagcagacacagaacctatttttgaattgcccactatacttccactagcttcgctcttttctcttacactatccgcaaaccttgtatcttccttctcctgatctttagccgcatttttctgttggtactgattgtaagcccgtgtcatatagttcacattaattgtattactcatagtaacctcctttgcttcctttatcggataaaataacctgttctcctagtcccatatcatcaaacgaccatattgcgcacaaagaccatatttttacaagatgaccactgccttagtagaagctctgtatctcaaactctttgaaatacaatgcttccctgcattttctatatcggcatgttgatattattactttactatcctgcacactctctgagagtgactgtatctatcaaaaaagaagccagcagtttattcacgcactgctgacttcttataatactactcattttatttacttcgctgcgtctcagacaatttttttatttttaaacataacctctgttttcccgccatccctttacataccacctgattccaacatataccagttgcacgaataataagagaaatagcagattgattggcaatacttcctttatccaatccccaaagtagatagctattgccatacttacaagtatcaccattatggtaatcatatcccaacagtatttcttatatagccctgcaatctttatttcgataaatgccaaaagtattcccacacccaccagacatccaccgcaaatcaatattcttatcagccagtttataattccggcaacgacaggattggatattccatcactaatctgtgccacgttctttcctgccagtacaacccagccagcaatggtctgtgtgaaagttgcgattgtatcaaagaataccacgcaatcagaaataaatatttttgaccttatcatctgaaaaagagtagttgatacggaataccatatcagcagaaacatcaatgcttcatacatggctgtttttgttttatatctgcctgccagtttttccctctgcatatcatacttttccttagctttcagataagctgtctgtttacaattcccgcacttttgatagagtaccggcttttc

SEQ ID NO: 6 - DNA, 421232 bp, Roseburia hominis
tcaagatgagatatccctcacataagtgagtaagatcccttgaagactacaaggtagatagggcagaggtggaagcacggtaacgtgtggagctgactgttactaatcgatcgagggcttgaccaaataggtttatcggaatctgtatgaagttttgaaggtacaatataccattgattttttgtaagatatctagtaagataataaatgacgtatctgatacgtcatttttataaatataggggattggtcaaatggtatgataggggtctccaaaacctttggtgggagttcgattctctcatcccctgtgcgtaaagccttgagttttcaaggctttatttttttgtgtcatatttcgtgtcatatcatatcctttctttttccttctgtaagaatcctatttcccgttatatttttgtatttgtgccctacgataaaacagccggctcaattctgagccggtgaatctttttttacagttaagatcagataaagaaaccaggcgatcatgatctcacctcctacaggatagtatatgcaaaggcgggatcacaatacgagcgttttgcatattcttacagattgtaaactggattgcagcgtgatggcggcagataatctgtatatcgggtacgcataattttcatagagagttgtaaaaaaaagaaaattgcgatataataatttttgacatatgacggaaataggtatgaggagaaaagatggcacgaccgacaaaagcaagaagaatctgtatggaagcggcatatgataatttttgcccgaatggtgttccggcaagggaaaaagtcattatgacgatggatgagtatgaaacgattcgtcttgtagaccttgagaagtgtacgcacgaacaatgtgcgaagcagatggggattgcccgcacaacagtgaccgaaatttatgagtcagccagatacaaaatggcagacagcatcgtaaatggaaagacattggagatttcaggtgggaattatcgattgtgtgatggaactgccctgttttgctgcaataaaatatgcaggcgcacctcaacgtccgtcggaaaagatgatattcaaagaaaggaaacagatcagatgagaattgcagttacctatgaaaatggagaaatatttcagcactttggacacacggaacagtttaaattatatgatattgagaatagccaggtggtaagatcccagattgtcgacacaaatggacagggacacggggcacttgccggatttttgacggaggcgggtgcggatgtgctgatctgtggcggaatcggaggcggtgcgcaaagcgcacttgcaactgccggcataaagctgtatggtggagtgtccggtgcggcagatgaagcggtagaagcttatcttgcaggaaaattagattacaatcccgatgtgagatgttctcatcatgagcatgagcattcctgcgcggaacataagtgtggtgaagacaagcatggatgtgccggcaatgaaatgttatcataaaaacacgggacgggagaaattatgataaacagagaagatatgctggagctgacacgcagaatgacgcccagccgcacttcctttacacgtgtggcaggcggctatatggagcaggacggagagatcgatgagagttttaatgtgaactttctcaatctgtctgcggcggaaaaggagaaaaatctggcgattgccaaagcggttccgtttgcagcaaccaatgtaaacctgcgcagctacgcattcggggatggcgcagaacagaggaaaatgcgccagttgttgtacggaatgcgcgagtgcggactgaaaaatgatgcgctgctgtacacgttttatgagcttgtgggtgcccggtaccgtagcagggagccgtatgcgattctggtctttcacgaccgctatgatgtgccggtaaaggcatcggacaaggagcggcaaggggagtcggaggaggtatatgaatatctgatcggtgcagtcgctccgttggtgggagagtacgagccggggcggccggtctgcgggtttttatatccggcatttgccgacaggagcacagacgatgcgcatgttgcgatctttcaggcggatccggaacacaaaatcccggtgtttgaagaactgtttctcacacggtagcagaggaagattgtgccggaaaaggtacaaaaatggcgggatttgcgatagcagaaaccgcgtaggaatattggaaggaatatagaaaacatcccgtttcgggatgttttttttgtgagtttgagcagttctattttaacacatcaaagcattcctcggaattattggatacgacagaacacgcttttgccgcatttctgggaaaatgtaaagaaaatttttccagaattttgtgaatgggaaatttgacttttgggaagaatctagtatgatgaaacaacgagtgcgagagcagctcacagagtatcattcttgaggaaaggagcaaaatgaacagaaaaatattggacgtgacaatgctgtgcaccttatgcatttgtctcatggttgcggccaacattgaggagaagaacacgatacgggagagcagagaagagatcagcagcgcgtatgtaatttctgcggcagacaaagcagaggttccggttgcgggtgtgtgccgtgttttatccggatattcatttacgacagaatcagatgaagcaacaggaatcacaaagaaccccagaacaatggtagcaagcacggcgccgtccgatgcggcagaagaagtacaggtacccacggaggacgcagagacaccggaagccaaagtacaggcagcatcggaggaagcagaggcgccggaggcggcagagagcaagcctgcgacggcagagacgacggccggtgcagagaaccgctggaatatcacattgacgcaggaggagatagatttgttggcaaaaatcgtctggctggaatcgcagggcgagccgacagaagggcaggaagccgtggtcgaggtagtttttaaccggatggcttccgaaaaatatccagataccttgtatgacgtgctcagtcagggaaacccgacgcagttctgttcctggaagaacagagagcgggcaaaccccacggagaaggaatacacttcgattcatgaggtgttgaatggaaatacacatatattaagaaatgatacgttatatttttctacggaaccgttgacgccgagactggaccaaaagatcggcggacacagcttctgctattagtaaggaagtttaggttaaaccggaaggaaaatacgaagggaacccgcagggacgaaagaacctttgggttccttttgcgttgcgggataaagcggcagaccggacaaaagagagcgaaaaatggaaagagttccctgtagattccatgtggttcctttgttacaatacggttgttgcagaaatgaaatatttttgtaacaaataagtaacaatatggaagcatatggaataaatcgggaggattctacataatgaagaaaagaatgacaatactggcgcttctgctggcgggagccgtcacactgggaagctatggaatggtgcaggcaggacaggaaaaacgtgaggtgccggtggcgggcgtgacacagacgctggcacaggtgcttaaggaagcgggaggagtgcaggcgcagacggcggatgctgtggaggaactgcaaagtaacgcggctgtggcgcggatgatggaaccggagatggtggcagaggaagcgtgggagacggcggagattgcggaaaatgaacttccgcagaccgcatcggagtttgcggatattgcagtggcgcaggtgaatcactatgtcaacgtgcggcaggaaccggatacggagagtgaaattcttggaaaactttacgacaaatccgcagccactgtgctggagacgacggaggacgggtggtaccggattacgtccggaaatgtgaacggatatgtcaaggcggaatatgtggtcgtgggggatgaggagcttgccagaagtgtgggaacgcgcctggcgaccgtcacaacgacgaccctgttcgtgcggacggagccgacaaccgaggcgaaggtgcttaccatgctgccggacggcgatgacgttgtggtaaccgacgagtcgacggaaggctgggcgaaggtgtccaccgcggacggtgacggttatgtggcactggattatgtgacactgtccacagagtacattcatgcagagtcaaaagcggaggaagaggcgcggcttgccagagaggaagcagaacggcaggcggcagcccgtgcggcggaggaagcgcgcaaagccagagaggcggaggcggcacgtgcggcagcagaacaggaagcagcccgcaaagcggcagaaaaacaggaggtgaaaaaatccggcgcgggcagcagtgcgggaagcggctccggcagcagtgcgggaagcggctccggcagcagtgcgggaagcagttccggcagcagcacgggaagcggttccggcagcagcacgggaagcggttccggcagcaacgcggggcaaagcacgcagatggcttcctccaacggtcaggcggtggtcgattacgcgagacagtttctgggaaacccttatgtatacggcggcaacagcctgacaaacggaaccgactgctccggatttgtcaagggcgtgtatgcggcatttggaatcaatctgccgcgcacatcgtcggaacagcggagtgtgggatatgccgtcagcctgtcggaaatccagccgggcgacattgtctgctatagcggccacgtcggcatctatgcgggcaacaacacactgattcatgcgagcaatgaaaagacaggcattacgctgacttctccggtaacctaccgcagcgtgctggcggtgcggagaattttctaatccatccgggagggctgctgtctcttaaatattccggttccttgaaatatgactggcggagagaactccgaagtggtatatatataagaaaagggaggaagagaaggatgcggattggtggaatagaagcgggcggcaccaagatggtgtgcgcgatcggggaagtgcagacagacaaaggacagccgggagaaaatcaggtcacaatcacagagcgtgtgacgattcccacagagaagcccaagattaccctgccgcgcatggctgcgttttttgagggaaaaggaatctcgtcactcggaatcgggtgtttcggaccggtggatctgcaccgtgcgtccccgacctatggatatatcaccagcacgccgaagctggaatggcagaatgtcgatatggtgggaacttttacacgggcgcttggcgtcccggtcggatttgatacggacgtgaatgcggcggtgcttggcgaagttacctggggagccgcaaaagactgcgacacggcaatctatattaccgtcggcaccggcgttggcgtgggcgtctactgtaacggggcgctcatgcacgggctggtgcacccggaggcaggacatcttcttctgcagcgtcacccgaaagacacctacgccggaaaatgcccgtaccatgccaactgtctggaagggcttgcaagcggtccggcggtggaggcgcgctggggcagaccggcaaaggaactggcggaccgggaggatgtctgggagatggaggcgttctatctcgcggaggcggttgcaaattatgttctgacgtattctccgcagaagattgtgctgtggggcggaattatgcaccagagccagctcttttcaatggtgcgcacgaaagtgcaggaactgctgggcgggtatatttccaatgagaaaatcttaaaggagatcgatacctacctcgtgccgccggcacttggagaaaatccgggtattatgggagcgtttgcgctcggtatgcgggaggcagagtaccggaagcctaaggaagcgtaggggcgccggagaacaggatcgcggaatcggcgggagtgaaaacagaatttagaagaacagaaaacgggagcgctatgccggagatttttcctgacacagcgctcccgtgtgattttgtaaaaaagaccgggtcttagttatcgccctcgtcatccgatgacatggagtatacctgacgttttcttgccatctcatcattctcgaggtattcgtcgtaggtggataccttgtcgacaaaggtgccgtccggcaggaactcgatgatacggttcgctgtggtctggacaacctgatggtcacgggaggcaaaaagaataacgcccgggaacttgatgagtccgttgtttaatgcggtgatggactccatatccagatggtcggtcggttcatctaagatcagcacgttgcttcccataatcatcatgcgggagagcaggacacgtactttttctccaccggagagaacgcgcatcttcttggtaccgtcatctccggcgaacagcatacgtccgaggaaaccgcggacataggttgcatccttgatctcggagaactgtgtcagccagtcaacgatcagaagatcggtatcaaagatctcggtgttatccttcgggaagtaggactggctggtcgtcacgccccacttgtaggtgccggaatccggctccatctcaccggcaagaatcttaaagagcgttgtctttgccagctcgttgcttccgacaaacgcgatcttgtcgtcatgtccgacgataaaggagacattgtcgagcaccttgacgccgtcgatggtcttggtaatgccttcgacggtcagaacttcattgccgatctcacggttcggacggaaatcgatatacgggtatttacggctggacggacggatctcgtcgagctgaatcttttccagggcacgctttctggaagtcgcctgcttggatttggaagcattcgcggagaaacgggagatgaattcctgcagctccttgatcttctcctcttttttcttgttggcttccttcatctgctttacgagaagctggctggactcataccagaaatcatagttgccggcgtagagctggatctttccgtagtcgatatctgcaatgtttgtgcagactttgtttaagaagtagcggtcgtgggaaacaacgatgaccgtgttctcaaagttgattaagaattcttctaaccagctgatcgcatcgagatccagatggttggtcggctcatccaaaagaagaatgtccgggttgccgaagagcgcctgtgcaaggagaaccttgacctttaaggcacttggcatatccgccatgagtgtgtagtgatcctccgtcgggatgccaagaccatttaacatggtggctgcatcggactcggcattccagccgtccatatctgcgaactcggcttcaagctcactggcgcggataccgtcctcgtccgtgaaatcctctttcatgtagatcgcgtctttttctttcatgatatcgtagagacgcttgttgcccatgataacggtatcgagtactgtgtactcgtcatatttaaaatgatcctgctgcaaaaaggaaagacgctgacccggcgtgatgatgacttctccgctcgtcggttcaagctggccggacagaatcttgaggaacgtagatttcccggcgccgtttgcaccgatcagaccgtagcagcagccctctgtgaatttgatgttgacatcttcaaagagagctttttttccgattcgtaaagtgatgttgcttgtactgatcatatttatgttctcctaacttttcttgtaaatcacctgcttttattgcaccaattcgtatcatactaaaaaatacggagaaatgcaaccggaacttcttattaaaaagggctttcacgctgtgacaaattgtttggatttcgttaaaaatttgatataatgtacgggaaggcaatcggagttatcttaagtatgacagaggaaattgcatctcaggagattgattttatggagtatggggatacgcaaataaatacaatagacatggagcgggggcagagaaaagatctgatcggcaagatgccggtcggaatagcggtagtccgcggcgggaatgagctgtatattgagatggtgaaccgggaatttttgcatgcagaggggtatgacagggaggaactgaccggaaatacgccgtttgtggagtatttgtaccgggacgataccggtgtgttcgaggatgccatcgaagtgtgccgggaactaagaaccacggaggagattgaactgcgcatccgcacgaagagcggcggcgtctgctgggaactgatgcggtgcagactgtattattaccgggacgcggtaccttactatatcctggtaagctggaacatagacaagcggaagaatctggaggaagaactgcgcctgatggaggagcagtacagcatgttagaagaggtcaccgatgaattcccgctagagtacgacgttgcacagcggcgtttcagggtgccgcgcaaatatcgcgggaacgggcaggcgggaacggcagggcgcagatatatgggctatgaggagatgctcgcggatatctgcgaggaggatcgtgtcgcgtatgcccgggtgctggaggcagccagcagggatgtgcagacaggaagtattgattaccggatgaatgtggcggctcccggggaggaacctgtatatgtgtggtaccggacgatttaccggagtattgtcggggacaacggacagattatccgcatcatcggacgcagctacgatgtcagctccgaccgaaagattcaggaggaactgtcggaggaggcgaagcgcgacccgctgacaaggctttataataaggtggcggcatccggagaggtagaacggattttaaaaagtgagccggaaaaacagcatgtgctgttcctgatcgatattgataattttaagcggatcaacgatacgttcgggcataccgtcggagatacggtaattactgatattgccggcgtgctgcaaagccagtttcaggagacagatgtcaccgcaagagtcggaggagatgaatttctggcgctgatgcgggatgtggctccaaaggaggcagaagcgtgcgccgcggcgctgggacgggaagcaagaaaaaagctgatcggcgatgacgccatcgttgaggtgacgctcagtataggcatggcggtatacggtgaggatggaagagactatgagaccctgtttgcgatggctgaccgggcgatgtatgccacaaagcgggagggtaaggatcactattcgtttgcgggcaaaaagcagcaagagggagtagagcgggagcgcaggcgcgacaggattgaatatgctccggaaagcgggcagaaggtggataaagagttcctgaattttgcgttcagccttctctcgcatgcgaaagatatcaacggatcattaaacgtattgatcgaacagattgggaaaaaatacgggctgggctttgccatggtgtttgagtaccgggaagaacagcaggaaatggtgctgatgaattactggaaccgggatggcagccgggtggaacaacaggttttcccacaatcggttacagtgttccgggaggcggaaatcgggcgttttgtctcgacgccaacggaagatatattaacggaggttccccagctgggggcggagaaatatcatggaacttccatcaaaaactgtggaaatgtaaaatttgaattttccggtaacagaagtggctgcctgtgtgtgggaagcagcagtgcagagggattttccaaagaggaagcagggatgctcagtgaactcgcgcgggtggttgctgtatttgtctcccttcgcagcaggcagagcgatgaccaggcagagatacggcatctgcagaatcaggatatgctgacggaactgtataatctggacacattccgcaggctgatccggaaaaaattaaagagcggtgggcttgcgcaggatgagaacatggtgtacgcgctggtaaatctggacgtgaacaactttgcctatgtaaatgaaaattatggacaggaggccggcgacagtattctgcaggagcttgcagcgttaatccgcagcgagtcccatgtcgtggaggcctgtagaatgtattcggattatttcattgagctggtcagaggaacggacaaaaagaacattctggggcttgtggagagagaggatcagatgtttggcgaacagttaaagatccgctatccggcgggagccatgcagctttcggctggaatctgctttatcgatgacggggaagagacgtttgagaagatactggagggagccaatctggcacgaaagcttgccaaggagcagaatgcgggagcggtcgtttaccgggaggatatgaggaaaaaccgcgatgagggaatccggattaccggaagattttacgcggcactgcagcggggcgagttcgaggtatatttacagccaaagtttctgctccgcgaggagagggtctacggcgccgaggcgctcgcgcgctggcggctggaatccggggaggtcctgtctcccgcacggtttatccctgccctggaaaatataggctatatcgtggatctggatttttatattctggaacagctgcttcgggcaatgcgccgctggagggattccggaagagagctgtttacgatctccaccaatttttccaggagaaattttgagaacggcggcgacgattttatcgagcgcctgcagaataccctgcagcggtacgggattgatccgtgctacatagggatcgaggtgacggagagtgtgattgtggagaagttagacagcttaaaggcgtgtcttaccagacttggcaaactcggctaccgcatcgccatcgatgatttcggaaccggctactcatcgttgagtgtgctgttggagattccagcaaatgtagtcaagatcgacaagagttttaccgacaaaatccaccagaacggacagaatgcttttgtctatcagatggggcagttcatccagtcggcaaaggaggaggtgatttttgagggaattgaggaggagcagcagcggacgtttttgatggagtgcggttttaactacggtcagggctattattttgaccgcccgctgcccctggaggagtttgaaaaaaagtatatctgaccggggacaaacagaacatgacaaatgtagattgcacacgttttcgtacagtctgaaacctttacaatcgacaaattaaatgctaaaattagtcttaagtcggaatatgacactctattttaatttaaggaggaataataatgtccagagcaaaacagtcaatggacggtaatacagcggcagctcacgtagcttatgcgtttacagatgttgcagctatttacccaattacaccttccagcccgatggcagataccgtagatcagtggtctgcagcaggacaggagaatatttttggcaatcaggtcaaagtcgtagagatggagtctgaggcaggtgcagcaggtgccgtacacggttcccttgcagcaggtgcgctgaccacaacctttacagcatctcagggtctgttacttatgatcccgaacatgtacaaaatcgcaggcgagcagcttccttgtgtattcgacgtatccgcgcgtaccgtagctacccagtctttaaatatttttggtgatcacagcgatgtttacgcctgtcgtcagaccggtttcgctatgctgtgcgagaccaacccgcaggaagttatggacttaagcccggtagctcatcttgctacaatcgagggtaaggttccgttcatcaacttcttcgacggattccgtacttcccatgagatccagaagatcgagaagtgggattatgcagatctcaaagagatgtgcaacatggatgcagttgcagagttccgtgcacatgcactgaatccggagcatccggctatgcgtggttcccacgagaacggagatgttttcttccagcatcgtgaggcttgcaacacagcttacaatgaacttccggcaatcgttgagaagtacatgaagaaagtcaacgagaagcttggcacaaactatgatctgttcaactactacggagcaccggacgcagagcgcgttatcgtagctatgggttccatcaacgacgtagctgaagaggtaatcgactacttaaccgctaagggtgagaaggtcggacttgtaaaggttcgtctgtatcgtccgtgggtatcagaggcatttttaaaggctcttcctaagacagctaagaaggttgctgttcttgacagaacaaaggagccgggcgcacttggtgatccgttataccttgatgttgcaaccacactccgtgaggctggtctcgacactgttgtcctgacaggcggacgttacggattaggttccaaggatacacctccttcaagtgtattcgctgtatacaaagagctggagaaagatgctccgaaggctcgtttcacaatcggtatcgtagatgatgttacgaacttaagcttaccagaggttaagccggctccgatcacatctgcagaaggtactgtagagtgtaagttctggggtctcggcggtgatggtactgttggtgcgaacaagaactccaccaagatcatcggtgaccacacagacaagtacatccaggcatacttccagtatgactccaagaagaccggtggtgttaccatttcccacttaagattcggtgacaagccaatcagaagcccgtactacatcaaccaggcagacttcgttgcatgtcataacccgtcttatgtaaccaagggattcaagatggttcaggacgttaagccgggcggagtattcatgatcaactgccagtggtctgatgaagagttagctcatcatctgaatgcagatgcgaagaagtacatcgcagagaacaacattcagttatatacaatcaacgcaatcgacaaggcaatcgagatcggtatgggcaagcgtaccaacacgatcttacagtctgcattcttcaaacttgcaaacgttatgccgatcgatcaggcagtagagttcatgaaagctgcagctaagaagtcctacggtaagaagggcgacgcagttgtagagatgaactacaaggcaattgatgccggtgtagacgcagtacataaggtagaggttccggcttcctggaagaatccggaggcagacgcagctcctgcagagcttaagggtcttccgaagactgttaagatggtaagagacttaatggagccgatctccttaatggatggcgattcccttccggtatccgcattcaaggagaacccggacggacagttcgagcttggcgctgctgcatatgagaagcgtggtacagccgtaaccgttccgacatggaatgctgagaagtgtatccagtgtaatcagtgtgcatttgtatgttctcatgcaaccattcgtccgttcatgctgagcgaggatgaggtgaaggcagctccttccaacatcaagcttgcagatacaaagccgaaggcaagcgagtacaagtacaccatgagtgtatctccgttagactgtatgggatgcggtgagtgtatcactgtctgcccggtaggcgcaatcgagatggttccgcaggagtctcaggcagaagagcagccggtattcgattacctggtagcaaacgtaggcaagaagcctggcatgccggcagacaacactgtaaagggatcccagttcaaccagccgctgcttgagttctctggttcctgtgcaggatgtgctgaaacatcttacgctcgtctgatcacacagctgttcggtgagcatatgtacatcagtaacgcaaccggatgttcctctatctggggtggtccggcagctacatcaccatatacggtaaacaaagattccaagaagggaccggcatgggcaaactccttattcgaggataacgctgagcatggtcttggtatggaaatcggtcagaaggtacttcgtgagcaggcaatcgcttctgcagagaagtgcgcaacatctgacaaggcaagcgctgagttaaaggcagcatttgacaagttcgttgagacaaagaacgatacaaaggcaaatactcctgcagcagcagctcttgtagcagagttagagaaggcagcagcagccggatgcccggatgcaaaggctgcagttgagaagaaagattacctcgctaagaagtccgtatggatcttcggtggtgacggttgggcatacgatatcggattcggcggtctggatcacgtacttgcttccggtgagaacgtaaacgttatggtattcgataccgagatgtactccaatacaggtggtcaggcttccaaggcttccaacatcggtgaggtttgccagttcgcagcttccggtaaggaagttggcaagaagagccttgcagagatcgctatgagctacggttatgtatatgtagcacagatcgctctcggtgcaaacatggctcaggctgtcaaggttatcgctgaggctgaggcttacaacggaccatctctgatcatcggttacgctccatgtgagctgcacggtgtaaagggtggtatgaaccactgccaggatgagatgaagaaagcagtagcagcaggttactggaacctcttctccttcaatccgcagctcaaggcagagggcaagaatccgttcactctgacatccaagccgggcgacggttcttatcaggatttcctgaacaacgagacacgttacagccgtctgactagagcattcccggagagagcagaaagactgttcaaggcttccgaggaagctgcaaaggctcgttacgagcacttacagagactggtagagctgtacaaataatcagtccgatcagcagattgtgtaatgcatagaaggatcgcagttcatgtttccatggactgcgattctttttgtgcgttatacttgcacgtttgtaattagatatgttaaaataagccgaagtatattagacaataacgtataggacaggaagagaaaatgatgcagttaagcagagagaaaaaacattttttgcactgcaaatacagagtggcactggcatgtctgatcgcagtcagtcttattggcggctgcggatatcataaaagctatcatctggagcggaaatacggcgacgttttgaaatcgtttttgccggacgggtatgagatcacaaggaccgagaaggaagataaggtaaacggaaaacactattataccagcaataatcatcctactttagacggatacgtatacgacacctatgattattacagcattgattacggatataacaattcccactcctggtatatcagcacgtatctggtcgcaaacggaacatacgaggatgacgactggatggcatcacaggtatgggggcagattacctatgagatcgagcgtctgatgcgccgtacgacgacacagtataagtatgtagatgagaacggcgacacccagaacttcggggcagtgaccacactgagcgggacagaaatctactgtgatatggatgatctggagattttgaacaacccgaccgggatcaatctggctgaatttacgtgggatgatgtgagaagtctcggcaatccggagataaaaatttatgcaaaatcttctactaacaaggatgcgctgcaggaagatgtgattcagggtgtgcaggaagcgattcaggaagatgcgggagatggaattgtaatcacaatcgaagtggacaggtaggacttgaaacagaggtggttttgatcttgccatgcagccgaatgagatccggtggttatcagatctgacagaggaagtgtttaagggaaatggacagaaaaaagaagcggattcatttgtcaaaagagaatgagaaagtttttcgggagattcttacggaggtatgcaaaaattccaggtttctctcctccagccggtttatgcagcatggttccacgagcgtattccgccacagcgtggcggtggcgtacgtcagtttttacattgcggaaaagtatagaatccgcgtgaactgtcatgcgctgatccgcggggcgttactgcatgactattttctgtacgactggcatgagaaggacgattcccataagtggcatggattttatcatgcaggaaaagcgctgcagaatgcgatggaagattttgaactgagtgagattgagaaggagacgatccgtcggcatatgtttccgctcaatccgattccgccgtgctgcagggaggcgtggattgtgacactggcggataagatctgctccggcggggagactgtcgaaggatttcgggaaaagtttgaggagattaggaatcctttataaaatagaattgccgcaataagcatatcgctctttgctttgataagtaatattatgagaaatagatacttaaaagttccagataaacatgcggcggcaaattctgaccgcaaaatccggtatttctaaccatgccgcagctggcatctgtgatgatccgtgtctttccaagtttggagcactctacggactgtgtccgcaagccggcagacaatttgtaggactttcgtgtgtgtcccttattggcacctctgaacaaaacataaccgcgcgaagccgctgtctgagtcggcatctgccctattttcaatagcagaagccggtgagttcggttcgcgcggttttatattgtctgtgaagaggtgccattagggacaccagaaagtccgcccattgtctgcggcttgtcggacacactccgtgagtgttcaaacgtggaagagacacagaacgggatgccagccacggcatggaagaaatacatgaattttgcttcaaagaatctgccgccgtctgtttattctggaacttttttgttctctgatatctctgtaatattacttatcagagcaaagcacgctgtgcttagtgcgacagttctattttttcaggaacttaatcttccgctggaattacacggaaatttagccttcggctaaattcccggtatacagctgatagtatttgccgtgtttttcgatcagctgatcgtggctgccgcgctcaatgacacgtccctgttccaggacaatgatgcagtcgctgttgcgcacggtcgagagacggtgcgcaatcacgaacgtggtgcgtcccgccatcagcttatccataccgtcctgcacaatcttttcggtgcgggtatcgatggaacttgtcgcttcatccagaatcagaaccggtggatcggcgatggcagctcttgcgatggcaagcagctggcgctggccctggcttaggttggcaccgtcgccggtcagcagggtgtcatagccgttcggaagctgctggataaatgtatctgcgttggcgagtcttgcagctgccatgacttcctcatccgtggcatccagcttgccgtaacggatattttccataaccgtagccgtgaaaagatgggtatcctgcagcacgattccgagagagtggcgcaggtcatcttttttgatcttgttgatattgataccgtcatagcggatcttgccgtcctggatatcgtagaaacggttgatcaggttggtgatggtcgtctttccggcgccggtgctgccgacaaaggcaattttctgacccggcgtagcgtagagatctacgttgtgaagaacggtcttctctggaacatagccgaaatcgacatcatcaaataccacgtcgccctttaattcaatataatcgacactgccgtctgcctgatgggtgtgcttccatgcccacatacccgtacgctctttggattccacaatctgaccgttctcctgtctggcgcggacaagtgtgacgtagccgtcgtccacttccggctgctcatcgagcagagcgaagatacgctctgatccggcgagtgccatcacgatattgttaagctgcatggagagctggttgatcggctgcccgaagctcttattataggtaagaaaacttgcgagctttccgagcgtaaatccgccatatccgcccagagcaagaataccgccgacgatcgcgcagagcacgtagctgatattaccgatctgtgcattgaccggcattaaaatgttaccgaacttattggcattgtctgcactgtggaacagctggtcattgagccggttgaaatcggcgatgctttcctcctcatgggtgaagactttgaccaccttctgaccgttcatcatctcttcaatgtagccgttgacggtggcaatgtctttctgctgcgcgataaagtagcgggcgcttaaagctccgattttctttgtggcaaacagtgtgacaccgaccatcgcaagtgtgacaagcgtcagcggaatgttgagaagcaacatactgataaagacgctcacgatggagatgatgctgttcaaaaactgcggcatactctggctgatcatctggcgcagggtatcaatgtcattggtataagttgacataatgtctccatgggagtgtgtgtcaaaataccggatgggaagctcttccatgtgggtgaacatgtcgtcgcgcagatgctttaaagtaccctgtgagacattgaccataattcttgtgtatatgtaggctgcgatagcgccgatgccgtagaagacggcaacgcgtaaaatggcgtgtgcgagaccggaaaagtccggatcgctctgcttcatcagcggcaggatatagccgtcgattaaggtctgcatgaaccaggttccctgcacacttgcgagaaccgtgataaaaatacagatcacgacaatgacgcagtgtacggcataatttttcataatataggaaagcaggcgcataaaaagctttcccggattcttgacattcggtctgggaccgtgaccgccgcggccgcccggtccgccgatcggctttgcatttttttcattctgtggcatcaggcagcacctccttcatcaaaatcaccgccgccgccggtctgtgactcgtagacatcgcggtaaatggcattggtctgcaataattcttcgtgtgtgccgaaaccgttcaactctccgttgtccagcacaatgatgcggtctgcatcctgaacggaggagattcgctgtgcgataatcagcttggtcgtgttcggaatctccgtgagaaaagcgcgacggatcttggcatcggtagcggtgtccaccgcgctggtgctgtcgtctaaaatcagaatcttcggcttctttaagagcgcgcgggcaatacacagacgctgtttctgaccgccggagacgttggttccgccctgctcgatgtaggtgttgtaaccatccggaaaacgctcgatgaattcgtcggcacatgccagttcgcacgcgtgacggcattcttcgtcggtcgcatgttcatctccccagcggagattctcatagatggttccggagaaaagcacattgttctgcaatacgacagagacctcgttgcggagggtgtcaagatcgtaggaacggacgtcttttccgccgacgagaacacggccttcggatacatcgtagagacggctgatgaggttgacgagcgaggacttggaacttccggttccgccgatgataccgatcgtctcgccggattttatggagaggtcaatatcggagagcaccggctttgcggatgtcttgctgtaacggaaggtcacatggtcaaaggtgatgcttccgtccggcacggtcttatccgcattttccggattggtgatgtcgctcttctcatttaatacttcacagatacgctcggcgcttgccacactcatcgccagcatgacgaacaccatggacagcatcatcagactcatcatgatattcatacaataggtaagaagactcatcagttctccggttgtcaatgttccgccgacaatcatttttgcgcccacccagctgatcgcaagaatacagctgtaaacggtgatctgcatgaccgggttgttgaaagccagaatgctttccgccttgacaaacatgttgtaaatattctggctggctttgcggaacttgtttttctcgtaatcttcacgcacataagccttgaccacgcggatggcggatacgttttcctgcacggaggcatttaggtcatcgtactttggaaaaacttccataaaatagtgatgcgcgcgcacggtgatgatggcgagaatgatgcccagaatgatgacggcaacaagatagatgctcgccagtctcgggctgatgaaaaacgccatgcacatcgcgcagatcagactgatcggcgcacgcacacacatgcgcagcagcatctggtaggcattctgcaggttggtcacatctgtggtcagacgggtgacaagacctgcggtactgaatttgtcgatgttggaaaacgaaaaactctggatgttctcgtacatcgcttttcttaagttacgtgcaaaacctgcggaggctcttgcaccgtattttccgcccatgacaccgcagaagagggagaaacaggcggcgacaaccatccaggcacccatgacgtagatatggtggatgttgcccgcttccacaccctgatcgataatggaagccatcatcagaggaatgattgtttccatgaagacttccagaatcatgaagacgggagtaagcagggaatcttttttgaactccctgatctgtgctccaagtgtttttaacataatttcacatcctttttgaattttctgttgatttttaattgttagtgtgctaacaataatgttatacgataattaaaaacagaagtcaatgattattttagaaaacagacagaagagaggaagagatggaacgaatcaaaaggtcagagaccatcggatacaaaatacgcctgctccacaatcagatccataagaatatggaagcaaagcgtatggaaaatgaggataacctgacaggaatgcagcgctggacacttggttttttgaaagatcacagcgactgtgaagtctaccagaaggatatcgaggaggctttttccatttcaagagcgaccgcttctaatatgcttggtgtgatggagcgcaaggggctgataaagcgtgtggcagtctcacatgacgcgcgcttaaaacgtctggtgctcacagataaggccgctgcgcttttggatggcgcggagcgcgatatacgggagatggaagcgcgtctgacggcggggctttcggcggaggatgtggagcacctgaagcgctgcctggatcagatgctacaaaatctggatgtaacaataacggaagacacaagatgttgttgtaaaccaaagcgataaaaagtgacaaagtttcgggatgaattttgttcaaaaggtaaaataaccacagaatctaggaaaacgcattgacaacaatactagatattgtataatgaaaaagcaattaacagaaaggattctgaacggttatgaagattattaagagaagtggcagcgaggacatttttgacatcagcaagatcgaggctgcaatccgcaaggcaaacgacagcgtcattgattatgaaaagcttggagacgacaagattcaggcgattctttccaatgttgaaaaagcctgcgagaatatgaagcgctccccgagtgtggaggagattcaggatatggtggagaaccagatcatgagtcagaaagcgtttaatgttgcccgcaactatattacttatcgttataagagagaactggtgcgcaagtccaactctaccgatgagcagattttaagtctgctggaatgcaataacgaggaagtaaaacaggagaactccaacaagaatccgactgtaaacagcgtacaaagagattatatggccggtgaggtcagcaaggatatcaccagaagattccttctgccaccggagatcgtagaggcgcatgagaaaggaatcatccattttcatgacgcggattattttgcgcagcacatgcacaactgctgtctggtcaatctggaggacatgcttcagaacggtacggttatcagcgagacgatgatcgatacgccgaagagcttttccactgcctgcaacattgccacacaggcaatcgcgcagattgcaagttcccagtacggcggacagagtatttccctgtcccatctggctccgtttgtgcaggtgagccgtgagaagttccgcaagcaggtgcgcaaggagcttgagactgccggaatcgaggcgacggaagagaaagtcaaccagatggcggaaatgcgggtcaaagaggagattaaccgcggtgtgcagatgatccagtatcaggtcatcacgctgatgacgaccaatggacaggctccgtttatcacggtgtttatgtatctggatgaggtgccggagggacagcttcgggacgatctggcagcagtgatcgaggagatgcttcatcagagaattttaggggtcaagaatgagcagggcgtttatattacgccggcgttcccgaaactgatctatgtgcttgaggaggacaatatcagggaggggtccaaatactggtacctgaccaggcttgcggctgagtgtaccgcaaagcgcatggtgccggattatatctctgagaagatgatgaaaaagttaaaagacggcgactgctatacctgtatgggatgccgttctttcctgacggtagaccgcacgacgggcaatctggcacatgccaagaattataaagaaggaaagcacaagtattacggacgctttaaccagggcgtagtgacattgaacctggtggatgcggcatgctcttccggaggagatgagaagaagttctgggagatcatggatgagcgtctggaaatgtgctatcaggcattgatgatccgccacaaccgcttaaagggaacaccttccgacgtggcgccgattctctggcagaacggtgcgcttgcacgtctgaagaaaggcgagacgatcgatgaacttctctatcacggttactcgacgatttctctcggctatgcgggactctgcgagtgcacacgctatatgaagggcgtatcccacacggagccggaaggcacggaattcgcgcttgcagtgatgcgtcgtctgaatgatgcatgcgccaagtggaagaaggagacggacattgatttcagtctctacggaaccccgcttgagtcgacgacctacaagttcgcaaaatgcttacagaagcgtttcggcattatcccgggtgtgacggacaagaactatatcacaaacagctatcatgtacatgtgaccgagcagatcaacgcgttcgataagttaaagttcgagtcacagttccaggaactgtccccgggcggagcaatcagctacgtggaggttccgaatatgcagaacaatctggaagcggtgctttccgtgatgcagtacatctatgaaaatatcatgtacgcggaactcaacacaaagagtgactactgcatggagtgcggatatgccggagagatcaagattgtgacagaccgggacggcaagctggtatgggagtgcccgaactgcggcaaccgcgatcagaataagatgagcgtggcgagacgtacctgcggctatatcggaacacagttctggaatcagggcagaacacaggagatcaaggaacgggtattacatttataaaaaacagggggactgtggcgtgcacgggattgtgcagccacagtctttctttccctgtcgaggagaaaagatatgaattattcggcaatcaaatattgtgatattgcaaacggaaccggtgtgcgcaccgttctctttgtgtcgggctgcagaaatcactgcaaagactgttttcagccggagacgtggacttttgaatacgggaatcctttcaccggcgaggtggaagatgagatcattgcgtccttgaagccggattacatccggggactgacgctgctcggaggagatccttttgaaccggagaatcagaaggcgctgcttccgtttatgcggagagtgaaggcggagtgtccggggaaggatgtgtgggcatacaccggctatgtgttagaccgggatcttgtgccgggcggaaaatgctgcaccgcagataccgcggagctgcttcacacgatcgatgtgctggtggacggaccgtttgtgacggagcttcatgatatatccctgctgtttaaggggtcttccaaccagcgggtgatcgactgtgcagagtattgccggtcgggagagatccgggagctgatgtagaagaaggaaggattttgcatcttcctgcggtttgtgttacaatagacgcggtattgcaggaccaacaagggagaattagatatgaaaataacatggaagacattgctggcgttgtttttttacacgctgggagttgttggctggttctatgtaggaggatggatgatcttaagaggaccggtcagaggagtgattctggcgcatatggcaggagatttgtctctgatcaagctggcggtcgcactggtgcaggggtttgtgtatctctcactggcgggaggcgtctggtgtatcggctatatgttgagcgatcatttccggaaagatgagtaggattacaaaaaggtgcggcgcatgacgcacctttttgcaccgtaaatggatataaaatggcgcagaaaagaggcgcggacaggagcaaataatgatattaaaagtaccgtcttactatgaaaagtttcactgtattgcagatcagtgtaaggataattgctgttacggctgggagatcgacatcgacgaaggtacgatggattactaccgcagcctgggcggagagcttggaaaagagattacctcgcatatcaaggcaggcgaggagaacaccatgattatgcgcgaggacgggtattgtccgtttttaaatgagaaaaagctctgcgacatctgcattaagatgggagaggaagcgctgagtgagatctgcaccgagttcccccgttttaccatggagtatgaggacgtccgggagaagatcttaagtctggcatgtgaggaggtcggaaacattatgttttccaccgacgagaagatcacctggcaggagcatgagatgccggatttctgcggaaccggggacgatgccgaggcagcttatgatgccgacggggctttgtacggtaatgaggaggcagcgtgtgaggacgatgcgtccgacggcgaggcgtatgacgacgatgaggaagtgtctgtggatgccgatcagctgaatgccgtttctaaggcggcggtggcattgcttcagaaccggaagaagccggtggcagagcgtgcggcggagtaccttctatattgcaagaggatgcagcaggagctttacggataccacacgggcggggaagtaagcgggcaggaacaggagcaggagcagcgtgagagccggctgattgccgagtgcagggagaaagaggtaacgcctcaggaggcgtatgcggcgtttcttgcccgcatggagcgctacgaacaactggaagtgctcgaccagaactgggaggaagaaaagaaacgtcttcgtgcggcattccatgaggacaattatctggaatgcatccagaactttcacacagcgcagcagggacgggaatatgagtatgagcatctgctggtctactttgcattccggtattttatgagatcctattatgatgacaacattttaaacaaggcacagtttgcggtggcgagtattctgatgatccgcgatatggatgcattgcgttttctggagaacggaggaacattctccgtggaggaccgggtggcagtggcaaagctgtattcaaaggaagtagaacattccgaggaaaatatggaattcctggaggaggatttccagtttgaggatatttttgcaccggaacagatgatacggcagcttttctttgcttcatagggaagacggagaacatcaatggagcgattccgacccacccaaggcaggaagcactttatatttcataagcgtacgatcacagggaaagtggcatagaatagaaggcaggaaatctgccaggatggaggaaagaacatgaaagtaatattggtaaacggaagtccgagggaaaagggatgtacttatacagcgctctgcgaggtggcaggggctctcgagaagaacggcattgagaccgagatttttcaggtgggtgcaaagccgatcgccggctgcatcggctgcaatgtctgtcttaagaacggacgctgctttgtggacgatccggtcaatgaatttgttgagaaagcaaaaacggcggacggttttgtgttcggctcgccggtgcattatgcggcggcatccggtgccatcacctcgtttctcgaccgcgcattctacggaaagggaaatgtgtttgccggaaagccgggggcagcagtggtgagctgcagacgcggcggcgcggcatccgcgtttgatcagctgaacaaatatttcacgatcaattccatgccggtggtttcctcccagtactggaaccaggtacacggaaatacgccggacgaggtacggcaggacgcagagggactgcagaccatgcgcacgctgggcagcaatatggcatggctgctcaaatgtattcaggcaggggcggcagcgggaatcacattcccggagcgggaacctgcaatgaaaacaaattttattcggtaaaagttcagtggaaattaagagaaattaagacaaatttaaaacacagaaattctcatctgatgtaagataaaaaagaagggaaaagccttctagtaacgacctgtgataaagtgcaggaaagataccggctttttcccagcagccttggcagcagtgagatattcttcataaaagagaactgcttcgctgtaagtcatagttggatctatggtatatttcatcgtgatacgcctcctttctttttccttgacagagtatagcacttgttttggaagaaagcaacaaaaagatagtaaaaattttgtaaaaaatcacgaaaaaattgtgtaaaatgaaaaaagaggcgcgcgtggaaccgcaaagagagtacgacaggacgaacggacagatgggaagatggagcaatgcgagaggaacaggaagagaaatacaggcgcgaagaacggcgtaggtatgaggagaaaaggcggagacggcgcaaaaggcttcggagaagacgccggctgcgcatagtgcttttgatcggcattccgctgcttttggtgctggcggtctggtttggcacacgacagatcaaaaagcttctatatgaagaaaagccggtgatggcgtacgaggtaaagtatgtggcacaggcgccggactatcaggtagaactgctggattacaacgaatattcgcgaccgggaacggcgctttcccaggtaaacgggatcgtgatccactatactgcgaatccgggcacgacggctgagcagaaccgcagctattttgagaatctgaaggacacaggggagacatatgccagcagccattttgtcatcggcatggacggggagatcgtgcagtgcattccgtgcaacgagattgcttacgcgtcgaatgaccggaatgaagacacgatagccatcgagtgctgtattccggatgagacgggagagtttaccgatgcgacctaccagtcgctgatagagcttaccgcctggctgatgggacgctatgacctgactacggatgatgtgatccgccactatgatgtgacggggaaaatgtgcccgaaatactatgtggagcatgaggatgcgtggcttgtgttcaagcaggacctgctgacctacattgatgtgaatggtattgccaaaaatgaggaaatatcgtagaatacctagtatcaagggtagtaggtatacggtatgattcacgaatattataaagaattacagaacaatcagaatataagagagaacttgagtctgctgcgaagcgagtgcaaggacccacaggcaagggaaaccctgctgtctctggtgggagacggggcactgctcacaggactgctggagagcgatgagccgaaggtgcgcaaaaatgcggcgcttctgcttggaagtctcgggcttttacagacggcaggttctctttttcatgcatacgagagagagcagacgctgttcgtaaggagcgcgtatctcacggctttgtcagggatggaggtatccccgtatctggaagcgttaaaagaacacagggatgcacttttggcgcgggagattcccgagaatgagaaaaagcatgtgaatgaggaactgcgggaactggaacgtatcattacggcggcggagggaattacccgtcacacgtttgtgggattcacagagccgcaggattttctgctcgcgacaaaccgggagcagcgcggcgtgacgcttgaggaggtaaaagcggtgtccgcatcggtcagacgcagtgagaaactgcacccgctcggtgtgctggttcatgcgaaggacgtccgcccgtttgcgtcgataaggacttaccgcgagttattgtttccggtgcgcacggcgcagccggtgccggaagatgccttaggagccgcggaggcggtctgggattccaatctgcgggagctccttacacaggcgcaccgggagacgacgccgttttatttcagactggaaataaagagccacatgccgttagacaaaaagagcacgtttgccagacggttttccgcggagctggagcggctgtccggcaggatgcttgtgaatgcaccgtcggattatgagattgaactgcggcttctggagaaaagagacggcggttacgcctgctttctgaaacttcttacgattgcgcatggacgctttgcctaccgcaaaaatgcggtggcagcttcgattcatccggcgacggcggcaatgattgtggcgctggcagagccgtatttaaaagaaaacgcgcagattctcgatccgttctgcggtgtcggcacgatgttgatcgagcgggatatccgtgtcccggcacgggaaaaatacggaattgatatctttggcgaggcgatccggggagccagggagaatgcatcatatgcgggggagaaaatcaattttatcaaccgtgattattttgattttacacatgcatatctatttgacgagatcatcaccaatatgcctgtccggggaagaaagtcaaaggaagagacggacactttttacggcagattttttgaaaaatcagccggacttttaaaagcggacggaattcttgtgctctattccaatgagcagggatttatcagaaaacagcttcgcataagaagcgcttaccggctgcttgccgagcagtgtatccgggaaaaggatcagttttatctgtttgtaattcagtataaaggatgaggaagatatggcactttcaagggggatgaatcaggaagcgtcgcaggataccgatctgggattgttagatgcgacattgatgcagaatctgcaggaccggttttgcgatgccaataatgtgtatctggtgtgtctgagcagaacgcgcggagttgtcacaaaggcatacggttctaaggaggaactggcgtacattcacggactgaccggagtggaacggcatatgacgctcatgaaccggcttttagatgacggaatcgaaagtgtgctcgaagaggattgtggaaatgatctggtgaaaatgtgcggcgtgtccatcaagatcggcgggaagacggcggcaatctggatcgtcatcggaattatggatcgggaaggcggggatgttccatcttatgtcatgcgcacgacgccggaacggtatgataagtcactggaatttctggagacattgtccaagcagatgttcgccgtgaagatggaagaactgatggcacaggaggcggtgttaaagagccgcgagtctgagacgcagatggaagcggaacttcacaggaatgaggtgatgacttccatcgtaaagatgttagagtcggaaaacagctttgaggagatcgtgcacgacattctgcgggaatgctgcgcgtatatggagatttcgcgcggtgcgctcttaaaagagaacaaagagcactcgaagatcgagatgatctgtgaatatgcggcgcccggaatggactcagtgcgtggggaatggtccggcgtgtcgcgtgagaagatgcccttttttaacggaaaaccgtatatgatttcttcaaacagtatgatgccggaggtgttccggcagttttttgatgcgcacgggcttttggcaggcatttttctgccggtcgaggtcaataccagggcggagatgtacctgtgctttttggaagaacacgaggagcggaactgggaagtgacggacgtcaagttcgtcaacgatgtcagacggattattcagagtattcttctgaagcgtattgcaaaaaattcgttggcgagttcgtatgcgtcccttgaggcgattttagagaacgtgggctgcggaatctatgtgaaggatccggtcagtggaaggattctctacagcaaccagcggctgcgcgcatttctgccggacgatgccgcgccggacatgttggagaactgctggcgggaagaatcgggcggcattgatacggactgcttccacgagatctatctggagcaggaaaaacgctggtttgactatcaccggacaggaatccactgggtcgacggaagaagtgtatttttgtataccatctatgaggtgacggacaaaaagctgtatcagcagaagatcgaacggcaggcaaacaacgattttttgaccgggctttacaaccgtatgcggtttgagcaggatcttgcgcactgcattgaacagacaaaggagttcggcggcgaaggagcgctgctctacatcgatctcgatgattttaagcatatcaacgacggactgggacaccagtacggggatatcctgttaaaaaatatatcggacagcctgcgtcggattccgggtgtggaaaataactgttaccgcatgggcggagatgagtttatcattattcttgcacatcggcagatcatgatgctgcagaagattctgaacgacatccgcacgctgttttccaagccgtggatgcttaagggggcggattactactgtacgatgagtatgggcgttgtgcgttttccgacagagggcgacacggtggaggagctgatcaagaaggcggatattgcgctttacgccgcaaaatgttccggcaagaaccgtgtggagttctacgatgagaacgtggagtccacatcgttccgccgcctcgatatggaaaaaaatatgcgcaatgcgaccaacaatgcattttccgagtttgaggtggtctatcagccgatcgtggatgtgaccagggaatccaatccgtgcgtgggtgcggaggcgttgatccgctggaattccggggaactgggattgattgctccgacggattttataccgctggcggagtatctggggctgattaacccgatcggtgcgtatgtcctcgaggaggcgtgcaagcggtgcaaatactggaacgatatggggcatccggattacaaggtaaatgtcaatctctccgtggtgcagctgctgcagaatgacattgtagagcaggtgcgctcggtcatcaaacggacggggattgtaccggagaatctgaccctggaggtcacggaggggctggcgatcaacgatatgagccggatgaagaagattctttccgagattcgcgcacttggcgtgcgtgtggcgctggatgatttcgggacggggtattcctcacttaatcatatccgggaaatgccgatcgacgtcatcaagattgaccgctgttttatcattgacatcgggaaggatgaattttccgccgccttcgtgaaaatggtggcggaacttgcccagacgatcggcgttcatgtctgtgtggagggcgtcgagacgaaagaacaggttgatgcgctcaagcagacgaaaatccagttgattcagggattttactttggaaagccgctgcataaagaggagtttgacgagaaatatctgtagttgcacgaattgtttgaacaatttatttaaaattttttgaaaaaagcattgacattttaaaatacgtttgttattattatcaagtcgtcacgatgagtgaccgaaatgcggaagtgtcggaactggcagacgagcaagactaaggatcttgtgttcattgcgaacgtgtgggttcaagtcccatcttccgcattacatcacaaatattcgtggagattatgcaggagtggcggaattggcagacgcgcaggcttcaggtgcctgtggtagcaatatcgtgtgggttcaagtcccatctcctgcattttttatttgcgggaagccttgagagtgaaggcttcccgttttttcatttcctgtattctatatactgcaaaattaattcggcagctttctcgataccgattttccctgtatcaatacaaaggtcatactcgttgccgtcgccccagcgggttgccgtgcactgttcctgaaatgcagaacgcttttcatctacttcccgcaatgtctccgcagcctctttttcagatacgtggtcgcgctcctggattctctttttccgtatgtccggatcggcgtggagataaacggacacacagtccgggtcatccttgtagattatgtttgcgcatctgccgatgataatacaggattcctgctccgtgacatcctttacaaaacggatatatcgttcacgcggatttttggaaccgtagctcatgataagactgtaaagaaaactgtcgatcggtttctcgttcagaaaatttgcgttttcatcatagacgtttcttcttttagactcttcgataaatctttttttgtcaaaaatctccatacccagtttttcggacagaatgtcggcgactttgtgcccgccgcttccacactgtcttgcgattgttattttcatgcttattgacctgcctttctcattttataataaattaaaaataaaaatctgttgcaatgatagtgccgccgatcaggaaccggagaatccatatcgtgtagtaatcttttgcgatatcttccgggcagaacatcttcttcggctttttcggatggtagaaaatttcacattctgcgcttttggcttccgcatgcagcttcttattatacggatagatgctatgcacgttggtataatccgtgccgtccacctcataggcataatagtactgctccgtggtgtacgtggagtgatccgcgtcggtggttgtcgattcgtgaaatgttcttgtcgcttttgtctgccggtagtttgtcttgcgaagccagggggtgcccagctggcagtagagaacaaataccacaaacgaaaccggaaccgggatgttcagagaactgcccccgattaaaaaaagaaagccgagcagcagacctcttagaattccccacattggtctccaatataccgaaatcataataaggatgatgagcagaaataaaaccatggtaccacactccttgttcatttggtggttatagtatagcatttttagcgcaaggaaacatgattttttcaaactgtgtcgaaaaaaatagaggaaatccactccggacgcagaattatatatatggagtcactgcgtagtgcgtgacgaaaaagaggagataatacatgtcgatacgggaagaaatagagagaatggagtgcgagaccttaagtccgtacgccacgctcagcattcattctaagggcagagatgtgtatgaggagccgtgtgatatcagaccggtatttcagcgtgacagagaccgcatcctgcacagcaaggcgttccggcgtctcaagaacaaaacgcaggtgtttctgacgccgaagggcgatcattaccggacgaggctgtcccatacactcgaggtatcgcagaatgccagaacgatcgcaaaggcactgcgcctcaatgaggatctggtcgaggcgattgcgctcggacacgatatcgggcatacgccgtttggacatgccggcgagttcgtgttaaacgggctctgcgagaatggattccggcacaacgaacagagtgtgcgtatcgtggagaagctggagaaggatggaaaggggctgaatctcacatgggaagtgcgggacggtattttgaaccatcagtccagactgatgccgcatacgctcgagggaaagattgtgcgtttttcggataagattgcctatatcaaccacgatattgacgatgcgatccgtgcgctggtcttaacggaggacgatattccgcttgaactcagaaagacccttggtttttccaccaagcagcgcctcaatacgctgatacataacattatcatgaacagcagggagaaggatgacatcatgatgtcgccggagatcgaggaggcgatgatcgatctgcgcaagttcatgtttgagaacgtctacaagaaccctgtggcaaagggagaggaagtcaaggcgaaggcgatgatcgagcagctcttttacttttacaaggagcatctggatcagctcccggcaaaatatctgcgcatgatggacgagggcgagagcgcggagcgcgtggtcgcggactacatcgcaggaatgacggatcagtatgccatcaccaagttttcggagtactttttgcctcaggcctggcaggtggacggctattaagactgtgtcatgcctgaggcgtcccagggcctggcaggtggacggctattagaatggaaataaaaagcgggaagaaaggagcggaagatgccgcgttattcggatgaattgatagaagaagtgcgttcgcgcaacgatatcgtggacgtcatttcgcagtatgtgcggctgtcaaaaaagggcagtacctacttcgggctgtgccctttccataatgagaagaccggttctttttcggtctctcccaataaacagatgtactattgttttggctgccacgcgggaggcaatgtttttaccttcctgatgcagtacgagaattacacgttcggggaagcgatggaagcgcttgctgagcgggcgggcgtcgaccttccgaagcaggaatatacggcagcgcagcggcaggaggcggatcggcgggcgcgtcttttggagatcaacaaggaggcggcaaagtattttttcgtgctgcttcgcggggagcgcggaaaacgtgcgcttgattattttaaaaagagggcgttgtccgatgagacgatccacaagttcgggctgggatattcggatcagtacagcgatgatctgtaccggtatctgcggtcgaagggctatgacgacgagatcttaaaggattccggtcttgtcacgatcgatgaggtgcggggcggacatgataagttctggaaccgtgccatgtttccgatcatggatgtgcacaataaggtgatcggatttggcgggcgcgtcatgggagatggagagccaaagtatctcaattcccccgagacgaagattttcgacaagagccgcaatctttacggactcaatttcgcacgggcgacaaaaaagccgcagctgctcttgtgcgagggatatatggatgtgattgcactgcaccaggcagggtttgacaatgccgtggcgtcgctcggtacggcgctcacaagcggtcatgccaatctgctcaagcgctataccaaggaagtctatctgacgtatgacagcgacggggcggggatcaaggcggcgctcagggccatcccgattttaaaagaagtcggaatcacgaccaagatcatcaacatgaagccgtataaggatcccgatgagtttatcaaggcgcttggcgcggaggcgtatcaggagcgcatcgaccaggcggagaacagttttctgtttgaggtgcgcatggaagagcagcagcacgacatgcacgatccggagggcaagacggccttttacaatgcggtcgcgaagatgctttgcggatttacggagaagttagagcgcgataattatatcgaggcggttgcagccaaatacatgatctcgtcggacgatttgagaaggctggtcaaccagcagggattaaaggccggacttgccggaggaggcagggcgtcgcagagcgtcgcggacgcacaggacggtgcgcgcacagaatacaaaaagagtgcgaaaaagcgcgaggacggcatggtgcagtcgcagaagcttctgctgacgtggctgacgaacagtccggcgttgtttccaaaggtgcaaagatatgttggtgcagatgattttacggatccgatctgccacagtgtggcaaaaatgctgtttgaacagtatgagaaggacgggacagtcaatcctgcgcggatcatcagcacctacgaggatgaggagcagcagcgggaggcagcgggaatcttaaacgcgacaatccaccgggtggataccagggaggaacgcgaaaaagcgctgcgcgagaccgtgatccgcgtgcgggagaacagcatcaatcataagctggcaaacacgtttgacgttcaggagatggcggctctggcaaaagaaaagaatgagctgccgggaacggttcatattccgctggaggaatgagagcgggcaaagaagcaggaatgtggatgaaaatctgcatttaaggacaaaatagtaacgaactatgagaggatgaagcgaaaatggcaaaaaagaaagaaaacaccgacaataaggaagttctgggagaaaacaaggagaactctgctgcaaaaactgccgatgcgggagcagagaacggggtggcaagtgcccaggagaagttccagataaagttaagagaactgcttgcgctggcaaaaaagaagaaaaacatgctggagtatcaggagatcagcgacttcttttccgacatgcagctggatgcagagcagtttgagaagattcttgatttccttgaggcaaacaacatcgacgtgcttcgtattacggatgacgacgttgacgatgagatgcttcttgacgtcgatgatgaggatgagattgaggtcgagaagattgatctttccgttccggacggtgtctccattgaagatccggtgcgtatgtatttaaaagagatcggaaaagtgccgcttctgtccgcggaggaggagattgagctggcaaagcgtatggaactcggcgatcaggaggcgaaaaagagactggcagaggccaatcttcgtctggttgtcagcattgcaaagcgctatgtcggtcgtggaatgttgtttctggatctgattcaggagggaaatttaggactgatcaaggcggtggaaaagtttgattaccgcaagggatataagttctccacctacgcgacatggtggatccgtcaggcaatcacgagagccattgcagatcaggcgagaaccatccgtattccggtgcatatggtcgagacgatcaacaagctgatccgtgtcagcagacagttactgcaggagctgggacgcgaacctactccggaggagatcgctgcggagatgaacatgccggtggagcgtgtgcgtgagatcttaaagatttcgcaggagccggtatccttagagactccgatcggtgaggaggaggacagccatctcggtgattttatccaggacgacaacgttccggtaccggcggatgcagcggcatttaccctgttaaaagaacagttggaggaagtgctcggaacgctgacggagcgtgagcagaaggtgctgacactgcgttttggactggaggacggacgtgcaagaacacttgaggaagtcggaaaagagttcaatgtcacacgtgagcgtatccgtcagatcgaggcgaaggcgctgcgcaagctgcgtcatccgagcagaagccgcaaattaaaggattatctggagtaatctatggtaaaaatatcagaacgtttaagaacggcggcgggactcatcggagagggagagcggctggcggatgtgggaaccgaccacgggtatgtaccgatttatctggtggaacgaaagcacatccccagtgcgattgcgatggatatcaggacgggaccgctggagcgtgccagggaacacatccggatgtacggcatggaagactacatacagacacgtctgtcggacggcgttgcggcgttaaagccggatgaggtggacaccatcctggttgcggggatgggcggcggactggtcatgcatattctggagagcgggcgagccatctgtgagcaggcacatgggctggttttgcagccgcagtcagagcttccgaaggtgcggcgttttctgatggagaacggttatgtcacggagagggaagagatggtcatggaggaggggaaatattaccctatgatgcgtgttcactttgatgcttccgcagtctctcatgcagacagctttacagaagagcaggaactggaattccgctatggaaagcagcttcttacagaaaaacatccggtgcttctggcgtatcttcgctgggaagtgcagatccagcaggatattttaacacagttatccggtcagccggcgacggagcagattgcagcccggattgacgacgtaaaacagatcctcgcgcagaacgccagggcgcttgcgtattatgaatgacaaaaagccttgaagaaaaggcagagggggagagattcgtatggggaaagatatggtcagcttgacaattgaaggggaagtaagacaatatccggcgggaaccagtttccttgcaatttcgcaggaataccaggaaaaatatccggatgacatcgtgcttgtggtgtataataaccggctgcgggaattgaataagacggcacagcgggacggaacgctttcgtttgtgacaacagccgataagacgggaaaaaagacataccgcagaagcgtcacgcttctgatgcagaaggcggtctacaatctctggggaagcgaacatatcagcgtccgtgtactctattccatcggtcagggatattactgcgagctgcgtgaaaaggcagacggacaggagcgcgtgattgcggtggacgaagagcgcgccatagcgctgaaaaaggagatgtaccgtctggtgacggaggatatcgagattgagaagcgcagcatgaacacagatgatgcaattgcactgttccatgacctcgggatggaggataaggaaaagctttttaaataccgccgcagttccagagttaatatctatgtgcttgatcactataaggactatttttacggattcatggtgccgtctacgggctatctccgctactacgatattgtgacgtatgaggatggatttgtacttctgttcccgaatgagaatacaagagaagtggcagagtttgcaccttccgggaagctgttccacacgctgaaggcttcgcgtgagtgggggcgcatgctagagatcggcacgatcggcgcgcttaatgacgcgattgcggaaggacgcatgcaggaaattattctgacgcaggaggcactgtttgaggaacggatcggtcatctggcagatacgattgtaaagtcgggaggcaaaaagtttatcatgattgccggaccgtcttcctccggaaagaccaccttttcacaccgcctttctatccagcttgctgcgaagggattaaagccgcatccgttccctctcgatgattattatgcgaacagggatcagtgcccgcgcgatgagaacggggaactcgatctggaatgtctggaagcgctggatgtggagctgtttaaccacgacatgaatgaactgcttgcgggcaagcgcgtcaatctgccggtcttcaattttaagaccggcaagcgggaatacaaggaccgctacatgcaacttggaaaagaggacgtactggtcatcgagggaatccacggactcaacgacaggctgtcctgctcgctcccggtggagagcaagttcaaaatctacatcagtgcgctgacccagctcaacatcgacgagcacaactgcctgccaacaacggacggcagaatgatccgccggattgtgagagatgcgcgcacgagaggaacttccgcaaaggagaccattgccatgtgggattcggtgcgccgcggtgaggagcgctacattttcccgttccaggagggggcggacgtgatgtttaactcggcgctgatctatgaactggcagtgttaaagatgtatgccgagccgctgctgtttgccattgacaaggattgtccggaatatctggaggcaaagcgcctgctcaagtttctggattatttccttccgatgccgagcgacggtatcagccagaattcgattatccgcgaattcatcggcggttcctgcttcaatgtataggattgctttgacattttgcggaaagcacattataataagcaatagttgcggtgataagtagaacaaatgatcgcggcccagcattgctggggtgaggaaagtccgggcttcacagggcaggatgccggataacgtccggtggaggcgactccaaggatagtgcaacagaaatataccgccggttccggtaatgccggaatacggtaagggtggaagggcagtgtaagagactaccgccgcgctggtaacagagcgggcatatgtaaaccccatccgaagcaagaccgaacaaaagcgttgacgcggcccgccagctttaggtaggttgcttgaggtggctggcaacagtcatcctagatagatgatcattccgactgtggcttgccacggtttagacataacccggcttatcgttctgcttatcattgtcacatagaagtatctgagagtcgcgcagcggctctttttatttcatagggaataccgtgatacattaatgtgtgaaagtagaaccttcctagaaataaaaaacgctctgcggggatgcattgcatttccctatgaagcaataagaaggagtttttctatgaacggcataaaactttttaatgatcttatggaatatgcggatggcaaaggtgcatcggatgtacaccttgtcccgggaagaacggcgatgcttcggattgacggagaactgactgccgcagggcaggaggacgccgcagaatggcaggatgcggatcttacagaggtgacggagcagatcttgtccggggatcagctggaagagtaccgcacgaaaggcgcgctggtatgcagctattcattttccaaagcgctgcgtctgcgcgtgtccgtatacagacagcagggaagagatgccatgtccgtaagactgcatccgaccggggttcctgccccggagaaacttctgttaccggaggagattacggagcttgtgaaaaacgggcgcgggctgcttcttgtcacgggaggcagaggaagcggagtgacgacgacggtggcatcacttgccgcacagattgccgcaacacagtcaaaggtcattgtctctgtggaggatacgacagaatacatccttccgcagggaaggggactggttgtgcagcgggagatcggagcggactgcgcttccagggaggaagcccttgcgatggcgctgcagcaggatgccgatgtgatccttctggatggaatcgggaatgagcgggaggccgggcttttgtttgcagcagtcaggagagggcagtttgtgattctggcagagaaggaggacagtgtgacggcggcattgctccatctggtacagtgcggcgggagcacatccggttcgcagatccttctggaaagtctggcgcagggactggcgggggctatggcgcagaagctgctgcggcggcaggatgaagccgggcgcgtggctgcctatgaggttctggtggcggatgccggggtgcgcagtctgattgcggagaaccggatacagcagctggatacgtccgccggagcagagaaggagcgtggcagagtgcagatggatgatgcgatttacaatctttatatgaagagctgcattacgtccgagacggcgatcgcaggagcaaaagatccggaggatatgaggagaaaggtgcgcctgttttgacaggcagcctgaaatctaatcaaagtctaaaatgtttctaaaaagacgataggaaggttgacagtctattttgcagggcttaacatgatctcatgatccggaaaggaaggaatggatatgagagaaaaactgcagcgttttatgactggacggtatggagcggatgagcttgggagaaccttgaacatcgtggtattggtgagtctggttgtgtcgatgtttagcgggcttctgccggtgctttccattttttactggtttggaattgcgctgatgatttataattgtttccgtatgttttcaaagaacgtctcgaagcgttacgaggagaatcagcggtatctgagcaggcgctacaaagcagttgtgaagcgggatcagtggaagaagcgcttcgcacagagagatacctaccgctttttcaagtgtcctggatgcaggcagagagtgcgggtgccgaagggaagaggcaaaatctgtattacctgcccgaagtgcaggagagaattcatcagaagaagctgatctggcagggcaaaggagaacttggaatgttcggttacataaatatcaatcagaagatcatgacagaggagaaccggaaggcatatcaggcatattactgcggactgtgccagagactcaaatccaactgtggtgcaaaaggacagatgctgctcaactatgatatgacatttctgatcgttcttctgacgggcttgtatgagcttacgaatgaatcctccgagattacctgcgcgctgcatccgaccaggaagcggcaggtgtggatcaatgaggcgacagattatgcggcggatatgaatctgattgtagcctatcataatctgattgacgactggaaggacgagaaagcctatacgaagaaggcgtttgcaaagatgctggataaggactatgcgcgcgtgatagagaagtatccgcgccaggttcacgcagtggaagagttcatgcgaaaaacagacgaggtggaggcaagaggcgagacgaaccttgatgtggtggcaggtctgaccggagagatgctgggtgagattttctgctggagagaggatgagtggcaggaagagctgcgcacacttggcttttacatgggaaagttcatctacattatggatgcctatgaggattacgatgaggatcgcaggaaaaaggagtacaatccactcgtctatgcgatgcgggagagtgcggatgacatggatacgctctgccgtctgctgctcacgagcatgatgtccgagtgcgccaagtcgtttgagcgccttccgattttattacatgcggatatactgcggaatgtgctgtattccggcgtatggtcaaaatacgagtatcttcagctgaaaaaacgcaaggcggaagagaagaataagaaaaaagcgcgcaaatagcgaggttacacatatatgacagatccatatcaggtgctcggcgtatcgcggggagcctcagatgaagagataaaaaaggcatacagagcactcagcagaaaataccatccagatgcgaatgtgaacaatccgaacagggatgaggctgaggagcattttaaggaagtacagcaggcatatgaccagatcatgaaggagaagcagcagggcggtggatacggttatggcggcggctacagcagcaattccggcggttacagttacgccggcagccatggattcggtcagaatgaatcgccgaagatgcaggcggctgcaaattatattgcaagcagacactatgtggaggcgttgaatgtgctgaacggaattccgtttggggaacgccgggcgcgctggtactatttcagcgcgattgccaatcagggcatgggcaataacatcaacgcgatggaacacgcaaagcgtgcggtggagatggagccgagcaatatggaataccggcagtttttacagcatcttcagtatggcggcacatggtataccagcatgggaagtgactacgacagaccgtatgcgagcgcagggaactggtgcttaagcctgctctgtctggatctcctctgcaactgttgctgtttccggccgttttagcggaagttttccgcctgacgggcggatatagatggagagaaatgtgtattctattataatagaagaaagtgatgcgggaatcctccggaggacatggaaccttcggaggattttttgctatttataaacaaactataaaatcacaaataaaacacaacttttatgaaaaatcctgttgacaaagaaataggttggtgctatcttaagtacgtaaggtgttagcactccatagcaacgagtgctaataagacaaaaggaactgcaggaaaagcagcaggagaccagcgatggacgagatggaattagatgaacgtaaaataaaaattttagatgcgatcatccgcaattatctggagacaggcgagccggttgggtcgagaaccatttcaaagtatacagatctgaatctgagttctgcgactatccgcaacgagatggcagacctggaggaactgggttatatcctgcagccgcatacttccgcaggacgtattccttccgataaggggtatcggttttatgtagatcacctgatggaagagaagaaccgtgaggtagatgacatgaagaagttcgtcattgaacacacggaaaaagtagatcaggttcttcagcaggtggcaaagatgctggcggcaaataccaactatgcgacgatggtgtcggcaccgagctaccaccgcaacaaggtaaagttcatacagctttccaatgtgaatgaagaacagatactggcagtgattgtcacggagggcaatctggtcaagaacaagattattccagtatccgagccgatcgacaatgagacgatgctgaagttaaatattctgctgaactcgaatctcaacggtcttgccttgcaggatatcaatctcggcacgatcgccaagttgaaggagcaggcgggaatccacagcgacatcatcagtgatgtgctggataccgtggcagagacgatgggacaggatgaggatatccggatctatacgagcgggacaacgaacctgttcaaatacccggagttaagtgattccacagaaaaagcgagtgaactgatctccacatttgaggagaagcagcagcttgcatcacttgttactgagaacctgttggaagataagagcacagggattcaggtttatataggaaatgaaagcccgattcagacgatgaaggactgcagcgtggttacagcaacctatgaattgggagaagggattcgcggaaccatcggtattgtaggaccgaagcgaatggattatgagaaagtcatggataacctgaaggtattgaagaattctctcgatggaattttggacagaccaaaaggggagacatagatggaggattggaatggcagagaaaaaagaagaaatgatggaagaagtattagaggatcttgaaaaagatgccgcagagaagcaggcagaagaggtaagcgaggcggaggagacagagactgaaacagaagcagctgaatccggcgagcaggcagaagagacagaggaatctgaggcagaggacggacaggaagcgcctgccgatgagaagaagggattctttaagaaaaagaaagataaaaaagacgaacagatcgaggaactgaatgataaattaaaacgtcagatggcagaattcgacaacttccgtaagcgcacagagaaagaaaaaacacagatgtacgatatgggagcaaaaagtatcattgagaagatccttccagtgattgacaattttgagagaggactggcagcagtaccggaggagcagcgagaagatgcgtttgtcgtcgggatggataaagtatacagacagatgcttaccgagcttgatgcaagcggagtaaagccgatcgaggcagtcggtcaggaatttgatccgaacttccacaatgcagtgatgcaggtggaaagcgaggagtacgattccggagtggtcgcacaggagttacagaagggttatatgtataaggattctgttgtgcgccacagcatggttgcagtggtatcatagcagccgttttatcagtcagacgtgccggcatcgtaagatgtccgcgttaatataaatgcagcaaaagtaacaaatttgtttttagaatatgatgaggaggaatctatcatgggaaaaattatcggaattgatttaggaacaacaaacagctgtgtagcagtgatggaaggtggaaaacctaccgttatcgccaaccaggaaggcgcaagaacaacaccgtctatcgtagcatttacgaagaccggtgagagactcgtcggtgagccggcaaagcgtcaggcagtcaccaacgcagagaagacaatctcttccattaagagacatatgggaaccgattacaaggtagcaatcgatgacaaacagtattctccgcagcagatttccgcaatgattctgcagaagttaaaggcagatgcggaaggatacctcggagagaaagtaacagaagcagtcatcacggttccggcttacttcaacgacgcacagcgtcaggcaaccaaggatgcaggtaagatcgcaggactggatgtaaagcgtatcatcaacgagccgacagcagcagcacttgcttacggtcttgacaatgagaaagagcagaagatcatggtatacgatctcggcggtggtacattcgatgtatctattatcgagatcggtgatggtgtcatcgaggtactttctacaaacggtgatacacaccttggcggtgatgacttcgataacagagtgacacagtggatgatcgatgagttcaagaaggcagagggcgtagacttatccacagataagatggcacttcagagattaaaggaagcagctgagaaggcaaagaaagagctttcttccgcaaccacaaccaacatcaaccttccgttcatcacagcaactgctgagggaccgaagcattttgatatgaacctgaccagagcaaagttcgacgaactgacacatgatctggtagagaagaccgcaatcccggttcagaatgcaatgagagatgccggactgaccaacgctgatctgggtcaggtattgttagtaggtggatcgacacgtatcccggctgtacaggataaggtaagacagctcacaggcaaagagccgagcaaatcattaaacccggatgagtgtgtagccatcggtgcttccattcagggtggtaagcttgcaggcgatgccggtgcgggtgagattttacttctggatgtaacaccgctgtcactgtccatcgagaccatgggtggtattgcaacaagactgatcgagagaaatacgactatcccgaccaagaagagccagatcttctccaccgcagcagacaaccagaccgctgtagacatcaacgttgtacagggtgagagacagtttgcaagagataacaagtcccttggccagttccgtctggatggtatcccgccagcacgtcgtggtgtaccgcagatcgaggttacattcgatatcgatgcaaacggtattgtaaacgtatccgcaaaggatctgggaacaggcaaagagcagcatattacaatcacagctggttctaatatgtctgatgatgagatcgataaggcagtcagagaggcagctgagtacgaggcacaggataagaagagaaaagaagcaatcgatgcaagaaatgatgcagattccttcgtattccagacacagcaggcactggatcaggttggcgcaaacctggatgcagccgataagtcggaagtagagaacgacatgaatgcagtgaagtcattcctggatgcacatcagaatgcagaagagatgacagaggcggatgtgacagagttaaaatccttgcaggagaagctgacacagagtgcacagaaggtatttgcaaagatgtatgagcagacacaggcagcacagggtgcagcaggcgcaggtcctgatatgggcaatatgggcggtgcaggaagcacaggaagcacaggcgctgcaaacgacgatgttgtagatgcggacttcaaggaagtataatctgacagaagttgcggcatttacaaagaagccagagtgtgttacgatatttcaacgcagtgtataaaacatggggtttctggatggtgacatctggaaaccccgtgtgcagtagagaggaatagaggaaaagttatggcggataagagagattattatgaggtcttgggcgtaagcaagaccgcatcggacgatgagatcaagaaagcattccgtactcttgccaaaaagtatcatcccgacatgcaccctggggataaagagtgtgaagaaaagttcaaggaagcacaggaagcctatgcagtgctttccgatgcagagaagagaaagcagtacgatcagtttggtcatgcggcatttgacggcaccggcggcggagcaggtggattcgatttctccggcatggatatgggagatatcttcggcgatcttttcggcgatttctttggcggtggttccagaagaagaacaaatgatggtcctatgaagggctccaacttaagaaccagtgtccgcatcacatttgaggaggcaatcttcggatgtgagaaagagattgagatggtgttaaaggatgagtgccatacctgccatggaacaggtgcaaagccggggacaacgccggagacctgtccgaagtgtggcggtaagggaaaggttgtatttacacagcagtctttctttggcacggtgcagaatgtgcagacctgtccggactgtggcggttccggaaagatcatcaaagacaagtgcccggattgccggggtaccggatacattgcaagcaagaaaaagattcaggtgtcgattccggcaggtatcgacaacggacagagcgtccgtatccgggagaagggcgagccgggaatcaacggcggaccgagaggcgatctgctcgtagaggttgtcgtatcgagacatccgaccctgcagcggcaggatatgaatatttattccaccgcacagatttcctttgcccaggcagcacttggcggagagatccgtattcatacggtggacggagatgtgctgtatgaagtgaagcctggaacacagacgaacacaagaattcgtctgaaaggaaaaggtgtgccgtcgctccgcaacaaatcggttcgcggcgatcactatgtggatctggtggtacagacgccgaccgggctttccgcagacgcaaaggaggcgttacgtcagtttgatgcgctgacgggtgattccttaaaccgaaccggcgcccaggacggggcaggttcttccgataagcaggagaagcctaagaaaaagaagggattcatggataagatcaaagaatccctggacgatatttaaatcaaattataaaaaacaaagggtgtaaagtctttattgagagattgagacgttacaccctttttctttgataagattttattccggatagatgagatgcgctgcatcaatgtgatacagagtattctccagataacgattcgcaagataattcgccatgccaagattcatatccagatagtttccgcagtcctttggtgcggcaccaggtacatcgccccgaaaatcccggataaattcaaacatttcaatcattaacggaacgatgtccttcgactcgtaatccccggcaaggagaagatagaagccggtgcggcatcccattggtccaaagtagacggtcttatcggagaagtccttgtgattccgcaggaaggtagcacccagatgctcgatcgtgtgcacttctgccgtgttcatgaccggttcgtcgttcggtgaggtcatgcgaagatcgaatgtagtgatgacttccgctccgacatgatcctttctggacacatagacacccggctgtaatttgatgtggtctatggtaaagctggcaattttttccatataaaaatcctcctgtctgtatctactaaaaccttaaaacagaaagcggtatccgtcaagaaaaaaatacgtcccttgacatcgggaagtttaacaacgtatagtagatacaacagaaatgagaatgtgctagaagaaaagacagaaatgaggaaaacatgccaaattacgatttcaaaaaacagccggtgcttctgattcagggagcgatggacacggagacggagtatctgatcggacagcttgacgaaccggaggagataacctgcggcaactggaaattctatacgggattcctggggaagcacgcggagccggtcgttatctcgcgcacctatcaggggatggtgaatgcggcggcggcaaccgccattgccatgacacagttctgcctgtgggcggtgattaacctggggattggcggaggtcatgatgcgcgattccatcggggagacatcgtggtgggggagcgcgtggttccgatgggagccatgatccggaaatacgcgcccgagggagccggaatcgatgagtgtgattttgagccgctgccgattgaaattttcgataaaacacttggacagacaaggaaagtactcgatttcccgtgtgatgagaggcttggggatgcggcgatgaaggtacagacggatgtttatgtgggcagaggagtgatcggctcggcggatgagtggaacaaccagctggaccggatcgcactgctaagagagcggtataagactgcggtagaagatatggaatccgcagctccggcagagctttgcctggcgtatggcataccgtttctgggaatccgcattatctccaactcgatcgttacgggagagagctttgaggaagcggtaggcgtggatgtgcagaaatttgcggtatcctttgtggagcggctgcatggtatgagggaggaacaagagtgaccggaagatacagacgcgtggcggcgctgatctgctttgtttgctgtgtgctgtgcagtaccttgagcgtgacggcggcagtggcggatcaggagaaaaggcatgtaatcaaagtcgggtatatcgattacgacggatttatcactgaagaaaaggacggaacctacacgggctacggtgtggaatacctgcgcaaaattgcagaatataccggctgggagtatgaattcgagtatgacagctgggatcagcagttaaaaaaacttgagaccggtgagatcgatatgatctgccaggcgcagcgaacaaaagagcgggagaagcagtatcttttttcggactatgccatcggggcggagacgagtgttctgtacgtgagtaaagagaacgatatttactactacaatgactatgccgcctataacggcatgcgcgtaggtatgcttagggacagcttccagaatcaggaattcagggactatgccgccgaaaagggattttcctacgaggagagcatctatgacacgcaggaggcatgttttggtgcgctcgatcgcggcgagattgacgcggttgccatgggaagtcttgcactcaagacggattacaagatcatctgccgcttcggttccgatccgttctatattatgactgggaggcagaacaaggaactgcttgccgaggtaaacgaggcgctcgggcagattgccgaggcaggagcttcgtttcagacggatctctatcagaaatattacggggagaaggaggcggagggagaggtcgtctttaccagagaggaagcagaatacattcaagggtcaggtgtgattacggtggcgtttattgcttcaagagcaccgttgtcctaccggaacgcggaaggaaatatcgacggtattacagttgacattctggatctgctgtcagagcgcagcggtctgacatttcagtatgtgatgatgccgcaggggatgcgcacggcggactatctctcaaaatatccggacagtctggttgcaggggtgctctcggacaatcctgatttccagaaggagccctatattctgacggacagcttttatacggatgacgtcgcactggtcggaagaaacggacaggaatatgatgtggatgcggacgatgtttcataccgtctggcaattccggcaagctatgtcgggctggaacattatatccagatgaatgcaccacagtttgagatctgtgaggagaagaacttagaagactgtctggccatggttttggacggaaaagcagattttgcggcgcagaatgtcagcgtgctgacgccgtatctggcaaatccctattatgaggaacttactgctgtcccgactttttttatggaggaaaatacgggaatcgtcgggttggacagcgaggaacaccgcatgctgataaagattttgaacaagtgcattgggatgatatcagaaaaagagattgcccagtttaaggtggatcacacgctggcaaccgcctatgagccgacactctccgatatggtgtacaagtttcgttatccgatagccgtgatcggcatccttctgctgcagattgtcgcatggatggttgcatttgaacttttgagacgcagaaattaccacaagctggaagagaaaaacgagcagctcgctgtggcggtggcacaggccaacagtgccaatgaggcaaagggacagttccttgcgcggatgagccatgagattcgtacgccgatcaatgccattgtggggctgactgagatcgcaagacaccgcagcgatgaagggggaggggtagaagagtgtctggataagatcgatacctcatccaaagtgctgcttgcgattgtaaatgacgtacttgatatgtctgcgatcgagagcaacaggattaaaattgcgcaggcaccgttttccttaaaagaggtgttggattcaatttcagcagtatatggaacgcagtgtgagcagaaaaagattgcctttaccgtggagatggacgaggtacaggtggagcaggtccaaggcgatgtgctgcgcctcaatcaggtattgctgaatctgatttccaacgcctataagtttacgccagagggcgggagtatccgcgtgacggtcagcgaactgccaatgcagcaggaacagttcttctataaatttgtggtgacggataccggcgagggaatgagcgaggaaatgcaggagcggctgttcctgccgtttgagcaggaggaggccgagacggcacagcatcacggcggaagcggactcggactttctatcgccaaaaatctggtggaactgatgggtggatcgatctcctgccagtcgaagaagggtgtcggaacaacctttacagtatccctgccgctggcacacgcagtggatgagaaaaagcaaaaagcagaagagacgggggaaggtgaagcagaagaagaagaagatgcgtcagagtcttatgattttggcggcagacggattcttcttgcggaagataccgagatgaacgcggagattgtcacggagctgctggagcttgtgaacatgcatgtggatcatgcgtggaacggtgaggaagcagtggagcggtatatggaatcagcaccgggaacctatatggcagtcctgatggatgtccagatgccgggaatgaatggctatgaagcggcgaaagcgatccgcgcacagaagagcagccgcccggatgccggggagataccgatctatgcaatgactgcaaatgcatacaccgaggacatcagtgcggcgttgaatgcgggaatgaacggacatattgcaaagccggtggataccgccgcgttgtatcgtcttttgaagaagagcatggaggaaacgggatgagagagaagatttgcacattttccgggatacatatatcaccggcagatcctagaccggaagaaatctgtatcgaggatattgcacatgcgctgtcgttaatgacacgtgccaacgggcattttccggtattttattctgttgcgcagcatagcctggactgtgctgcaatggcgcaggccgaagggcgcagcagcagggaggttctggcgtgtctgctgcacgatgcgagcgaggcatatctgtcggatatcaccaggccggtgaagggctgtctgcccgaataccgcaggattgagcaggtgcttcaggagatgatctatgaaaaatacctgattgcgccgccgacggagcgggagcgcgagattgtaaagcgcatggatgatacctgcctgtattatgaatttgaacatttcacgggagaaaaattatttgatgtggcaccgcaggcggcggtgctgccggaataccgggagtgtccgatgcgggaagtggaaaaaaagttcctggcactgtttgagaaactgatggcgcaaacagtgcaggaagatggcgtgcgtacggatcagtagttgcttaagatcagtctgcgccggaaagaagtgtccagctggtcgatggtgcgtcttgcctgcccgtagcggttgcggttcgtgcggatcacatagatctggtgtgcaccgcggtatttttcccgaagaaaaaacggaaccttgatccagccccgggtaaaggggatctggttctcaatcagaagctgtgccgcctgattgctgatgcgttcattggtggtgcggcacagctccacgtctttgtcaatctggtgaatatcacctaaaatctttccttttgtcataaaaactcctccttcatgcttaacgaatcctgatctgaatctgcttcccgagactgtcggcaaccttaatcagaaaatcaaggctgggattgtaacggccgctctcaaaacgggatatattggatttcttggtgcctacgcgctctgcgagcacctcctgcgtcacattctgcgccttgcgcgcgctctttagctgttccacgacctcatagcgcggggtaagcgggctttgttccttcatgaatccctcaattctcctgaaaaatacaggtgttccgtaaaaaatcgtctgctataaagttatcatatatgataacttttgtcaatggaataagggagggggtgaggtgtgaaaagtgaaaaatgtggttgcaatatgaaggagggtatgatatgataaatcgtgcgtgagcgagacggagagatccgatcgcaagactgccggcgtggcggaatggcagacgcatcagactcaaaatctgacgggggcaacctcgtgccggttcaagtccggccgccggcattatattgaaaagagcatacaaaaggagctgtgaatatcattcacagctccttttgtatgctggatccgcagcgcatgttcaagaacttaaaatgcgtacggcataaatgcgtgtacggtgtatgtcagtgcctgtccgcggcggttatgcctggacaggaatctttttatcggaatagaggatatggttgatcagccatcccagcagaaattcgatcaggctctccatatatttttgcggattttcgtccagctcgatcaggttgatgctctcaagtctggcgacgaaggaagcgtgcgcatttttctgtgcggcaagcccctcataaccgatcttctccatgtaagcctcttcgtcggcaaagtgggttacggtataatccgtgagttcgtggatgatagataaaagctcatcgtagcacgtaatgacgtcgttggattttaccagctgataggcgcgctccacgatgcaaaagagctgctgatgctccaaatcaactatttcaatgccggtcagataatcgtctgtgaattcacacgggttgtcgcggatcatccattcctctaacggcggcagcttgccgatcatgatgtcgcttccgagaatatggtgatacagccatttggcaaggaaattcaaaagatcggtgacaacctgctgctgctttccggggtcatcgatgtctgcaaaggaaaaatcgcggattttgtcgcggaaaagagagtgctgcatgcgctgacggatcagctccggatcgcggatctgctccatgtaagcctcctcatgtgcaaaatgggtattggcatactgcgtcagctcctccagcagatgggtgatctgggtgcagcggtcgttggaatcggtatggttgagtatgtccatagcctgattgatcaatgagaacagacggcggtgctcgtcgtccagctccttgatcccgatcaggcagtcatctgtaaattggaacatggttttatcctccgtgaaatcatgtgttgtaaaagatagttttctgtgtgcttattatagcatcgtcacacgaaaaaagctacttttgcaatccaggttttttctctcccagaataaaataatcaatcatgcggttgatggtattctgctgtgtctgaataatttttttgaaattatcgttttcttttgctaagcggtccaattcgagattctcgttcataacagccaccttttccataaatttatcatacaagtgtaagcatagtcgaagaactttcggatgtcaatgaaagttgtttgaattgtgtgaatcaaagcggtctattaacaagatgtgtcaaaaaatgagtcatattcgacaaagtatgtggaaaactggaagaacatacggaagtgcttttgtgaattttttgcgaattaaataggaaaaacaaatgcagtgtgctaaaataagaaccaaaataatatgaggcagttaaaatgagtcagaaaaaaactttatcaaaatatacaaagtatgtgatgtggggaactgtggcattgattcctcccgccgcatttttttatttgctggaattttacacacacaatccgtttgcggaggtacgaccatgggcgcagctttttaacattgtattgtttgaactgctcgcggggatttttttgtgcatcaccggacggcttcggacggcataccggatcgagggtaccgcggcgctggtattcgggcttgccaatgcctatgtggtgcgtttccgcaccaacccgctggtaccgtgggacattctgtcctggaggacggcggtaagtgtgtccggcaattatgactttacaccggatacgcgtatgatcgttgtgacaattctgtttctggcgctgatcattggattgcagccggtgaagtttaaaattggcagacccggattttttaagcggtgcctgccgggcgtggtgcttggcgcggtgcttgtgatgtttgcgggaaccttgcagcaggagaatttccagaacgagcacaggctttacaataagctgtttacacccgtctttatgacacaggtggacggaataccggttacttttgtgatgaaccttgcgtatatgtcgattgagaaaccgcagaaatacagtgtgggcgaggcaaaggaatttttaaaaaaatacgaggaaccgcaggagacggaggagtcgatcgatacaatcctggaggaagagggaaaagatacctcggatgacacttcgcagagcggtgcagataccgggatgccgaatatcattgtcgtgatgaatgagtcgttttcggatctgtccgtgttaggagattttaagaccaatgaggactatatgccgtttctgcacagcctgcagcagggggcggaaaataccgtgaccggcatgttgaatgtctcggtgtgcggaggaaataccgcagatacggagtatgagttcctgaccgggaatacgatggcgttcctgccgcaggggagtatcccgtatcagcagtatgtgaacggagaacgcccgtcgctagcatcctatctgcagtcgctcgggtatgagacggtggcgacccatccctattatgcgaccggctggaaccgtgacaaggtctatccgtggctgggatttgagcagagtatttttaaagatcagtattacggggcacgttttgtcagagattatgtgagcgacgcaagctgtgcggacaaaatcatccagctgtatgagcagaaggaggagggcagaccgctgtttgtcttcaatgtgacgatgcagaaccacgggggatacgaccagacctacacgaacttctcaccgggtatttcggtggacggtgtgaacagtatatcagtcagccagtatttttcgctgataaagctgtcggatcaggcattagagcagctgatcgattatttttccggtgcagatgagaagacggtcatcgtctttttcggggatcatcagccgagcgatacggtggcggcaccgattcttgccatgaacggcatgcagtggaatgcgctggatgaggaacagcaaaagctgcgctaccaggtgccgtatgtcatctgggcgaattacgatattgatgaggaacagaatgcggacaccagcgcaaattatctgggagcagaggtgctaaagcgcgccggggtacccacggatgcctatcagaattttctgctgacattaaaggaatcatatccggtgatatcggcggtgcgtaccgtggaagcagacggaagtgagactccggcgaaggaagagcacggcgagatggatatttaccgcaaacttcagtattatttcatgtttgactgggaagaggagtctggagaatgaaaaaaagaggaccgttactggcagcgttttgcataccgcttctgatcacgctgatcatctgtgtgaaccgggaaatctatccgttcggggatcagtgtatgcttcatattgatatgtaccatcagtattgtccgttttttacagagctgatggaaaaactcaaaacgggaggcagtccgttctattcgtggaacatcgggctgggagcggattttgtatccctgtatgcgtactaccttgccagcccgttaaactggcttttgattctgtggccgaggggatatgtgattgaatttatgacggctctgtccatccttaagattgcactgagcggtcttacatttacctattatctgggagagcattttcttgtgtggcaggatgccggaaatgcggcggcagtcatacggacagagaagaagacggcagtgcggcttccggcagatgtggcatcctatgcggcggctgtatgcggcgcggcgtatgcgctgtgcgcgtttatggcggcatatgcctggaatctgatgtggacggactgcatggtgcttgcgccgcttgtgattctgggattagagcggctgatccgtgataacagaccagggctttattatgtgtcgctggcggtctgcattctgagcaattactatatttcgatcatgatctgcatttttctggtgctgtggtttttgctctactggatggaacaccgggcatcggggtaccgggcatggatccgctttgcgtggtattcgctgcttgcgggagccacaggcgcagtgctgatccttccgacggcaaaggtgctctccttaagcggtgcatccggaatatcgttcccggagacgatggagtggtattttaatatcgtatcggagctggcgcggtcccttctggcagtcgatgtatacacgggagattcccactggcccaatctgtactgcggaatttttgcgctctttctgctgtttctgtatgtgtggaacagagcggttccatggaagaaaaaactgccaaggctggcactcgtcgtgtttttctggcttagcttttcaaataatatgctggattttatctggcatggccttcatttcccgacatcgcttccgggaagacagtcttttttgtacgcgtttctggtacttgtgattgcctatgaggcgctgctttacatccgtgaattaaagctgtggcaggtgtttgcagcgggtggaatgagcgttgtattcctgcttttctgcaatcattttatggacgaaacgacgatggagcagacctccatatgggcaagcggggcattctttgcctgctattttgtgattgtactcggcatactcataggaaaaaagagaatccggcagctgatgctggcgaccgggtgtcttgcggttgtggcggagcttgtgatcaactataacctgacagggcttgacacgataagcaggacggattatgtgaaaaatctggcggattaccgggcggttctttcggagacggcggaaaaaagtgatgaagattccgtgttttaccggacggaggaactggagcgcaagaccaaaaatgatgcggcgctgtccggctatcactccggcacacagttctcatccctgatgaatctgaatgtcagccatttttatcaggatgtcggaatggagggcggcaagaacttttattgtgccggcggtgcgacaccgcttctttcggcaatgctttccatccgctatgtgcttgcggacaatgcgatggaggaaggaccgctccgcacacttgtggcgcagcgtggagacacgtatctgtatgagaatgcgtatgtgctgccgctgggattcatgatggatgaagatgtggcggaaaaatgggactatgccggcggaggcgacatcggcacacagaatcagctcgccaatcttctgggaagcgacagactgcttcttaccgcggtggaatccgaatcaaaggcgggagagagctcttttgtcgcgcaggattccgcatattattatgccacctacagcaagacgggcgttgacaatctgcaggagcaggtaagctcgggaagaaccagaggctttacaaaagtttcccacggatatattctggatttgggatattgtgaggcaggagaagaggtaaaagttactaacaccgccaatgagctggtgcagcttgtggtttaccggctggatctcatggcgcttcgtacggcctatgaggcgcttgccgcacagacggtggaagtgacggaagtttccgataccagggtaaagggaaacgtggacgtcacacaggcgggcagactgattttttccatcgcggatgaggatggctggacgctgtatgtggacggaaagaaaacggacagtgagacgtttggcagcgcttttatcagcacctatctgacggaaggcacacatgagtttgaactgcggtacaaaagccccggatttctgacgggagccgtaatatcggcggcagccgtggtgctctttgcggcgaccatggcagtgagaagaaagaggaaaaaaggatgaaatttgattttacaacgattatggatcgaaaaggaaaagacgcactggcagtagataagattccttacaaggacgtgcaggtgcaggaaggattttcggtgcttccgatgtgggtggcggatatgaattttgccacggtgccgtcggtacagaaggtgatgacagatcgtatcgcacatccggcatttgggtattttgagccaagagaggaatatttcgatgcaataatccgctggcatgcgaaaaggaatggcgtacaggggctgacgagagaatgcatcggctacgaaaacggggtgctcggcggtgtcttaagcgcactcaatgtgttctgttcgcggggagataaggtgctcgtgcattcgccgacctacatcggatttaccttcagcctgaaaaacaacgggtatgagatcgtgcacagtccgcttgtgctggatgagaatggtgtgtggcgcatggattatgaagacatggagaaaaaaatctgcgagaaccacattcatgcggcaattttctgctccccgcacaatccgtgcggcagggtgtgggagcgctgggagatcgagcgtgccatggaaatctatgagaagtatcaggtcgaggtggttgcggatgagatctggtcggatatcatcctcggggatcaccaattcgtgccgacgcagagcgtttccgagtatgccagaatgcacacggtggcaatgtacgcaccgtcaaaaacctttaatcttgcgggtctggtgggaagttatcatattatttacaatcccgttatccgtgaccgcgtgaaaaaggaatcatcgctgtcacattacaatgaaatgaacgtgctttccatgtatgcactcatcggtgcgtatcagcaagaaggctatgagtggacagatgaattatgtaaggtattgacgaagaatgcagaatatgcgtatgattatatcagatcccattttaagggcgtacaggtagctatgccacagggaacctacatgctgctcttagactgcacagagtggtgcagaaagcatggcataacgatcgatgagctgcagaagcggggcgccagcatcggtgtgatctggcaggatggcagaccgttccacagcccgtgcggcatccgcatgaatctggcgctgccattttcacttgtggaggaagcgatggagcgtctccggaagtatgtatttgtgtagaagttaagaaaatattgcagcgcgaacgaacagataaaagcaaaggagtcttgctatggaaaatcataagaccgatgaccggatggaagatctgatgcagaaagtgagagagggccgcggcacggatgcggcgtgcatgcttgactactgcacgcagattgaggaatacgcagaacgtgcgggggatgccaggctgcttgaattttcgcattattacaagggcagaacctactatcttagcaatgagaccggaaaggtgtttgaggagatcggcgaggcactcggatatctggaacagtccgggcagtgggaactggtggcagccgcctacaatcttatggcgattgtatccgtcggcaagggcaatctgtcgtttgcgatcgagtactatctggcaggattaaaatattgcaaaaaatatgagctgattgaggtggaaagccggattgagagtaacctgggttccctgcatatggagtgcggacagtacagtgatgccagagattatctggagcaggcacatctcgattacaagcgcgtaccggaaggggcgcgcagactggcaagtcttaccgcgatttacaacaatctggccctgtgttatatgaaaagcggcagcctggagaaggcagaggaatatatccgcaaactggaagcagagtgcgaagcgcattttgaggagatggattacatttatgtaaattgtatgcgtgcacgttactgtcatctgtgtggcaatatttccatgagagaccagtatattgcggatattcagaatcagctttctggggatgtactgattctggatctgtttgatgatctgtatgatttctgtgaactgatgttagagattgaccgcggtgatgtctgccgcaatatcggagaaaaactgaaggcactcgtggagcagaccggcatcgccaatatgcagcggaagatgacagcgctagagatggattatgttaagaaaacgaaggacagggaacgctatcttaagacggctggcagattctatgaactgaccgagatcgtggaacaggaaaacagaagcatgattgtcaatatgctttatctgcgcaaatccttagagcgggcaagagagcgctgcaggaagctggaggaggatgcggtggagctgacggaaaagtcggagagagatccgctgaccggactggcgaaccggtaccgcctgacaaatgattcagaaaagatcgtggaacagtgctttgcggaacataaaccgttgtcgtttgagattttggatattgattactttaagcagtacaacgaccgttacggacatcaggcgggggatgactgtgtgcgtgccatcgcggcactgatccggcagatggaaagtgatcagattttctgtgcgcgctacggcggagatgaattcgtcatcatttacagtggaatgagcgcggaggaagtctgcgagcgcgcggagaagctgcggcaggatgtgatggcgcttcaaatagaacagcgctatacagagggcgctttcggtgtgaccatctcgcagggcatctgccatgacatcccgagcaacgggaacaagaactgggattttctccacgtggcggatcagacgctctaccgtgtgaagaggcgggggagaaaccggctgtgtatgaccgatattcacgggcgtgagattgaggtgtaagggtatggtttgcctcggatgtggtacacatatagcatgcggtgccggggtatttatgtatttgctatacgatgatgtcattttttgtaatgaaatgcattggagattaagcagagcatgaggcctggctttttcttcttatttgagagacaatagaatcgaggatgtgatagaggattaggatcagcttgggctggtcctttttcaattgcgtcataatgaatgaaatgacgaagttgagttcaaaatgaggtaattagaatgagacaatttgattacacgaaaaaatggaaaaaatgcttacgccagaaatcgtgcgttaccttacaacaattcatgaatacaagggggaacagcgcttaattgcggaacaccatgcggatgtattagaaagtcttgttgaggtggctaagattcaaagtacagagagttctaataaaattgagggtatctatacttctgatgaatgtttgaaaaagattgttttggataagacaatgccaaagacaagaaatgagcgtgagattgcaggatatagggatgtgcttaacacaatacacgagaatttccctcacattccaatccgtaaaagttcgtccaacagatcgcccgatgacaacacctttatttttgcttcgttgcgtacaactggggattagtatccgagacctggatttgcttaccattggcctcgtgaatgatatgtatgctgaaaacagtgacgatgattataaaggatataagaaagtggcgactcaggaggacttcgacaaattttaatcaactggtagattttggagtataaacaatttgtaaaatattgattttgtattgcctttgtccgcacaaatagatataatatagttagaaaaaactcgaaaggagtgtttgctatggcaacaaaatcagcaaatgtatacgcacgcattgagcctgatgtaaaagaacaggcagaaggaatcttagcagcattaggaattcctgcatccaatgcaataaatatgttttacaaacaaattattcttcaaagaggacttccttttgaagtgaaaatgccatccgctcgtcctgtagacgttagtgcattatcagaagcacagatgaatgcagaactagagaaaggatatgcggatatgcaggctggtcgtactagatcagcaaaatctgtttttgctgatctccgcaaggattacaatttatgatttatgatatcgtgatttcagatcaggccgagatagaccttcgtggaatcttggaatacattgcttttgaactgcaggcaccagaaaatgcaagtggtcagcttgataggcttgaagcatgtattatggatcttgatcatatgccgaagagatatcgacaatatgaattggaaccatggaaaagtcgagggctacgcgtagcgccagtagacaattatcttattctatatattccggatgatgatacacaagtggttacgattatccgtgttatgtacggtggacgagatgtggatacgcaattaaacagatttacaaaaacaaaataatttgaaagcatcaatcagaaatggttggtgcttttttcgtgaatggagaaatctgtgcatttttatgcccatttttacggaaggaggtatcgaccgtggctaacagaattatgggtattactgtcgagatcggcggagataccgacaaactacaaatagcattaaaatgtgtaaacggtcagataaaaagtacacagcagcggctaaaggacgtggacaagttattaaaacttgatccaggaaatacaaagctgcttgcacagaaacaaaaattacttgctgttggattggagatgaggttcctttccaaggaaagacatatattatagaagcaattcaaaagtagagaacagttaaaaaattgttttcagtggtgacactttttaacgatagcttcgacctattgttaaaaggttcatggatatgtttcctttcacgatggtaattcatagacagcagtcctttcatgtggagacgatagttgtactacatcggacagatttgtaaaacttctcgacttccgacactttgagaggtttttcaggtttgaccagagtgaccgaaaaacatacaaaaaagtaatttcagatatagtcaagggctttactcaacgtgcttttaataggcttaatctttgtaaccgccatatctccgcaagcaccccctttatttcctctatgtcctcttggtagacgctgcctgtcgcattgacacgctttgcaatctgattgatgttgactccgattttctgtatctccgctgtcatggcttttatatcgctatggtctgtctgaatgatatagccgtcaatggcaatcttgcgaagatacgccgccatgtttttggtaggaacgagcttcattttctgctcaatcaacgcccgttcttcctctgttacatagaatttgatttgtatttttcttttgcgtccgttcatgcaatcgctcctttccgttccgagggtttgggacacttcccaacaggcaattttcaaccgacgcaccgcagggcaagagggcgaaaatacggaaaagggtactcttttcctatgcttgctaagaaagttttttatcttttttgtccttatttccctctacggagaaaaagccattttgccgaacttatgcaaaagaaaaaacgctgcaatctcaaaaagattacaacgcttcctaaaatccatattcaattttgccggacgttttatttgtcctctttttcgacttctgaaatttcttttgcggttgctgttacaatccgtatgccgttatcgctcatatcatcaaggagagcgtcgagctgccgccgctttgtatcttttccggcgggcgtatctaaaaggaactggtctacggatatattgtaacggagcataagctcaaaaaagatttgcagactggggtgctgtcctttattttcaatattcgcaaggtagcgaggggaaatatacatttcatcacttacctgtttgcgactttccctgcgtcccgtccgcgcagcttttatcgcttctccaaatgctttgaagtcatatttttctactggtctttttgccatatttattcacccagttacattttactgttcccctttctgcttggatatgtctacacagttcaattagttagccaaaataattctcaacaatttacagaaagaacctttcatttattcggctgaccgtatataattatagctgataaagttttaagaaagggtgaatgaagatgttagagtatatttctgccccggaagcagcgaagaaatggggcatttcggaaaggcgggtacagaagctatgtgaagaaaaccgcatacccggtgtggcaaaattcagccgtatgtggctgataccaaaggacgcggaaaaacccactgacggaagatacaagaaacggggtgatcgtgttgataagaatagcaatatgtgatgatgaaatcggtacttgctctgatattgaaaacatgattttaaattatgctaaacttcaagcattgcagatagacacagaagtattctattcgggagaaactttgttcaaaacgatagaaaacaaagataaatatgggttaatatttctggatattcaacttttgcagcttgacggtgttcaagtcggaaagcagataagagaacgacttggaaatgaaaaaatcagtattgtatatatttcttctaaagaaacttatgcaatgagtttgtttcaagttagaccgcttgatttcctcataaaacccattacacaaaaaaccgtcaatgaaaccatagataaatacatacgtctgaataatcttatgaagaatgattttttctttcacatagggaaatcaatacaacggctatatttagatgaaattttctattttgcctgtaatggaaagaagatagaaatacataccgacgcaggtgtaacaaccttttatggaaccatgcaggaagtagtagagcaagtggacggaaaaggattttggacaatccataaatcatatattgtaaattcttcctatgtttccatttacaaatatgacgctgttcaaatgacagacggtactattttaccaataagccaaaaatatagaaaacttatgaaatcttgtctgacggaactttatcgaaaggagtgagtttattgttattatgttatattgctatttttatgattgatgcagtacatattttactgcttatgcgtttttgcacaaactgtattggaaagcaccgggttaataaaaaaatagtgggaattatttttgccgccttttttattgttagctgttatttaaggcttatgcctgtttcaaaaaaattttctgctgcaaatacaattctgtttgtatttgaaattctattcttacttgttgtggtatttctttttcaaggaaagattgctgtacgtcttgctgttgccctgctattgcctgtcatatattggggattaaactggattattttaaaaatctgcttccatgacacatttgtagaaaacaaacaatgcttagtcagcacaggaatagcaatcgtgatattttccattctggagtttgcattagaaaaatggaaaaaatcaaaaagagagcaggaacgggaaatattagaacaggaaatccgtatgtatgaaaaccaatttgaaataatacagcaatcacagataaatacacgttctctgaagcacgacatgaaacatcatataaaaatgctatctgatttaatatcttccggggataaggatgctgcccttaaatatctttcggatatgggagatttcatggatcacacagagaaatatgtatcgtccggcaatgaacgtattgacagcattttaaattattatatcggaaaagcgaaaaatacggatattcatgtatcttggaaaatccaaataccagagcagattgaaatttcaacatttgacaccaatgtgattttaagcaatctgctggataatgcgctgaacgcattatcagatataccaaatccgactttggaaatttttatgaaatatgaccgtgggattctttatatcaatattcaaaataattgcaatcacgaacaaccctctatacatgccatactttctgcttttgagccagaaaatgaacatggatatggcttaaaaaatgtacagcgcattgtcgaaaaatatcatggtaatctatctaccgaatgtgtaaatgatgttttcaatgcaagcattctgctgtttctatccaacatagaaaaaagtgaatagaatcctaaactatatcaaagtccgtcacttctgttttgaagcggcggactttttaatttttcctttcaaccgtgcaatttttccaaccagccgtctatcctgtttaagtctgctattatggcattagataggaggataacagtatgcaagaagaaaagatacggtattattttgttgacgggataaggggcgttgctattatcaatatggttatatttcattttttatacgatgtgtatattgtgtatgaaaaatctccaacatggtatagccttccggcaatccatatctggcaacaggcgatatgctgcacattcatttttatttctggttttgtatgggtatggggaaaagaaaagaatttacggcgtggaatcatatttaatcttttggggctgctgatttcaattattacattagtagtcgttccagcgcaaacaatttggtttggaatattaaattttatgggttgtgcaatccttcttacgcttcctttagaaaaactattaaagaaaatccctgctatctatggaatggcaatctgctttttgctgttcctgctttgcaaacaaatacaatttggtcaaattggaataaccggtttgctacaaattcaagttccaaatctattatacaatataaaaatacttacaccgttaggctttccgcatgaggggtttcattcaagtgactactttcctatttttccgtggatatttttatatttatgcgggttttattttaatcagatattcatgaaacattatacatggcaaaaatacgcccagcgtaaattaccctgcttatcggttttaggaagcaaaacaatctggatatatctgcttcatcagccattcagtatgttaatttgcttattggtttttcattaaaggaggacattaaaatgcttttaaacgtagtggaaattgaaaaatattacggaacaagaaacaatctaaaaaaagcacttgatcgagtaagtttctctgtaaactcaggagattttgttagtattatgggagcgtccggctccggcaaaacaactctattaaattgtatttcaacaatagacagcgtaagtagcggtcatatatatttgggtgaacaggatttgacaactatttcgtccgctaaaatggcagcgtttcggcgtgaaaatcttggttttatttttcaagattttaatttgttggaaccattgactattgaggaaaacatctctcttcctctgtcaataaaggggattccggggaaagaaatagaaaaaattgtcaaacgacttatgcaacggctgaacattagtgatatagctggtaaattacccgcccatgtgtcgggagggcaaaaacaaaggtgtgcttgtgcaagggcttttgtaaacgatcccaaattgatattagcagatgaaccgacaggagctttagattcggcgtccgcaaagcagcttttaagtatgcttgcggaattgaacgaacaggatagaagtacaatccttatggtaacacacgatcccttttcagcaagttttggaaatcgtgtccttttcataaaggacggaaacctaaaaaaggaaattgataaggggcagcacaatagaaatgacttttatcagacaattctttctgaaatatctgcatttggaggtgaataaccatgcctaagaaattatcattacaaaatgcaaaaaaacaggttgttgaatatatgatttatataatcactatggtcattacggttgcattgctattatcatttaatatgattatattttcggaggaaatagctgctatcataaatgagaaatcaatacttccgctaattcttattaccgtaagtgttcttgttgtgcttgtgataagtgcattggtaaaacatattaccgtgtttatggtgaggaaaagaagccgtgaatttggtttatatatgctattaggtgttgaaaataatgatattgcaaaaatgttcatgtttgaaaattattttatctatgtatttgtcttaattatcggggtttttataggcacgctgttttatcagatattaaaagctgtaatttgtcaaatgtatgcgacaatatactattttaactttgaattttcatcaaaagcaatcatattaactttagtatatatgggagctattttttcttttgtttccattagcacaagtcgtagtatccgtaagttcaatgtacgagatttgttatacttagacaatgataattctgataatagagaaaagaaatatggcttgtccgcaactctgattcctctgcttttaggaataattgggattgcgattattacaatgtctgcttttaagaatatgccggacggatcaacgcttttttctcttgttcttctttcgacggcaacatacggcttatttgctgttttgctgaaccatttcacttcccgcttaaaaaataacaagtggaaatatacaaatataagggtgtttgtttatcggcagtttactactaaactgcgctccatgttttttttgatgataggagcttcaattctaataacagttgcattattgtcgattaactggggagtttattttaccactatggtagaaaaacgcgttgacgctgttgcttttgatatagcccttttttcaaacgaggaaaatacagatttttctaaatatctatcttatctaaaagaaaataatcttttggatagcagttatgagtataccttatatacaaataaagataattccttttatcaagaaacattaagggcagtgcaggggaaatttggtttttctatatcgagcgaaacaacagatacctttatgtgtataagtgattacaataatttgcgtgatatgctgggattatccagcgtcgtgcttgataggaatacttatatcatacattgcactgttcccaatatagctccttttgaaaaatataccgaagaacacacacagcttttgattggtgacacaatttgtcacttcggaggtatatacagtgaagattttatgcaacaggagtcatgtggaaatggaaacggatttttaatcattgttcccgataaagttagtgaagttttgtacgagcagaaaaatgtacttgtggtaaagacactttcttctttgtcgttaacgcatattgaggatttaaatcatatagacaaaaatgtgctgatactttcaaaaacaggagttcgtaatcagtctgcttctatggctgtttatactgtcctgccattattctattttgcatttgtatctgctgccattgcctgtactcttttatcagttcaaattttaagctgggcaaacaaggaaagaaaagattatcttactctggattatattggtgtcgcaaatcatcagaaaaaaactttgttgaaaaagcagttgtttcttttatatttcgtgcctgttgttccggcgactttagttaatttgcttttatttccggtaatgacaggcagcatagtaaatgacgttaatggagttttgcagatagcttctatcatatctggaatacagcaaacagtccttaccgtatgtttgctattagtagtctactttttctactatgtggcaacatatatgatctacaagagaacaattatacctaaaaaatgataatagataatttctaaaataatctgccggacgacggcaaagaaaaaaagccgtcgcagagcagccatattttcacgcgcctattctatttcgacggctttgatattcagagccgccgtttctttttgtctgtacgacgacccttaaccatgtagacatggcggctttaggaggtagccgccatgagttataaaccacatcaacaaattcttacattctttgatttatcaaaaaaagcccgaccgccaccggggatattcctacccttagatatgaactattaaatcatctaaatactttttattattcctatgcgcctgtccgcgtttttttgcggacgggcgcattttgtatgcttaaaaaaatttttgaaaaaatttccgaaaatatttggcattttttcaaggctccgtattaccccgcgaaaagggggaagcaccaccaactttcaacaagaaaggaggtgagaatgtggaacctaatagcagggagttttataagcaatgttcttttcagaagtattgcaatgcggtattgcacaatgaagcgtgcgacgctcatagagagcttcgtacacataaggcaaaggaagtaaccttttccgacatgaccttagatgaagcgcgacagctacatacctttgatgaatatttcaaacgggaaactgctgaaaccgtctttgaaaaagccggaaagaaaatcacgccgaagctgcttcttgaagcaatccgtactttgccggaagaaaagcgcaaagccatattgctgtattatttcgagggaatgagcgatacagaaattgcagagttgctcaatacaccgagaagcacaatacagtacagacggacaagctcttttgaacaattaagaaaatatttggaggaaaatgctgatgaatgggacgaatggtaatcaacctggctacccggaaaatgcccttgttccttatcctgtcattgtggcagcgacaaagggcgacccggacgctatgaaaatggtcttgcagcatttcagcggttacatagcccgcctatccatgtgaaagttatatgacgagcgtggaaatgtttattttggtatagacaacgacattcgggaacggctgcaagccaaactgatgatggctgtcctcaattttagaacagagaaataattgcaatcggcggtggaacgtctttactcccccttttccgttccgctgctaatgcagcaacacagccattttgaaccttgacaaagaaagcggcgcaatagaacggcgacgcagcataaggcaaatcggatacattcgatatatggggagccgttgggctgatacgccatgaccgaaaggagggacaaaacgagcgagaattatcagtgttccaaagcagacttagcaactctgccgccacaatccatatatcggtataatgatactcctttaccgccgtagtccgagcgttagaagcgtcgcaggcaacgggtagagctgcatgagaaccatgcggaagtgaaattcttgtgaggtttgctaagaccgtctgacgagcctattttttgttaaattgaaaaaagatagggggaaattctaatgaataaatcaaatagcagtgaagaaaaagaactgcctttatataaggaaacagaagtaagagtacctatccatttgaaaataacattaacaataagggaagccgctgaatatagcaacataggtatcaataagattgattctatgttaaaacagccaaactgcccttttgttttatatgttggaacacgaaagttagtgaagcgtaaagaatttgaggaatacattcgccgagaattgattatatagcctttaatagctgaaatatttgtctgttaagcttgaaaaaacggagcccttgtgatatactttatatttgcgttggactctttttttacgtgaaaggagtccgtcatgggaaaaaatttaaaaggcaaagagtgtggaaaaggtatttgtcaaagaaaggacggtttgtatttcgcaagattttatgctaaaaatggtacgcgtcaaaatggatatttcaaaacgctgccagaagcaaaaaaatggcttgctgacgcaaagtatgaagatacacataatctaatcgttactgcgcctgatatgacagtagacaaatggttcaattattggattgataatatcatttgtgaccttgcgccaaacacgattagaaattatcgtgagcgttacgaaagaaatattcaaccattgataggaactatgtgtatagctgatgtaaaacctatgcactgtaaagctgtcttaaatcgaatggaaacagaatatgcaggctcaacaatccggcagacctatatttcaatgggaactatgttcaaatcagcagttatgaatgatattattgcaaagcaccctatgaatggtgttcgatatacgaaaccagtccgggcagtagatgatattaaatacttaaccgttgaggaacaggaaaagtttcttgaagccgcagagcgttctcataattatagacagtatgctttgttattagaaacgggtttgagaacggctgaattgattggtctgacatgggacgctattgattggaaaaaacgtactttaactgtaaataagagtttagagtatcgacacagccggagatattggcgtgccggtccgcctaaaacaaaaaaaagttatcgtactattccgcttacagaacgcgcatatacaatcctaaaaagttgttatgatgaaaaagatacccggaaagagtctgaaatgctttcacagattttggagtacacagacagcagaacgggagaaaagaaatgtcttgtcatgcgggatttggtatttatcaactggcgaacaggagaacctgctaaaaacagttcctacgatacacatttatataaattgtgtgatgaagctggtattaagcgtttttgtatgcacgccttacgacacacttatgctacacgcgcgattgaacgcggcgtacaacctaaagttttacagcaactattaggacacgcaagtattaaaacaacaatggacaggtatgtccatgttacggacgagtcccttgcaaaagctgttcagcaatttgaagcagctacacccacagttgaaaaaagggtgtaaaaagggtgtaataaaaatatagagaaaggcgaaaacccgcataaataaagggttttcggacaggtaaagataaaaatgaaattaggtatcgtcggacttccaaatgtcggaaagtctacattatttaattcactgaccaaagcaggagcgctgtctgcaaactatccatttgcaaccatcgatccgaatatcggtatcgtttctgtgccggatgagagaattgtaaagctcggtgagctttatcataccaagaaggtaacacctgcaacgatcgaatttgtggatatcgcaggtcttgtgaagggagcaagcaagggcgaggggcttggtaaccagttccttgcaaatatccgtgaggtggacgcgatcgttcatgtagtgcgctgttttgaagataccaacatcatccatgtagacggatcgatcgacccggcaagagatattgagaccatcaatttagagctgatcttttccgatattgagattcttgacagaagaatcgcaaagattgcaaagcaggcgagaatggataagactcttgcaaaggagctcgagcttgtagaggcggtcaaggcgcatcttgaggacggcaagatggcaagatcttttgaggtgccagatgacgaggacgcacagatctggttcaagggatacaaccttttgacagcgaagcctacgatctatgcagcgaatgtcgcagaagatgacctcgcagatgacggcgcatcaaacccacatgttgcaaaagtaagagagatggcagcagaagagggcgcaaaggtattcgttatctgtgcgcagatcgagcaggaactggcagaactttctgaggaagagaagaaggaatacttagacgatctcggcgtggaatccagcggactggacaagctggtggctgcaagctacagtattctcggtctgatcagctttttgacggcaggcgaggacgagtgccgtgcatggacgatcaagaagggaaccaaggcaccgcaggcagccggcaagattcatacggacttcgagagaggctttatcaaggcggaggttgtcaactaccaggatcttctggacaacggaagcctcgttgcagcgcgtgaaaaaggcattgtcggaatggaaggcaaggattatgtggtgaaggacggagatgtgatcctgttccgctttaatgtataatttcagacaaacatgattatgaaaaaagacgcatatactttttcgaggaagcaaacgggggagtatatgcgtttttgcgatctggcgaggaaagaggtcatcaacgtaaatgactgcaagtgcctgggaaatgtgcgggatctggattttgacgagtgcgacggatgcatcaaggcgctgattgtgccgggaccggcaaagtggatgggctgcatgggaagggagtttgaagtgtttattccgtggtgcaggattgtaaaaatcggaccggacattattctggtggacattgatgagaaagaggcaaaacataaggtaaaataggcgaaggggacaataaaacagaaagtttgtgcaaaaaatgacaatttcgtgaaaatatataaaaaaccggtcatataatcgtgtaaatttcattgacaagcaacaaatgtatagatatactacaatatataggcaaaattgcccatggaggtagcaaatgaagtgtccattttgcagcagtgaaaatacacgagtgatcgattccagaccggcagatgacaacaattccatccgccgccgcagactttgcgatgattgcggaaaacgctttaccacctatgaaaaggtggagaccattccgctgattgtgattaagaaagataatacgagagagcagtatgaccgttccaagatcgagggtggtgtgctgcgcgcctgccataagcggccaatctcggtcaatcagattaaccagcttgtggatgaagtggagacggagatctttaaccgcgaggagaaggagattccgagttccctgatcggcgagcttgtgatggataagcttaaggatcttgaggcggttgcctatgtccgtttcgcgtcggtgtaccgtgagttcaaggacgtcaacacgtttatgagcgagctgaaaaaaatgctcgacaaataagaacagaaggtaaagtttctgtttttatttgtcgatataataaaaagttatagtaatatttttttctggttacaatggagagtttctaatgaatttgtcaggaatccgcatcagtgcgggattttatgattacaactccatagagaatcaaactgttaccgtgggatcggaactgccagcagaacttccgcagagcgtaacagggcaggcgccgtccacagaggagtatactgcgcctgcagccatcaggaagagcggaccggatcagggagccatcgattacgcaaacagctaccagccggatgcggtctacgagctgaagggcgtggacagcgacattgccagactggatgttgagcgcgccatttcggatatgcgtaaggatcaggtactcgagcagtatcagttttttgtaggaacgaatcctgacaaggcacagccggtcagaccggatgagaattttatactatagaatcatgagcggatgggactgtatacacatgtgtatgcagtctttttttgtgtaataggaaactttgttcctattacacaaaaacgctctgagaaaaacgaacaacgcgaattggaaattccgggtggatattttggtagaaatgtagtaatctatgtaaggatgcgcactaagtgagatgagtaaaggagcaaaagggcaatgctggaacggttttacccgggagaatacgtagattctacctatgcgatcgattttgaccgcctttatgaggagggatatcgaggcgttatttttgatattgataatacgctggtgccgcacggcgcgccggcggacgagcgggcgtgcgcgctttttgcacatttgaaggagctgggatatcattgcatgctgctgtcgaacaataaggaaccgcgtgtgaaaatgttcaatgacgcggtgcaggtttcttatatctacaaggcaggaaagccgaatccggcgaattacagaaaagcgatggaacagatgggaacggatgagaaaaacacattgtttgtgggagatcagattttcacggatgtctacggcgccaaccgcacgggaatccgcacgattctggtaaagccgatccatccgaaggaggagatccagattgtcttaaagcgttatctggaaaagatcgtcctgtttttctatcggagaaaatgccaaaagcagcagagcgcagcgcagaagcgataaaagaagcagtttgtgctgcagaaaacagtggcagcatgtgacaatgaaaaggacgggtgccaaaacccgggatggaggaaaaaatgaaaatagcaatcggaaatgatcacgcggcaacagagttaaaatttgtcattatggactatttaaaggaactgggacatgaggttatcaactttggaaccgacggaacggacagctgcaattatccggaatacggagagaaagtcggcagggcagttgtggcaggcgaggctgactgcggcgtactgatctgcggaaccggtgtgggaatctccatcgcagccaataaagtcaacggtgtgcgtgcagcagtgtgctccgacacggcaactgcgcggctggtaaaagaacacaacaatgccaacattattgcattcggtgctagaatcgtcggcacagagcttgcgaaagacatcgtcaaggcatatctggatgcagaattccagggcggaagacaccagaccagaatcgatatgatccatgagattgagaagcgcaacgcttaataataccggggagattgcgccaggaacagagcaaaaagcgtgcaaattcgcatggcgcagtgcggtatatgaaaaaaagcttgaaatatagcgctgtttattataaaatagaaaaatcagagagtaaaactcgagcgtatttttaaggaggaaatttacatgatttcagcaggcgatttcagaaatggtattaccattgagttagagggtaatatctatcagattatcgaattccagcatgtgaaaccaggaaaaggtgcagcatttgtaagaactaagttaaagaatattaagagtggtggtgtggttgagaagacattccgtcctacagagaaatgtccgactgcccgcattgacagaaaagattacacttatctgtatgcagatggtgacttatacaactttatggatgcagagacttatgagcagatcgcactctccaaagatgacatcggcgatgcgctgaagttcgtgaaggagaacgagatggtgaagatgtgctctcacaacggaagcgtattcgcagtagagccgcctctgttcgtagagcttcagatcactgagactgagccgggcttcaagggtgataccgctactggtgcaaccaagccggcaatcgtcgagacaggagctaccgtatatgtacctctgttcgtagagcagggcgatgtgatcaagatcgatacacgtacaggtgagtatctgtccagagtataattgaaaatggacttcggttcaagatgagaagcacaacccccggaaatatcaagttccgggggctttctttatgtaacgttttgtttttctaatttaggagcttttgttcttattccgtcaatgtgttcgtataaatcgtctcgtattggtgaacgcattgggtctaaaatgaaatcaataccctctcgtcgggcattcttggcggctggtacaaagtcactgtccccagaaattaaaatgattctgtcaacctgctttttgaaggaaagtgaagagatatctacgccaattctcatgtcgacacccttctgggtaactgataatgaaaaatccttttcttctaattcatctatagtttttacaccggataatatttttttcatcacatcgggttttatgttgaagtgagcctgttcctcggcgagtcggcccagtctgagtgcaaacttgcgttgatgctttaattctttaaaaaaatcgtttgcccatacataatcctccgattgaccgaggttgatggcccgctttagcaagggatgatatacttgtttgttcatagggggacaatcataataaaatactctatagaggcatgcaccttctttctcgtcttttatatgacggtggcagtatgccgaaagttcttttgctctctcggcagggcttatgtctccgaataatgtgtaggcacgttttctatagaaagcgccgtcaacaagaatagctgtttttatcataaaatctccttggtaaaaaaatatccctaggctcatcgcttcccatatgttgggaggattactgctagggatatactctcaaaatactgtaccacacaaataggtacaatattattatatccaaacagtaagcaaagtcaacagcttttaggaataaatctgtagtgataaaataactataccactgatgtaattatattgcaaggctgtttgtcagcttgccattatatacagatgcaacaattttaacctacatactttgtgaatgattctggcagtatttggtggagatggaagatgcggcagcctttctggtggataccagcgataacatgattttaagccaccggagcagtgcgctggtgggaagcacattggagagcgcagcttccgatccactgatgcagagtgttgcggaaaaactggatgcgggagacctggggacgaccattttaaacggttatcaggtggcgttcgagcaggttgatgcctccaatgtgcgcgattacgagtagcagcgcgtggtcaggcattaaaatgtgtctggcgcagcagaattccgatggagaggagagccatgacggcctgactgatgagaagtccgcacagatagccgcggatgccgtagacggggagggcaaacagcacaaagaggatgcggatgccgcaggcaatcagattcagcacgaaagtgatgcccgggtagccgagtccgtgcagaatactgctcagcgtcacgccgaggtacaggaaaggacagatccagccgagcgtccgtataaatgttccggcgagcgcgttcccaaagagcacattcccgataaagtggccggtagcaagaaaacctgctgtacagaaaaagccccacagaagacagacccggatggtttttaagaccgcgcgccgtatgagcgcatcgtttccaccggctttggcctctgagatggcgggcataagaagtaccgaaacggagttggtgatgacggacggaaacatgatgacggacatcgccatgccggttaagatgccgtagacgccaagcgcctcggaagccgtgtaaccgaacaggcgcaggcggctgggaatcatgatgttttcaaaactggaaaagagcgttaaaacaacccggtttgccgtgagcggaaccgccatggcaaggagattgcgcgtgttgcatttcacggaaagcgccgtgtccgttcccttcggaagttttgcgacgctgacggagacgagcgtgcttgccacttcgcccatcacagcgccccacattgtgacggagagcggaacggtggtctgctcccgcatatggatctgatagagcagccagaccgtgccgacgcgggcgatctgctctgtgagctgtgtgagagcggggacgcccgtctttttctgtccatagtagcagccgttgatgcaggcgtggatacagcacgggacaaaggagagagagatgattttaaggagcgggatgcaccgcacatccccgagcatggaaacaccaataaagtctgcgtatttccagattacaaagccggtcgcggcagataaaaacagcgacagcagcaggccgatccgaaaatagagcctcgcacccgcgggattgttctgcgcaagctcggaggagacgaagcgtgagatcgcagtctgaattccggcggcggtgacggcgaaaccgagcgccatcaccggggacagcagctggtagatcccaagaccttctgcaccaatcagccttgagaggaatattctatagaagaagccgataatccgtgtgagcacaccggcgagtgttagcagcagtgtgccggtgatcagggaatttttcagagaatttccagaaacggaattcctgggaaaatgaatgtctggcaagtgtgtctccgggaattggaatctttttattatatgtaaggtgtgggggaaaaatgtgcgatcaggaatataaagcaggtgtggtctatctggataatgctgcaacgacgcggatggcggaggaggccgaagccgctatgcagccttatctggtggaaaagtttggcaatgcgtcaacggcttacggttacggggaggaagcgcaggcggcgattgcccatgcgagagaggtgattgcagcatcactggatgccagaccgtcggaaatctattttacatcgggcggatcggaggcggacaactgggcagttaagggggtggcggaagcgtatggaaaatacggtcgtcatatcattaccagcaggattgaacatcacgcggtcctaaactcctgccattatctcgaggagcagggctacgaggtgacttatctggacgtcgatcaaaacggaatgatctcgctggaacagttagagcatgccgtccgggaggatacgatcctgatctcggtcatgtttggaaacaatgaggtcggaacgatcgaaccggtcatgcagatcggaaggttcgcaagagaccatcagattttgtttcatacggatgcggtgcaggcgtatgcccagattccgatctccatgcagcagtaccacatcgatctgcttagcgcgagtgcacacaaatttcacggaccgaaaggtgtgggatttttgtatgtaagagacggggttacgatgccttcctttatccacggcggcagccaggagcgtggaaaacgcgcgggaacggagaatgtgccggggatcgtcgggatggggaaagcggtggaactggcattctgtaatatgcgcagaagaatccgcagggagatgatgctgcgcaattatctgattgaaaagatcatgcatgagatcaagggggtccgcctgaacggacatcccacgaaccgcctgccggggaatgtgaatgtgagcttttccggcgtggacggtgcatcgcttctcattctgctgtatgaggacggaatctgcgcctcgggcggctccgcctgcaacaccggggaggagcgggtctcctatgtaatcggggcgttgggcgtgccggacgaatacgcaccggggaccgtgcgtatgacgttgtcgggagagacgacaagggaagagatcgaccgcgccgtggaggcgctcaagcagaatcttaggaaactgagagatgaaaaatagttttctctggggaaaaaatatgtgaaaatattacaaaaacgaaacgtacctttgcgggaaatgagaaagtgtgcacaagaataattatgcagtttgctttttgagagaaaatcgcaaaaagagattgcaaaaaacggcaaaaatcgggcacagaaatgagcagattgcccgtactttcaagtggtttaccggttgcgtcaaatttgacaaagaaaaaaaattatgcaataattgcgcggaaatcagagaaacacgtttggtttatagtaggaaaggatgaataatatgatagagagaaaaatcagattgtctgacacggaggaagtaaaggagtttgtgagagctgccggaaaatgtgattttgatatcgatgtttgttataacagagctgtgattgatgcaaaatcactgctcggaatgttgtatcttggactcagcaaggatctgaccgtaaaatacggcggacagaacaccgggtttgagaatacggtacagaaatatgcagtctgctagtcagacagacggagacagggctgctgccggagagaaacctcttcgtgcagcagccctgtttttgtgttacactgtatgataagaaaccggaaagtagggagcgctgccgtatggatgcacaacaggaaaaagacgaaaagaaaatcataaagatctcggtgcggaatctggtggagttcattctgcgggagggagacattgataaccgccacgggagaactgcgtccccggaggccatgtgggagggcagccgtatccataagcgcattcagaagaacaaaggcgcgaattaccatgcggaggtgccgcttaagatcgaacttagcgagggagattacacgcttgccatcgagggacgggcggacggaatcgagattacgtgcgacggggagagacagcttgatttttcggataacttcaaccatcttgcggtggaggaaggcatgcatgtgacgattgatgagatcaaggggatctacatgaatctggatgcgctggatgaacccgtgggcgtgcatcgcgcgcaggcgatgtgttatgcctatatctatgccttgcagcatgatcttgcagagatctccgtgcagctgacctactgcaatctggatacaatcgaactgacaaagacggcgtttctggggaatctgaaatactttagggaaacattttcgtttgcggagctggcggagtggttcacccggctgacggacgaatataaaaagtgggcggattttcagttcgcctggcagaatctgcggcaggcttccatcaaaaagctggagtttccctatgcataccggaaaggacagaaagaactggcatcggacgtataccgcacgatcgcgcgccggaagaatctgtttatccaggcgcccaccggtgtcgggaagaccatttcgacggtctttccggcggtgaaggcagtcggtgagggactcggggacaagattttttatctgacggcgaagacgattacgggcacggtggcaaaggaagcgtttgaacttttgcgcaccagggggtatcaggcgaagatcatccagctgacggcgaaggaaaagctgtgtctgtgcgaggagatggactgcaacccagtgcattgcccttacgcgaagggacactacgaccgcgtgaacgatgcggtgtacaacctgttgcagaaggaggatgtttttaccagggaagtgatcttagagcaggcgagggaataccgggtctgcccgtttgagatgtcgctggatacggcgacctgggcggacgacatcataggggattacaattacgtctttgatccgaatgtctatctgaaacgcttttttgcggaaggaacgcgcggggactacatttttctggtggatgaggcgcacaatcttgtggagcggagccgggaaatgtacagcgcatcgatctataaggaggattttctggcagctaaaaagctgctgaaaccctatcaggaagagcatgacagatgtgcggaacgtgtgatccggcatctggaaaaatgcaaccgcatcctcctgggatacaagcgtgagtgcgaaaactatgtcgtatatgaaaatatcggtacgctgatctttgcactgacgcgccttgcggcagatctggatgagtatctgcagaaaagtcccgatttcccggagcgcagggaagtaaatgaattttacttaaacctgcgcaatttcatgaatatctacgagctggtcgacgagcattatgtcgtgtattcagagcatgaggaggacgggcgcttcaagctgaagttttactgtgtggatccctccctcaatctgcaggagcgcatagacaagggaaatgcgacgatctttttctcggcgacactgcttccgatccagtattataaaagcctgctgtccacccgcagggataattatgcggtctacgcgcagacggcgttttccgaggaacagcgcctgctgctgtttggaaatgacgtcagcagcaagtacacgaggcgcggcagggcagagtatgagcggattgcattatatatagaaaaaacagcgcgcgcgaagcagggaaactatatggtgttctttccgtcctaccggatgatgcaggaagtctacgatgtgtttttagagggcggggagacggatgaaatgcgtccgcaggagtattttccggaaggagcagagaatgcagagattgtggagcatcccgaagaggcagagattgcggagcatcccgaagaggcagaaattgcggagcatcccaatgatgcggaaaatcccggagacgcagagccgtgtctttggtgcatgatgcagcagaccgggatgcgtgaggcggagcgcgaggctttcttacaggcattttccggtgaggcatcgaaacggcgaggcggttcactggtggcgttctgtgtgctcggaggtattttcggagaggggattgatctgaaaaaagaacagctcatcggggcggtgatcgtgggaaccggattgccgcagatcagcaatgagcgcgagattttaatgcgttattatgatgagagagcgggggcgggctttgactatgcgtaccgctttccgggaatgaacaaggtattgcaggcagccgggcgcgtgatacggacgacagaggatgtgggagtgattgaactgttggacgagcggtttttaaagagtgattacagagggctgttcccaagagaatgggaacagcgccggatatgtaatgtaaatgaagtggagcagatgttagccgagttctgggagagacggcaggagttttaagaattcttccgtggactgcgcgattggaagcgtcgggttgactgcggtgaccatctggcgtgccgggagcttttccttgatctttacgataaagagctctttggactcgcggtttaggcagtaatccgggataaacgcgattcccaggccgatacgtgccagatcaatcagaagatcgttgctgctcagctcgatctgcggcatcagttcaagctggtgctgcagaaagaggttatgcaaaaattcgctggtggtgctcttgcggtcgagcatcaggatcgggtactgctgcagatcctctaaggcaatctcctgctgcttcagattaaaataggcagggttggcgataaagacgtcgtgaaagctgcacacagtcttgcggatgtaggactggtttaaattagagttgggaaaattggtcacaatcagatcgacttttccctgttccaacagctccacacagctgagggaggttgagtttgtcaccttgatcgggacattcgggaacttcttgtggaactgctttaaatacggcacgagaaaatagcggcagatggtgtcgctcgcgccgatgtggagctgccccagaccgaggctgccggaatctaacagctggctctcaccgcgccggattaaattcatggcaggttcaatatgcttgagcagaatctttcctgccggagtcagctgtacttttttggtactccggataaaaagcggctgctccagctttttctccagcgtcttgattgactggctgacggcggactgggagatatagagctgcttgctcgcctcggaaaagctgagggaggttgcaacataatagaaaactttatacaattcgtaattgatatccatggttcctcgtttctgtcggagcgctgctccgaaccgttctgtagcgtgttaactataattataagacctgcttataaaactgtcaaataaatcttatgtgatatattaaccataataatagaagagattaaatatattaattatgcttatttgttcgcatatgctatacttcatatagaaagtaggataagatagaaatacaaacgatcagtagtttcgccgatggcgtgcgcagatggagggaaaatatgagcaacgtaagacgcgtatatgtggagaaaaaaccggcatttgctgtcagagcaagagagctggaagcagagatcagaaattatctcggtatcagtgacgtgaagggagtgcgtgagctgatccgttacgatatggagcatgtatcggaggaaacctaccgcaaggctctggttaccgttttttccgagccgccggtggacgatgtgtacgaggaaaattttgagttaaatggcgcgagaactttttccgtagaattcctgccgggacagtttgaccagagagcggattctgccgagcagtgtgtgaagctgttaaatgagaacgaggagccgctgatccgcacggctgtgacttatgtgatcgagggagagatcagtgatgcagagtttgaggcgatcaaaaagcactgcatcaacccggttgactccagagagaccggtcttgagaagccgcagacgctggtgcagtcgttcccggagccagaggatgtaaagattttcgacggattttctgcgatgcctgaggcagaactgaaggaactttatgattccctcggtctggcgatgacattcaaggactttttacatattcagaattattttaaaaatgaggagaagcgcgacccgtccatgacggagatccgcgtattggacacatactggtctgatcactgccgtcatacgacgttttccacagaacttaaggacgtaagctttgacgacggctattaccgtgcgccgatggaagagacctatcaggattaccttgccacccataagaatctttacgcaggacgttcagacaaattcgtgtgcctgatggacattgccttaatggcgatgaagcgcctcaaaaaagaaggcaagctgatggatcaggaggaatccgatgagatcaatgcctgctcgattgtcgttccgatcgaggtggacggcgtgaccgaggagtggcttgtaaactttaagaacgagacacataaccacccgacagagattgagccgttcggtggtgctgcaacctgtctgggcggtgcgatccgtgacccgctttccggacgtacctatgtctatcaggcaatgcgtgtgaccggtgcggcagatccgacggtttccgtgaaagacacgatcccgggcaagcttccgcagaagaagctggtgcgcgaggcggcacacggttacagttcttatggtaaccagatcggtctggcaaccggttatgtcaaggaggtataccatccgaattatgtggcgaagcgcatggagatcggtgcagtgctcggtgcggctccgagacgtgcggtgcagagactgacctccgatccgggagacatcatcattctgcttggcggccgtaccggtcgtgacggcatcggtggtgcgacaggttcttccaaggcacataacacagagtccaccgcagtctgcggtgcagaggtgcagaagggtaacccgccgacagagcgcaagatccagagattattccgccgcgaggaagtggcgcatatcatcaagaagtgtaatgacttcggtgcaggcggtgtatcggttgccatcggagagctggcagacggactgcgcgtgcagctggataaggtgccgaagaaatatgcgggacttgatggaaccgaacttgcaatctcagagtcccaggaacgtatggcggtcgtagtggcaccggaggatgtacagaagttccttgcatttgcgaaggaggagaatctggaagctgtcgaggttgcggttgtgaccgaggagccgagactggtactcacgtggagaggaaaggaagtcgtaaacttatcccgtgcattcctggataccaacggtgcacatcaggagaccaatgtggcagtggatatgccggacccgaaggaaaattatctgaataagatcgatacaccggcggtttccgaggcgttagcagcaggcgatatgaagaaagcatggctcgcagaacttgccgacttgaatgtgtgttctcagaagggactggtggagatgttcgacggttccatcggagcgggaagcgtatacatgccgttcggtgggaaatatcagctgaccgagacacagtccatggtggcaaagattccggtgatgaccggcaaatccgatgcagtcacgatgatggcatacggcttcgatccgtatctgtcttcctggagcccgtatcacggtgcggtgtatgcagtgcttgagtctctgtcgagaatcgtgtctgcaggcggcgattacagcaaggtgcgctttaccttccaggagtatttccgcaggatgagcgaggagccgaagcgctggagtcagccgtttgctgctctgcttggcgcgtacaatgcacagatcggcttcggactgccgtccatcggaggaaaggattccatgtccggaagcttcaacgagatcgacgtaccgccgacactggtatcctttgccgtggatgtggcaaaagagggcgacatcatcacgccggagcttaaggcagtgggaaatcagctggtacttttctccatcgagagggattcttatgatcttccggtctatgcgcaggtaatgaagctctatgcggtgctgcatgagctgatcggaaagggtgcggtcgtatccgcctatgcgctggatggaaaaggacttgcggcggcagtcagcaagatggcatttggcaataagcttggtgtgacgattgagaaggaagtgtcggaagagacactgtttgcaccgggatttggtaatatcgtggcggaggttccagtggagaaggttggtattgtcaaggagacattaaaggcagcgggactttccggaaatgaggagcttgtcggctgggtaaatgaggaacagagcttctgctacggcggcatgaagcttgcactcgacgaggcgatcgcagcatggagcggcacgctggagaaagtattcccgacccgcgtgacagataataaggacgaacttgacaccggcatctatcaggcagacagtatctatgtctgcaaacacaaggtggcaaaaccgaccgtgtttataccggtatttccgggaacgaactgcgagtacgacagtgcgagagcatttgagcgcgcaggtgcggacacgatcgtaaaggtattcaagaacctgaatgcagaggacatccgcgattcggttgaggagttcacaaaggcgatcgatcaggcacagattatcatgttcccgggcggattctccgcgggagatgagccggagggctccgcgaagttctttgcgaccgcgttccgcaatgcgaagatgacagaggcggtcatgaagcttttgaacgagcgcgacggactggcgctcggtatctgcaacggtttccaggcactgattaagctggggctggtaccgtacggagagatccgtccgcagaccgcagattcaccgacattaacctacaacacgatcggccgtcatatcagcaagatggtatacacgaaggttgtgacgaacaagtccccgtggctggcacaggcaaagaccggcgaggtatattgcaatccggcttcccacggcgagggacgttttgtcgctccgaaggaatggctggagaagctgtttgcaaacggtcaggtggcaacacagtatgtcaacgaggcgggtgttccgaccatggatgaggagtggaatgtcaacggctcctacatggcaatcgagggaatcacaagcccggacggaagagtgctcggcaagatggcacattcggagcgtcgtgaccggagtgtggcgatgaatatttacggtgagcaggatttgagactgtttgagtccggcgtggaatattttaagtaaaagaaaaaataacgggaagtaaaagagaccctgcagcgaggagaaaaacctttctgcggggtcttttgccgttcggttcttgggggattgttgataaaacaacgcaaaatgagtataatagtgcgaaagggaacggaaaacgggaagaagaaagatggagaaacgtatgaatattttagtgctgggcggaacgggatttttcggaaaacatctggtgtgggaacttttgcaccggggacatgaggtgacgatcgcaacacgcggccggacgccggatgattttggagacagagtcagacgtctgatcgtcgaccggacggatgtccggcagatggagcaggtgtttgcccataaatattatgacgttttctacgacgatctggcttactgtgcgggggatgtgcgcaccgtgctggaggcggtgccctgcagaaggtatgtgatggtgtcctcggcatccgtgtatgatctgcattttcagaccgtggagacagactatgagccggaacatgacagactggtctggtatacggattacagcggatcgtatgacgtattgaagaaaagtgcggaatgtgcgctcgtgcagcagtatccgatgaaaaatgcggcttttgtgagattcccctacgtcatcggcagggatgactacacggaccggctgtacttttatgtggaacatgtggtgcggcagaaaccgatgtatattgataatatggacgcacagatgagctttatcagcgtggacgatgcggggcgccttctggcgcatctcggcggggatgagatccagggtgccgtcaacggagcgagccgcgggaccatctcgccgcgggagatcctgacttacgtgtacagacgcaccggaaaagaggcgtttcttgatgagaccggcgatccggcgccatataatgggacgcccggctacagcatcaatacagagcgcgccgggcgtacgggatttgtgttttccaatctgaaagactggatctatgaactgcttgatttttacatagagcgcgccgcagaagagatgcgtaaataaaaacaggacatcaacgtataaaatgtcagtgagaatgaggactggagcgccggatgcggcggtcagtcctcaatttttatgaattccggcttgcgtttccggaagaccgtgtagtaaataaaaccggcgtcctttaaaatctgaggcactttctcaaaggcaaagccgacatgttccggggcatgggcgtccgcgccgaccgtgatgatctcaccgccaagctcacggtagcgcgcgaggatctcctcgcaggggttcggatgtcccagtccgtatttgaagccgccggtattgatctcgatgcctttccctttttcaatcagaagtcttagaatctcgtcgatcacgtcgctgtatctggcgtaggtataattctcgttgcgcgtcggaccgtagcgcacgacatagtcgatgtgaccgtagacgtcaaagtcatcaaatgcccggatgttttccaggatggactcaaagtattcgcggtatccttcctcctcggtgtgcgtcttccagaatggcggaaaatacggatcatagccgtgtaccacatgggaggaaccgatgacaaagtcgaagtcatactgcgagagaatatcggcatgcagcgctgccagatgcggctggagccccagctcgatgccgtagcgcacgctgatctgatcccggtactgttcctgcatggcgaaaacggatgacgtgtagttcggcaggtctaacaggaacgcttccgggttgtccggatagtcgatgtccagatgatccgtaaaacagatgccggggagctttgccctgattgcagcgcggatcatgtcctcctgcggggcgtcgctgtcaccggaatattggctgtgcatatgtgtatcccataacatagagatcttcctttctgtgtgagtttaatggatcagttcgttgaaaaattccgggaaccctacgcggaactgtttctcgcggatcacatatctgcggttatctgtgtgcagggtaagcgtccggagcccctgactgccggaggtacattcaagctggcggatatcccggcgcagcagggtttgtgtccggcgggggaaacgggaaataacaattttttcgcggtcgtaggtgattttctgcagactgacataaaacagtgccagaacggtgccgacaaacgcgaccggaaagaaaagggcgccgtagagcttttcttcgcggatgatctgcagcgttcccgaaatgctttccccggaaaaaacggtcaagccgaaaaacagaaacatgacaaccgcatagaggatgaggagcgcgtaatattcgccggtccggtagcgcagtgttccgcagccggatgccgcagacaccggattgtcgtacggggtgcttttttgctttgcggtgtattcgggacgggtgaaccgtaacgatgcctgataaaattgccggtagccttccagattcgcatttgcgctgacgcagcggcggccgtttctgtcatacagatcaaaaaagtcctgatttttgatccgcatctcagagatttcataccagtgaatggtctggtaggggcggaacggtttcccgatcagaaggatttcttcattatatagaacatgacgtgcctgcatggcgtaaccgccgagaaagcagacgacaactaacaggatggtgatgccgatgcatgagagcagagagcctatatccgatgcctcaaaaccgatgtcctgatacataagcaccataaaaaatgtgacgatacacgcgcagagacagcccagggcagggagcagcaggaccctgccgcgggaagtggcaagcagctgcatgccggaactctcataatcccgctggctgcggcttttgcgaaacagcggcgtcgcggataatataagaacaaaaacaaacaaaatcagtaaaaaaataaggtctgacataagaaaactcctctttggtatgtttacaggttaccagaaaaaagtataacacagcgggcgtgcagcgtcagcagattttccggcgtattttcagattttgtatatttttccggaaaagggaaaaaaaacctgtgatatagtgaaaaatttaacaaagtggcaataaagtggagaaaaaggcttgaactttctatggaaattggttagaatataggaagcacggagccaataagcataagtaccttgtgcttgccggttccaggggatttatgcccggcgattacatttacaaattctaggaggaattaaaaatggcagtaagagtagcaatcaatggttttggccgtatcggtcgtcttgctttcagacagatgtttggagcagaaggatatgaagtagtagcaatcaacgatctgacaagcccgaagatgttagcacacctgttaaagtatgactcatctcagggtaagtacgagcatgcagatgaggtatcttctacagacgattccatcatcgtatgcggcaaggagatcaagatctacgcattcccggatgcaaataactgcccatggggagagttaaaagtagacgttgtattagagtgctccggtttctacacatccaaggagaaggctcaggctcatatcaacgcaggcgctagaaaagttgttatctctgctccagcaggaaatgaccttcctactatcgtatacaacaccaaccacaagacattaaaggcttctgataccatcatttccgcagcttcctgtacaacaaactgcttagcaccgatggcagacgctcttaacaaatacgctccgatccagtccggtatcatggtaaccatccatgcttatacaggagatcagatgactcttgacggaccgcagagaaagggtgacttaagaagatcccgtgcagcagcagtcaacatcgttccgaacagcacaggtgctgcaaaggcaatcggtcttgttattccggagttaaacggcaaactgatcggttctgcacagcgtgtaccgaccccgacaggttctaccacaatcttaacagcagttgttaagaaagccggcgttacaaaggaagacatcaacgcagctatgaaggcagcagcaaacgagtccttcggttacaacgaggatgagatcgtatcttctgatatcgttggtatgagatttggttccttattcgatgcaactcagaccatggtaaatcaggtatctgatgatcagtatgaggttcaggttgtttcatggtatgacaacgagaactcctacacatctcagatggtaagaaccatcaaatacttctccgagttagcataattgagagaaagagattgttctcggacaatcacgtgatagactcagaaaggggtccggtcttttatggaccgggtccctttttgacattttgcatattaaagggggacatggcatatgtcattaaacaaaaaatccgtagatgatatcaatgtaaaaggcaagagagtgctcgtaagatgcgatttcaacgtaccgctcaagaatggcgagatcacagatgagacccgtatcgtggctgcacttccgacaatccagaagctgatcaacgatggcggcaaggttatcctctgctcccatcttggaaaagtaaagaacggaccaaacgagggcgagtccttagcaccggttgcaaagagactttccgagaagcttggcaaggaagttgtatttgtatctgattacaacgtaaccggagaggcagctaccaaggcggtagaggctatgaaagagggagatgttgtattacttcagaatacacgtttccgcggcgaggaagagaccaagaacggcgagcagttcagcaaagagttagcagatcttgcagatgattacgtatgcgacgcattcggttcttcccacagagcacatgcttccgtagcaggcgtgacaaagttcatcagcgcaaagggcggttccaacgttgtcggctacctgatggagaaagagattgcattccttggcaatgcagttgagaatccggtaagaccgtttgttgcaatccttggcggtgcaaaagttgcagacaagttaaacgttatctccaacctgcttgagaagtgtgataccttgatcatcggtggcggtatggcttacactttcttaaaggcacagggttatgagatcggtaaatccttagtggacgacagcaagatcgactactgcaaggagatgatggcaaaggctgagaagcttggcaagaagctgttacttccggtagacgcagtgacaattgctgatttcccgaacccgatcgacgctccggttgaggttgaggtttgcgacgttaagaatatgccggctgacagagagggctgtgatatcggaccgaagacggctgagttatatgcagaggctgttaagacagcaaagaccgttgtatggaacggaccgatgggtgtattcgagaatccgacacttgcaaaaggtacgatcgctgtagcaaaggcactggctgagacagacgctaccacaatcatcggcggcggcgattccgcagcagcagtaaaccagcttggttttgcagacaagatgagccatatttccacaggtggcggcgcatccttagagttcttagagggtaaggaacttccgggtgttgtagcagcagacgacaaataaataacaaaatcctgctgtcgtgacggtacaaaacgtcgtggcagcagatacataaatgggatcattcttaagggaaagaggattttaaaatggcaagaaagaaaattgtggccggcaactggaagatgaacatgactccaagccaggcagtaaagttagtagaagagttaaagccgcttgtagtaagtgatgatgttgaagttgtatactgtgttccggcaatcgatatcgtaccggttgtagaggcagtcaaaggtactaacgttgcagtcggtgcagagaatatgtactacgaggagaaaggtgcctacacaggagagatctctccggagatgctggtagacgcaggcgtgaagtatgttatcatcggtcattccgagagacgtgactacttcaaagagtgcgactgcatgctgaacaagaaagttaagaaagcattcgagcacaatctgaccccgatcctttgctgcggagagacattagagcagagagagatgggcgttactcttgactggatccgtcttcagatcaaatcggacttaaaggatattaccgcagagcaggttgcttccatggtaatcgcatatgagccgatctgggcaatcggaaccggcaagacagcaacaaccgcacaggcacaggaagtctgcaaggcaatccgcgactgcatcgctgaggtatatgataccgatacagctgagaaggttcgtatccagtacggcggatctgtcaatgcaggaaatgcggcagaactgttcgcacagccggatatcgatggcggtcttgtaggcggcgcatccttaaaggctgactttggaaagattgtaaactataagtaatagtttaaaattacagggaatcaggatcgctgcggagcggtacgatcctggaacggggacccgcttctctctgcggtaacaggcggagagagacgggttttcgtgaaaatttgtaagtggtaatataagagaattttgagtgacagcggagaaaatgtatgcccaaaaagtgcaagggaaaaagaaatgcacttgtagtaaccgtggtggctgtacttctgggagatatttttgcaggaggacagaatattccggcacaacagaagacctggaatgccggagatacaaaacgtacgcagatgacagagagcgcaacacagagaatggacctgacagacgcatttgcagtgatattacaaggtgcgacgaagaaatttatcgcaggatatgcagtcgatgattcgtttttgatgtggctggctgccagatacggagatgagaaggtagtgcggatcgcgagtgccgttctggatggaacggaggatccggaagtctggtatgacattaccggcagctccatccatgtactgtggttgatgtattgcagggacagtggttttcagcagtaccggctgcaaaatgtatactggaaagaggccggagaggatggaaagatcgtgctcggctttgcgggtgacatcaattttgccgacgactggtatacgatggagtatatgaaccggcagacgaatggcatctatgactgcttttcggaggatctgctctcggagatgcagaacgtggatgtgatggtgatgaacaatgagttcacctacgcagagagcgggagcgtggaggcggttcccgggaaggcatatacctttcgggcagatccggaggatgtagaactcctctctgtttttggaacggatgctgtgacgcttgccaacaatcatgtgtatgattacggggaagaagggctgctgtcgaccttagattgtctgcggaaagcggacatcccttatacgggggcgggcgagaatcgaaaagaggcatccaagatcctctcttttgtgatcggaggcagaaagattgccattgtttccgccacacagattgagcgggcgaccaagtatacaaaagaggcgacggagacggaaccgggagtattaaagaccttgaatcctgccgcatttctggaggtgatccgggaagcggacgccacaagtgattatgtgattgtggaagtgcactggggaacggaaggcagtctgcacgaagaaaaatcccagcgtcttctggcggagctatatgcggaggcaggcgcagacgcggtgatcggcggacatccgcaccggctgcagggatgtggttttaccgatggtgtgccggttgcgtacagtctcggaaatttctggttttccaccgggacgctgtatacaacgcttgccaagattacgatcacagaggacggcgcggtgacactttcctatgtcccgtgtatacagaagggactagttacaagcattctgacagagcaggatgataaagacgggttttatcattacctggctgcaatttccgatgacatcggaatggatgcggacggtaatgtttatgataaaacagcgggggattatccttcgcaggtaatcgtgtacgattcggatacaagcaagacaaagatccgcggcacgacagataatgatgggtatgccatcgacattgttggcaaccgaaaataaagagagagggaagaacaatgagtaaaaaaccaacagtactgatgatcctggatggattcggattaaacgataagacggaaggaaatgccgttgcacaggcgaagaagccgaatatcgacgcactgatgaaggaatatccatttgtaaagggaaatgccagcggactggcagtaggtcttccggacggacagatgggtaactccgaggtaggacacttaaatatgggcgcaggcagaattgtataccaggagctgacacgcattaccaaagagatcaatgacggcgaatttttcagcaatcaggcgctgcttgacggtattgcaaatgtgaaggagaacaattctgatctgcatttatacggacttctttcggatggtggtgtacacagccatattacacatctgtatggtctgctcgagcttgccaagagacagggcgtaaagaatgtatacgtacactgcttcctggacggacgtgacacggctccgacttccggtaagggatttatcgaggcactggaagcaaagatggcagaactgggcatcggtaagattgcttctatttccggacgctattatgcgatggaccgtgataaccgctgggatcgtgtgcagaaggcatatgatgtgctgaccaagggcgagggagagaccgcagagagcgctgttgctgcaatggaagcttcctacgcaaaggatgtgacggatgagttcttcgtaccgaccgcgattaccgagaacggcaagccggtagcgacgatcaaggacaaagataccgtgatcttcttcaacttccgcccggatcgcgcacgtgagatcacaagaaccttctgtgccgatgaatttgacggatttgacagaggcgcgagaaagaatgtgaaatatatctgctttaccgagtatgatgtgacgatcccgaacaaggaagttgctttcaagaaagtggagcttaagaacacatttggcgagtatctggcagcgcacggcatgacacaggcaagaatcgccgagacagagaagtatgcgcacgtcacattcttcttcaacggcggcgttgaggagccgaacgttggtgaggaccgtatccttgtgaagtctccgaaggtggctacctacgatctgcagccggagatgagcgcaccggaagtgtgtgagaagctttgtgcagctatccgttccgaaaagtatgatgtcattgtcatcaactttgctaacccggatatggttggacataccggtatcattccagcagccatcaaggcaatcgagaccgtagatacctgcgttggaaaggcagtggaggcattaaaggaagtagacggacagatgttcatctgtgcagaccacggaaatgcagagcagatggtggattacgagacaggtgcaccgtttaccgcacatacgacgaatccggtaccgtttattctggtcaatgcagatccgtcctacacactcagagagaacggatgcctggcagatattatcccgacgttaatcgaactgatgggaatggagcagccggcagagatgacaggaaagtcacttctggtcagaaaataaagaatagaacgagaaaagcagtcccgggggaggggctgcttttcttgtgttaggattcagaaaacggggggaccgttttctggaacatctgccctggtggcagataaagaggagttatatgaaattagataattgcaaaagtagtgcttttgtcctatctacgcagttattataactctggtactaaagtacgtcaagggagaaacatgtattttttttaagacaaaatatgaattaggctgtgtgaacaagcctataagtcacgctaatgaaataatgaatatgtacaaaaatactaataaaaagaactcgattttctatatcgcagaaatggtgtgagcgggtaaaaacattgactttccaaaagcggctgtattataattttgaagtacagtgcagaaatagtctgcggaagtgggtaaagctgtaaatatcaacaaaagaagccgggaaggcttcggaaaagaggatgaaatgcaggaatttaagccggtaaaagagggaaaagtacgtgaggtatatgataatggagacagtctgattattgtagccacagacagaatctcagcttttgatcatattttaaagaataagatcacaaagaagggcgcaattcttacccagatgtcgaagttctggttcgattacaccaaagatatcgtgccgaaccacatgatttccgtggacgtaaaggatatgccggaatttttccggcaggaacgttttgagggaaacagcatgatgtgccggaagcttgagatgcttccgatcgagtgcatcgtgcgcggatatattacaggaagcggctgggcaagctatcaggagaacggcaccgtatgcggtattaaactgccggaaggactggtagagtccgacaagctgccggagccgatctacacaccgagcacaaaggctgagatcggtctgcatgatgagaacatctcctttgaggaaagcgtgaaagtgctggagaagatctacccgggcaaaggtgcggattacgcagcacagattaaggacaagacgattgctctctacaaaaagtgtgcagagtatgcattaagcaagggcatcattatcgcagatacaaaattcgagttcggtctggatgagaacggcaacgttgttctgggtgacgagatgctgacaccggacagttccagattctggccgttagagggatatgaagccggaaaaggtcagccttcctttgacaagcagtttgtcagagactggttaaaggcaaatccggacaacgatctgcttctgccggaggaggtggtagagaagaccgtggccaagtacaaggaggcatttgagcttcttaccggaaagccgtttcaggcataaaaagacagaatatcagattcgtagatggggaaatcaatgagcgataatagaatcaataaaaatcagccggtgggggatgaactgcatgaggagtgcggcgtcttcggaatgtacgattttgacggcggagatgtggcatccacaatatattacggactgtttgcattgcagcaccgcggacaggagagctgcggtattgcagtcagcgagacgaacggtccgaaagggaaagtgacctcctacaagggaatgggactggtcaatgaggtttttaccgaggagaatttagagcccatgcacggggatatcggcgtggggcatgtgcgctattcgacagccggtgcgtcgaccagagaaaacgcacagccgttggtgctcaactatgtcaagggaactctggcgctggcgcacaacggtaacctgatcaatgcggcggaactcagacatgatttggagtatacaggagctattttccagaccactattgactcggaggtgattgcctaccatatcgcaagggagcgtctgaaatccagtacggtggaggaagcagtggggcgtgcctgtcgcaagatcaagggagcgtattcccttgtggtcatgagcccgagaaagctggtcggagcaagggatccctatggttttaagccgctttgtatcggaaagcgcgataatgcctatatccttgcatcggagacctgcgcactcgatacgatcggcgcggagtatgtgcgtgacgtgctgccgggagagacggtgacgatcacgccggagaatggaattgtctcggatctgtcccgcgcactgccaaaggagcaggaagcgagatgcattttcgagtacatatattttgcaagaccggacagtcatatcgacggcgtgagcgtatatgcatcccgcatcaaggcaggacggttcctggcgatggattcgccggtggatgcggatcttgtggtgggcgtgccggagtccggaaatgccgctgcgctcggttattcgctgcagtccggcatcccgtacggaaccgcttttgtcaaaaacggctatgtgggacgtacgtttatcaagccgaaacagagcagccgtgagtccagcgtccgcgtgaagctgaatgtcttaaaagaggcggtggacggcaagcgcattatcatgatcgatgattcgattgtgcgcggaaccacatccgaccgcattgtaaaaatgctgcgggatgccggagcaacggaggtgcacgtccgcatcagctcgccgccgtttttgtggccgtgttattttggtacggacattccggagcgggaacaactgatcgcgtacaaccgcaccatcgaggagatccgggacatcatcggagcagattctctcggctatctcggaattgaccgtctgagcgagatggcggatggactgccgatctgcaagggatgctttaacggcatttacccgatggagccgccgaaggaagatatccggggagactacgagaggtagaaagcttcttaaaaatatagaagaatgtggcaggcagcagaaaagtttagattcgagggaaatgcagcaagcggcaggggcgccgggagcaaagggaaatgcagcaggtggcaggatatcttgaattttagaaaatgcagcaagcctatggataaaggtaaggagaaaaaatgagtacagacagatattcaagtccgctctcagagcggtatgcaagcaaagagatgcagtatattttttcacaggatatgaagttctccacatggagaaagctgtggattgcacttgccgagacagagatggagctgggactttccgagaacggaaagccggtcatcacgcaggaacagattgacgagatgaaagagcatgtgtacgacatcaattatgatgtggcaaaagagcgcgaaaaactggtgcgtcatgatgtcatgagccatgtatacgcgtttggacagcagtgcccgaaggccgcaggcatcatccatctgggagcgacttcctgctacgtgggcgacaatacggatattattatcatgaacgaggcgttaaagctggtgcacaagaagctggtcaatgtcattgcggaactggcaaagtttgcagacacctacaagaatctgccgacgctcgcatttacgcatttccagccggcacagccgacaacggttggcaagcgcgccacactctggacacaggagtttctgatggatctcgaggatctggaatatgtgatgagcactttaaagctgcttggatccaagggaacgaccggcacgcaggcaagctttttggagctgtttgacggggatcaggagaccatcgataagattgatccgatgatcgcagcgaagatgggattcaaggagtgctatgccgtatccggacagacatattccagaaaagtggataccagagtggcaaatattcttgccggtattgcagcaagtgcacacaagatgtccaacgatatccgtctgctgcagcacttaaaagaagtggaagagccgtttgagaagaaccagatcggttcctcagcgatggcgtacaagcgcaatccgatgcgttcagagcgtatcgcgtctctttcccgctatgtgatgatcgatgcgttaaatccggcgattacctctgcaacccagtggtttgagcgcacattggatgattctgccaataagcgtctttctattccggagggatttctggcgatcgacggaatcctggatctgtgcttaaatgttgtcgacggactggtggtctatgacaaagttatcacgaagcatatgatggcggaactgccgtttatggcaacggaaaatattatgatggacgcggtaaagaacggtggcaaccgtcaggagctgcatgagaagatccgccagctgtccatgcaggcaggaaagaatgtcaaggaagagggcagggacaacaatctgctggagctgattgcggcagacccggagttcaatctgacgttagagcagctgcaggcaaccatggagccgtccaagtatgtcggacgcgcaccggtacaggtggatgcattccttgcaaatgttgtaaatccggtattggagaagaatcaagacgaactcggcgtaaaggcggagatcaacgtataacagagaagtggctaaaaaacaggcaaagcaccgtggtgctttggcctgtttttttatggaactgtcccaataagcatatcatgtttgctttgataagtaatattataagaagaccacaccgtgggatttcagatggaaatgcagatggaaattcggttcaaaaaatatggaatttctaaccagccgaatgtctgcatcttcgatgatccatgtctttccaagtttggagcactccgcgggtcatgtccgcatcccggaagacaatttgtaggacttttgtgtgtcccttgcggcaccagacaacagatggcataaatgccatctttatgtcgaacaaaacataaccgcgcgaagccgctgtctgaggcggcatctgccatattttcaatagcagatgccggcgagttcggttcgcgcggttttatattgtctgtgaagaggtgccattagggacaccagaaagtccgcccattgtctccggtgtgccggacatgcacccgtcggattgtccaaacgtggaagcgacacggaatccgatgcagacattcagctggaagaaattctcacatttttctcaaacaaatattccatctgcatttccacatgaaatcccgaagtgtgtttctgataatattacttatcaacccaaagagatctatgcttattgcgacaattccacaaaaaaggcgcttccgattaacggtaatcgcccatataaaacagtgcaacgacgcctggacccgtgtgtgcgccgatggtcggaccgacatggttgatcagaaagctttcatagccgaaacggtctttgatgagatcagcaacatactgtgcatcttcgatgcagtcgccgtggctgatgaaaatgatgtcattcttgtcacgccagccgccaatttgtttttccatggcatccacgagagcaatcagcgactttttgcgtcctcgcactttggagagcggaatcagatgtccctcatcatccacatgaagaagtggttttaaactgatcattgtaccgagaaaagcagcggtttttgacacgcggccgccgcggtagagatgaaacagatcattgacggtgaaattatgtacaaggtgaagtttgtttgactcaagccagtctgcggtctcttccagtgtatgtccctgctcctttaaggtgacggctttgtgcaccagaagtccctcgccgagagaagcgcagagagaatcgatgacgatgattttccggtcggggtatttttcggaaagttctcccgtagcgagccttgcgctgttgtagcttccgcttaaaccggaagaaaaggcgatatgaagaatatcggcattctgttcgttgattattttttcaaaaacagcggcagcctcctcgggattggcctgggaggtcgtgggaagagaaccctgacgcatgcagtcataaaattcctttaccggaagcggatgctcccaagaataagtagtatcgttaatcgtatatgtaagagaaagcatgccgatctgatgctgttctacataggcagccggaagatcggatgtggtatcggttgtaatgataaaattattcataagacctcctgatacatgtatttgtatttattataatggaagcaatgcgaaaagaaaagtttccggtagtaatttctaaaaaaaatataaatttgaaaaatgctatttacatatgtaagaaaacgatgtaaaataagcacatcttttatcaaatagttggattttatccacatttctaagtatcacgctatatggaggcagtttcatccataattccagtaaggacaatcacacagcacagagtgaagtgaggaacaaatgaatattgtattttggggagaaacacaccggagcggtacgacggcgaactatactgcaatggcaggcattttgccgcacttatgcccggacaggaagattgtgtgcggcagcctgcagagggagcgatgcgaggattcggcactctttttgtgggatgcgggagtgtgcagtccggcgggtcaaaagaagctccttttgacagcggatcttgtggtggtaaattttgaaccgcaggattacgacggaatggagcagttctttttgcgccatatgtatctggagaagcgcatggtgtatctgtatgccaactgcatcgggacaccggagccggatgtgctaaacagagtatatcgggtggatgaggggcagattggcatcgtgcggtacaatgcagcgtatgactgtgcattgaagcgcggactgggcagctcttttatagcggaggaatacgggtctgcgagaagcagcaggaatcaggagtttatcgatggattagtaaaagcggcggatcgtattttaagggaggtatgtaagatcgataaaaccggacatgtttggtaaaagaaaaagacacaacagaagggtgaaggaggaaattattatggaacaggtaatgaaacattatggaaatgcaatccttgcaattattgtattgcttgcactcggcgcaatcattattgcggcgctctcctcggacggatatgtggcgacggagttcaagaatgcgctgacgggattcttttcccgcatgaatggcttaacgccatagggaggatgacatgggggagatcatgacgtttgaaccaacggaagcgcagtttggggttttctggaaatatctgcagcgcccgaatgttaccgatgtggactacaacggaagcgaattgtggattacggacttaaagatcggaaggtatcgtgtaaaagagcatctgtccgatgcatttatcagcacttttacgcacaatatttccaactgcgtgaatcgtcagttcaataatgccaataaggtgctggaggctgataccagagaactgcgtatcagtattatccatgaggcggcggccgcatccggcaccagtatctgtatccggaagtcgccgagcatggtgcgcatgaacattgagagaatgctggaagaatcctattgcccggaacggattttacagcttttgatgaactgtgtgctggcgggcatgaattttgtgttcggaggagaacccggtgcgggaaagacggagtgtgcgaaattctttatgcagtttataccgcgcgaggagcgggtaattacgattgaggattcgctcgagatccattaccgggacatcaatccgggggcggatgcggtggagcttcgtgtcggagaagatttttcctacacggatgccatcaaggcgagcctgcggcagaatccgaagtggcttgtcctctcggaggcaaggtcggtggaggtgacgtcgctgctcgagcagtggagtaccggcgtgagcggctttacgacgatccacctggatgatgtcagaaagcttccggaccgcattcagaatatgatgagcgatgcgcgtgacgcagagcgtatggagaaccggatctaccgctatgtgaatgtggggattctgatccgctgcgtcagacagccggacggaaagatccgaagatatatggatcagctgtgtttttacagcagggagcagtatgagaatcgtatttatatgatactggaggatggggaactgctctcggaagagcttccgcctgcgattgtgagacgccttggacaggcgggaatagaggatccgttttgctgcgcacactggcagagatacaggagagagggaaaatagatgaaaagagaaggactgtgggagaaactgcggctgttgaatccgaaaaatctgcagcgcgaagtgcatgtgtacggttatcgtttttcgtggaggacgcatcttatggcggtgatagccgctctggttggaatcggtgggattggaatggtgtttcagctaaaaccgctgtttttggcaggggtgcttttgacagtgcttttcgtattcccggtactggtacttgatatgtataagaaaatgtatgagcagaagcgttttggagatgcatgtgcctacatggaacagctgctctatgcgtttcagaagaccggaaagatcgtgagtgcattgaaggaggtgcgcggaatttttggggaaggacagatccgactctgtgtggaggaagcgattgcgcatatggagtacgggcatccggtcggagagcagggcgttctgcgtgagggtttacagaaaatcgaacggtattatgcctgtgataagctggcgacggtacatgaacttctactgaatacggaggaatatggcggggatgtggaggcatcggtcacgcttgttctggaggatattgagcggttcaaaaagcgtggataccagcttcaggcggagaagcggaagagtcatacagataatgtgatttccattgtggtggcagtgctcttgtgcgcggctgcattgtatcttttaaatgagatgcaggagatgtttacatcagaggctgacgtatcggtgtttaccgttcctgtgatccagatatcttcgatggtgtttcttttgttgctgcttgcattttatgtgaagagtgtcagaagcctgacggctgactggctggaggaaaagccgctgtatgacacggcatatatcagacacagctatgaactggtaatggggtatgaaaagaaagcacagcagtatcggcgcctgattcctgcaggaattgtgactatgactgcgtttgtgttttggactgtgggatggcgcattgcgggaatactcctgctggtgactggtttactggttgcaatgcagccgagaatcagttaccgcattgccgagcgggacgtgacggcggaattgtatcaggtgctgccgcgctggctttttgagatggtattacttttacagaacaataacgttcagatggcgattacaaaatctgcacaacatgccccggcggtgctcgggagcgaacttgcggagctttgcgcgagaatggacgagcgtccggatcaattacagacatacacggacttttgcaaaaagtttgatctccccgagatgttaagctgtatgaaaatgctgcatgctttttctgaaaacggaacaggagatattgatgtgcagatgaatcatctgattgagcgtgtggttctgatgcaggagcgcgccgatgttttgcgcagtgaagagcgtgcattccggatgaagttgatttttgcatatccggtgctggcagccactggaaaactgctggcagatcttacggtcggaatggcgttgatgatgcaggttcttggaggcatgggaggtgcgtgagtgaaatatatcatagaagtgttcagtgtgatgctggtgctggtttttaatctgctgctgtgcatcagtatgctcggggtgagtgccgatgtggcagcggcgaaggaatttaaagctgcaatgattgcagaaattgagaacagtgactttaatccgtacgtgattgatggctgcaaggcgcaggcaagaacagaagggtacgaactggaagtgcagtcctacacctacggtggacaaagcgaccgcaggattgcggggatcaatctctattatagataccggataccactgttaggggtctcgcagcagcgggtgacgagaggaatcgcacggtaaaaggaggagcaggatgcaatggagtctggaagaacttggaatgacaatgctggtattgctggtgggctggtttggatgcacggcaattcaggagatatggatgcaggtggctggcatgctatagggggatttcgtgcccggacgtgtcagagaaaaggagcgtacagatgaaagagatcgcagaggtttatggcaatggatttttgcagattgcaggcggaataggggcattgctcttattcttccatgccgtggatgggcaggggatgatcggtatggtcctgcggtattatatgacgggaatctgtgggagttaagtgtccaacaggaaaagaacagaggtgatcagatggagcaggtacttcaatgctatggaaagggaattgcggcaggaattgtgctgatagcagtcatggtactgctgtttgcaggaattcgtgacgagcagggcaaccggggaattattaacatcgtaaagacatggataccggaggaagagacaatcacagaaaacgctgccattgacgcttttgcggaggcgggggaggtggcgtaccccacgatccggtatgcgtacaatggtatgctgcacaggggagcatatctgccgggagacttattttctgcggtagacggaatgggagaagaacggagtgttttgtggtgtgagatgacagatccgcatggaaacagctgcacaatagaatcacagcaaggtgaggttgtgtttgatgtggaggggatctatacggtgcgggtctgcgcgacagacgaagcaaaccgcagaagcgtctgtgagtttcagatacctgtgaaccgatgagaagacagaaagccgggaaaggagatatatgtgaaaaatgcagcgatgatcattgtcagtgcaatcatgggatttctgatactcgggattgtgctgacgattggcggaagcatgaaccgcagatgtgaggcggagacgattcttccttctgcgatggaaaagacgattgagggaatgacgcttgcagaggaggattgctcttccggggaactggtgttggcagagtgtgtggaacttctggcggcggaaatcgatacagactccgatgtggtgttggagatctatcagaatgatgttcaaaagggggtattgtcgatgaaattggaggaaaagtttcgacatccgaatgggatggaaggtacggcagaggcggtcagaacaatcattcgggaaaagaggaagaatgtatcaaaagagcagtaccgggtgcggttttaccggaaccgggagggaatgctcggggagggaagttgttataaggcatacactgtggaggagggacaatgtctgcagccaccggcagatccgggaggcaatggtgtggtatttgccggctggcatgactggaatgattacgcggcggacttttcacagccgatagaagaaaatcgtgattattatgccgcctgggaatagatatgggaattgcagggaatacggcaaatgtgtatggtgcagatcgtggcaccggatcatgacaggcagttgtagactatattatcaatgcgatgatacgatctacagagagaatcggtaaaaagagggttaactggaagtgatagagggaagcattaaaagcgtagctgagattataaaaatatagaaaaaacgtactgtgtagtgtatactaatgtagtagtagatatgcctctttaaaagcgaacgaaagtgttgatttgtatggcaagtgttcaaagaattggattcaagtgaaaggagctatgagaaactggtggaagcatttatgaatgaagttttttaaagggaagcggcaaagacagaaaaggaaattataagaatcagggagattagtttatgaaaaagaaaagcgtagtagtattattaacagtaacaatggtgacagaaatgacagcagcaggttgcggagataagcagcttgcgcttgcaacagatagggtaagtgtcgaactggggtatgagcttaatacggatgtagcggcttatgtggcggatgcggatatcgcagtggagacaacaattgattttggggcggttgatgtaagtaagcttggaacttatacggcagtggttacttataaggatcagacagcgtcccttgaagtggacgtagtagataccacagcgccggaggcggaggtggtgaatcaggttacagtcggtgtggacgagccattgtacgtggaggatgttttaacgagtgtaaccgagctgaccgggaatgtaatggcaacatttgacgatctggcagatgagtctaccgatgccaccgagaaagtagagaccactgagggtgtagaggctaccgagggtgtagaggctgccaaggatgtggagaccactgaggacatggaggtcaccgaggaagtagaggccaccggagcgtcagaagatatggaaacatttgtgttagacgatgtaacggtaacaaatgacgcgatagtctttcatacagtgggggagtacagtgtaagcttaacactcgcagatgagagtggaaatagcaagcaggtagaagtgccggtactggttggtacagaaccgacatttttgggaattgaggatcttaccgtaacaaccggagcagagaatgtggactatctttcgggtgtaacggcaacggacagcaatgggaatgatctgacagataagatcgaatgtgatgacagcaaagcagacctgtctttggcaggagagtacgagattacttacacggtaacagatgagaacgggtttactgcaaagcagactgctaaggtgacagttgcagatggaaagacctctaagaaggataccaaatctgctacaacaaagtcggagacaacaaaggctgaaaccggatcaaccaacagcagtgctacaaatactggaagcagtaatactggaaatagcaacagtggaacatctgaaagcagcaattccggaaatagcaacagtggaacatctggaagcagcaattccggaaacagtaacagcggaacatctggaagtagcaattccggaaatagcaacagtggaacgtctggaggcagcaacagcggaagcaataataccggaagcagcgagaatggaagcacaacgccgagtggtgacagcggaagtaccgacactggaagctccacaccaagtgcagacactggaagcaacaacggtggaaattcaagttcagatggaacgatgtcagttccagatgattttatcccactagatccgtcacttggagataactccgggactggcggaaatggcgggggaaattccacgatcacatttaattagatataacggaggataattatatgtatagtgagcgcaagctcagatacgacagaagtacaatatataagattattttatgcgtattgtttgtgataagtgcgttattattttctgataaagttatggcgggaacattggcagaaggcgcggcaagtgagatacaaaaaaatgtatttaatgttttgccagtaggacaaaatgatgagaatactacggtaggcagatatgctttgaattacacgggcaatataaatgtctattcctcaccgtcaccgagatatgatgatgaatcttattgtagtcagacgttactgggatggtctaatagttcgatggcgacgctacatggtgataataacacgactcatattgtaaaagcatatttgatatgggaaactcggaagagatataacaaagatgatagtaatgcaaatcatgtaacattcatcatgcacgacggaagatcaggagcaaacatttatcctgattgggtctatgtagacgatcgcagttcgcggtatgtttctggatgggagcagtcccgcccccgaatttactgcaacgttgcggatgtaacaactatcgttaaaacatacgggtatggtgattactatgtagccaatataccggtatgccgtgcatccgatctctgggagcaggatacgggaggcggtggaacgccgaccggttggcagctgattgtcgtggaggaaaatgcttcttatccggtacgtgcggtgactttaagtgtgggatcgagattccggttcggagatgttgattgggagggcgatgattatggtttcgatcctgtctccagagcaactgttacgatgcaggcagagttgtttgatggtttaaaaaccaaagaatacggagacgtgacaggacagatactttttggatgtatcgatgcggcgagggttacggaaaatcccaaacggatatccatgtttacacaacaagctcgggatagtgaaaaaaatgtaaagaacggcgggactgtaatagaggggctttaccgtgatggatcactattttgccaacaaacggatatgtgctccgttttgtataacgtttcgggattatcatatggtgcgacagtgtttggggtggatgttgccaatgtccgttgggatacccagctttacatcggagcggcggtagacattgcttttccggagtttgagtcgcagcagacaacaagtatatcggatggaaaggttatcgtaaaagggaagattgaaaatacatctgcacaggatgatactggtctttatgacggcgaactgacggtgacgctggatccgaatctgactccggatctgacgaattacagcattgcggtaaatggcaatattgtgtccagtgctactgtgaggcagggtacggtgacggatgcggacgggacagtacataatacggttatcttttctggtggtggcatatcaagttggtttaagggagataagattgagtatacgatctattgccggatcagcggatccggtatgagtcggtttgataacagggatcaacttgatgggtatttaaaatctgcaggagttgacacgggacactggatcgacaaagcatgcattgcatccagctggtgcaatgctttattccgagttgatctgattgcaggaaatggaattcagagtgtcagtggtgtacgcaattatatgtctggggcagcggttacaattgatgcggtggtaaaaaatggttaccattggacgggatggactggcacgtatgagacggatagaaagcagtatgcgtttgccatgcctgcacaaaatgtgcgaatgactgcaaacgcgcagattaaccactcaactttaaaagttgatcccaatgggggaacatggcaggaaagtaccgctgtgcagagttttacggagcactatggaacggttaaatccattccgtatccggtaagaaccggatatactttttcaggctgggtgaaatcggatccatttaacggtagtctgaacaatgcggtgtatacgtttggcgcagaagatgatgcgacagatgttctgacggcgtcttggacagcaaacagctatacgctgcattttgacccaaacgatggcaaagaacaagcgccgattgatgatataacgatcatgtacgatcagaatgtgacgttgccggatgttacgggacgttatatccgctatacgttggacggagaggatatcacgcagcaggtattagacggcacgattgttttggatgattctggcgtagtggttatggtgatggatgcggatacgggtctgatgatgacaccggcaggtggcattataaatgaggatggaagcatcacgaattcagatggaagcgtagcagatccggaagtagtagaagcggatgcttccagtgaatcgacagaagtaccggaggaagatgcaacagaagcagaagcggatgtggaagaactggaagttccagaagaatcggaaactccggctgctgatccggtgtcggataaaaaggcatatgcggctgtttttatggggtggtcgctcgaggatgggcgcgatagctttataccgcaatggacagcaggaatgcaggtcagtgtggcggatctgatagaagcatccggcgtggcagatcagaacggtgcgatgatcacgctgtatgcgtcgtgggatgactgtccgtggattgttgccacaaatctctactatacactggagcaggcgaagcaggggattatcacagacagtgagattttaagccatgcgactgcatcagatcgtgaagatggaagcccgatcgaggcaggatttcatgaaaatggaacatctttttcggtcccggattatcaggcatcggattttacgcagtttttgcgtggaggaagctgtacggaaaatctcacggtagttgacagcgccgggagtatctattgtaagcagataacggtttatgtggtggatacaacgcctgcagatgtacgaacggagagaacgacacgctttattgatgaaaaatattacggaagttcttatgaacggggagggcttttggatgattcgatctggaagacggatactgcgtacgtgtctgcacttcggacggcgtttggaaatctggaaaatgatgcaccggttgaaacctatatgattaacggtgagacgcgccggaagatccgcgaatatgtggatgcgcacggattcggagacaacagagaagccggagcattacaggaaatgtatgatcggtatcttgtgccaaattgtgtaagatgaaaataaaaaacagccggcaggcgtttcctgccggtcggctgcaactctttcgttcttctgtgaggaagagcggagaggatgttccctaatatattcttgttgattacggacagcccttacgtgtgttcttctgcatctgagaccggagcttccggcttcttgatatagatcttttcaatccggtttttatccatctgttccacacgaagcaacacatcatcatcggtaataatcacttcgttcttttccggaaggtgatccagcagaccgatgaggtagccgccaatcgtatcataatcctcggatgtaaaattcaagccgatctcatcacagagatcttccaggttggtggagccgagaaccatgtattcacggtcgctaagctggacaatcggatcttcttcgtcagtatcgtactcatcacggatttcaccgacaatctcttccagaagatcttccagcgtgatcagacccgcagtagcaccatactcatccagaacaatggcaagtgagatagaggacttacgcatttccataaacaattctgcagtgttcttgtgctcgtatgtaaaatacggttcacgcataatatcacgaacagaaaaatgatccttgtcgtgacagagaagcagatctttcatattgaggataccaatcacgttgtcggtcgtatcttcatagactggcaaccgggtaaacttatcctcctgaaaaatctgaatcagctcatcgtaggaactgtctacctgcgcaaaggtcatatcgattctcggaatcatgacttctttggcctgtgcatcgccaaaatcaaacacattgttaatcatggtgtgttcttcagactcgatgacgccggattccttgctgacatccacgattgtgcgcagttcttcctcggtcatcttctgggtatcggcattcggatcaacgccgaataatttgcagatgcggttggcaagcttattgatgataaaaatgaccggagtcagaattttcatcagtacctcaatcacatttgcataggtgagagccagtttctcggaattgaccgtcgccagtgtcttcggcgagatttcgccaaaaatcaaaatgagtacggtaaggatgccggttgcaatacctgcacctacactgccccagatcttgattgccagagaagtggcgagcgaggatgccgacagattcacgatgttattaccgattaagattgcagaaagcatttttccggaattatttgtgatgcgaagaactgtggcagcgcgtttgttcccgtcttctgccagggtacgcatccggatgcgattgacggtaattaaagccgtctctgcggatgaaaagaatgcagagagcataagtaagagcactaagaaaattatttgaaatatgtcacttgaatccaagtatgttcacctcattaaatagcaggatgcgcacagatgtatgtgccatgcctttggttaatagtattccggcacacagggcgccggaatacaaaagtgtaatatgaatgacattatataaagaaaatgtctattcgtcaatactgtagtttggagcttcctttgtgatgtggatgtcatgcggatgactctcacgaagagcagcagcggagatttttacgaacttgctcttttccttgagatcctcgatcgtcgggcagccacagtaacccataccggaacggataccgccgaccagctggaaaacagtgtcctccacattgcccttgtaagccacacggccttcgacgccttccggtaccagcttcttggcaccttcctggaaatagcggtctttgctgccgttctccatagctgcaagagaacccatgccgcggtaaaccttgtattttcttccctgatacaactcgaaagttccgggagcctcatcacatccagcaaagatacttcccatcatgcagacatttgcgccggctgcgagagctttagtcatatcgccggagtatttgataccgccgtcggcgatgatcggaataccggcttcctttgcaaccttatagcagtccatgatagcggtaatctgtggaacaccgatacctgcaacgatacgggtggtgcagatagaaccaggtccgatgccgacttttaccgcatctgcaccggcagcgattaagtcgcgtgttgcttctccggtagccacgttacctgcaatgacctgcagatccggataagcggtcttgatcttcttgacagcctcaaggatatttctggaatgtccgtgagcggaatccacaacaatgacatctacgtgagcctttacgagagcttccacacgttccatcatgttgccggtaatgccgacacctgcaccgcaaagcagacgaccctgctcatcctttgcggagagcggatacttgatctgtttttcgatatccttgatggtgataagtcccttcagatgaaaatctttgtcgacgatcggcagcttttcttttctcgccttggcaagaatcttttttgcctcttctaaggtaatgccttcaggagcagtgataagaccttcggaagtcatactttcactgatcttcttggaaaaatctgtctcgaactttaagtcacggttcgtgatgatgccgacgagcttgttattctcgcagatcggaacaccggaaatgcggaatttgcgcatcaagtcttcagcatcctgcagtgtatggcttggagaaaggaaaaatgggtctgtgataacgccgttttctgaacgttttaccttgtcgacttcatctgcctgagcctgaatggacatatttttgtggataataccgataccaccctgtcttgccatggcaatggccattctgtgctctgtgacagtatccattgcagcactcatcatagggatattgagcacgacctttttggtaaggtgtgtcgttaaattaatcatgttcggagttacttctgaatactgtggaaccaaaagcacatcatcaaaagtaattccttcaccgataattgttcccatttttattttcctcgctttccttgtataaatgtttgttaaaaaagtatattagtttctctataatagcaaaaaaaaatgtgtgtgtcaatgtggtataagtgtcagttgataaaaaaatatattgataagttagactaatatataaaaatattcacaaacggacagatgtgtgctatgatggcagtgggcgacggagccactgttatagggggtacgttgcctaaatttatattacgagagcagtgtataaggaggcagtatggagtttcgtccctgtattgatatacataacggcaaggtcaagcagattgtcggcagcagtcttgcggatgagggagaccgggcagtggagaattttgtcgccggagcggatgctgcgtattatgcacatctatataaggaagcgggacttcgcggcggacatatcattctgttgaattcgcgagacagtgcgtactatgaggcgacaaaggcacaggccatgcaggcgcttgcggagtatccgggcggacttcagatcggaggaggcattgatgccgcgaacgcaaagcagtttctggatgcgggcgcaagtcatgtgattgtcacctcctatgtgtttcgtgacggaaaaattgactatgaacggcttgcaacattgaggaaaaatgtcggaaaagaacatctggttctggatctaagctgcgcaaagcgggcggatggttattatattgtgaccgatcgctggcagaaagatacgagggaacgtgtgacaacagaacttttggaacgcctcggcagtgagtgtgacgagtttttagtacatgcggtcgatgtggagggcaaggcaaacggtattgagagagaacttgcaagtctgcttggctcctggggcaggataccggttacctatgccggcggagtgcgggactttgatgaccttgcacttttgagagagcttggatgtgacaggctgaatgtgacgatcggaagtgcactggatttgttcggaggatcgatgccttttgaaaaagttacagaatattgcagacagcaggagaagaatcgcgacagtgagaaaagatcacggcagtgaggaaggaacgtgacagtgagaaaagatcacggcagtgaggaaagaccgcgacagtgagaaaagatcacggcagtgagggaagatcatggcagtagaagatggaggagaagaaaatgagcaagtacacaaagcaggatattatccgaatcgtggaggaagaggatgtggagttcatcaggctccagttcaccgatatgttcgggacactcaagaatgtggcaatcacgttcagccagcttgagaaagcattgaacaatgaatgtatgtttgatgggtcctccattgagggatttgtgagaatcgaagagtcggacatgtatctgtatccggatctggatacgtttgtaatctttccgtggcggccgcagcagggaaaagttgccagaatcatctgtgatatttataccgcagaccgcaaaccgtttgagggagatccgcggtatgctttaaagaaggcggtggcagatgcggaatctatgggataccgttttgatgtcggtccggaatgtgaatttttcctgtttaatcaggatgaggatggacagccgacaacgatgagcacggagcgtgccggatattttgatctgggaccggttgatctcggggagaatgcaagaagagatatggtgctgacattagaggatatgggctatgaaatagaggcgtcccatcacgaggtggcaccggcgcagcatgagattgactttaaatatgacgaggcgttaaaaacagcggacaatatcatgacattcaagcttgcggtaaagaccattgcaaagcggcacggcatgtttgcaagctttatgccaaagccgaagtacggggtgaatggttccggaatgcatgtgaatatgtcgctttccaaggatggtcggaacatttttgacgatccggacggggagaacggactgagcagggaagcttactggtttatcggcggcattatgaaccatatgagagccatgactgcaattaccaatccgcttgtcaattcctataagcgtcttgtcccgggatatgaggcgccgatttatatcgcatggtccatgacaaaccgcagtccgctgatccggattccggtatcgcgcggcagcagaaccagagtggaactgcgctgcccggattcggcagcaaacccgtatcttacgctcgcggtgtgtctggaagccggactggatggaatccgccggcagatcgatccgccggctgccgtgactgagaatatattcgagatgcggctgtcgcagattaagaagcagggaatcgaatcacttccggcggatctgggagaagcggtcgaagcatttaaggcagatccttacattcgggaagtacttggcgaacatatcagcgagaagtacagcgaggcaaagatggcagagtgggcagattatcgtgcgcaggtgacaggctgggaaattgacaattacctttataaaatatagagcctggatgcaaaggggatagaattgacaaatattattgttgcatttcccaaacaggataatgcccgcaatatcaaaaaaatactgatgcagaacggtcatcatgtcgatgcagtctgcagcaccggagcgcaggtgttacagagcgccggtgaacttggcggcgggattgtcgtgtgcgggtatcgttttgtggatatgatgtacacagaactgcacgaatatctgccggtacaatttgaaatgctgttggttgcgtctcctgcaaactgtggaaaccgggatgtggagaatctggtctgccttgccacgccgcttaaggtaaacgagctgttagatacggtggagatgatggaatataccatcaccaggcgcagaaaaaagttgaagcagattccgaaggagcgcacgaaggaggaacaggagctgataaatgaggcaaaagcacttctgatggaacgtaacaatctgtcggaggaagaggcgcatcggtacatacagaaacgcagcatggataatggaaccggtctgacagaaacagcccagatgattttaagtttgcttgcctgatgagtgagagagaggattgccgcagatgcggcggtcctttttttgtaataggaaatatcgttcctgttatacaaaaacgctccgcggggatgcatacccgtgcgaataggaaaagtcgcagacaggagaattttgtttaccgggaatcaaaaagtgcttgcggattggatttaagtatgagataatgggtgacagagagtggcaatgcgttgtgtcgttggcgacattttgaaagagaacgaattctgtatggaaggaataaggagagagacatgtacaagatcaatgataattatcagaaacttccgggaagctaccttttcagtacgattgcaaagaaggtaaatgcctacagcgaagcaaatccggacaaaaagattatccgccttggcatcggtgacgtgacacagccgattgcaccggcaattattgaagctatgcataaagccgtcgatgagatggggcatgcggagacttttcacggatatgcaccggatctgggatatgaatttctgcgcagcgcaatcgtgaagaacgattatcaggcaagaggatgcgatattacggttgatgaaatttttgtatcggacggagcaaagagcgattccggtaatattcaggagatttttgcacagaataaccgcattgcagtgtgtgatccggtctacccggtatatgtggattccaatgttatggcgggacgtaccggtacttatgatccggagacggagatgtggagcgatgtgatctacatgccgtgtacgatggagaataattttgtgccggagtttccgaaagagacaccggatatcatctatctgtgtctgccgaacaatccgaccggtaccaccatcacaaaagatcagctgcagggctgggtagattatgcaaataagaacaaagcggtcattatttacgatgcagcgtatgaggcttatatttcagaggaaaatgtggcgcactccatctatgagtgtgagggtgccaagacctgtgcgattgaactgaagagtttctctaagaatgccggttttaccggggtgcgtctgggttatacggttgttccgaaggaattaaagtgtggtgaggtatcgctgaatgccatgtgggcaagacgtcacggaaccaagttcaacggtgcgccgtacattgtgcagcgggcaggagaggctgtttattccgaggcaggaaaggcacagttaaaagagcaggttgcttactatatgaagaatgcgaaagcgatcaagcagggattaaaggatgccggttacacggtgttcggtggtgtgaatgcgccgtatatctggctgaagacaccgggagagatgacttcctgggaattctttgacgatctgctcgcacgtgccaacgtggttggaacacctggttccggattcggaccgagcggtgagggatatttccggttgacggcattcggaagctatgagaatacactggcagcgttagagcgcattaagatgctgtaggaacattacaacaaaaagcattagacagaggagacatggcgagtgaagaccgtgtctcctttttgcaaatacaaagaacgccggattgagaaaatttgctgacgggtattgtgtcaaaggattttaggaaaggtgtctgttgatttcatgagaggagaattaagtgctgtttcattcgttttcattccttttgtttttccctctggtgacgggaatgtattttctgataccaaagagggcaaaacagttatggctgcttgtggcgagctattatttttatatgagctggaatgtgcagtatggctgtctgattctgcttgtgaccgcaatcggttatggtggcggacttttgctggcacaaaataaagtacgacaagggaagagacgtctggcggtgctgaccggcagtgttcttctgtgtgtcggaatcctcttttttttcaaatattttgcttttgcagtgcagaatatcaacgaattgctccgtgcggtgggaagcgtgcgagcgttaagggtgcccgatctcattcttccggtcggaatatctttttacacgttccagaccatcgggtacctgatcgatgtctggaaagggaagacagaagcggaaaaaagtttcctgcgttttgcgctgtttgtgtcatttttcccgcagcttgttgcaggaccgatcgagcggagcagcagtctgcttgcacagctgcgggagccggcagagttcgactatgacagggtaaaggacggactgcttctgatgctgtgggggtattttgaaaaaatgtggattgcggaccgtgctgcgattctggtcgatcaggtctatcaggattaccggaattattcctccggcatgcttgtgtttgccacggtgctgtttgcggtacagatctactgtgatttcggcggttacagccatattgccatcggggcggcgcaggtgcttggcatccgcctgatggataatttccgacagccctattttgcagtgaattgccgggaattctggagacgatggcatatcagtctctcgagctggttccgcgactatctgtatttcccgctgggaggaagccgcggcagcagtgggagaaccgctgtaaacctgatgataacatttcttgtcagcgggctctggcatggcgcaggctggcactatgtggtgtggggagcaatccatggaagctatcaggtggcgggcagaggcatcagatatgtaagtgaggccgtacaaaagagactaccggagaaaaagatacgctttttttcggagaaaacgcggggactgacacgcgctgcccggatttgtgtgacatttattctcacggattttgcgtggctttttttcagggcagatcatctgggacgagctgtggcgatgcttcggcggattgtgcaaaatggcaactggctgggacagttttccgatggcacattatttggcatggggctttgcagactggaggtgtgtcagctggcacttgccatcggagttctgcttgtagtggatatcctgcatgaatccgggatttccatacgtgcctggcttgcaaagcaggtgcttgtgattcgttggagtatttacatgctggttcttctgggatttgtcgtgctgttgctgcagaattatggaagagcgtcggtggagtttctttattttcaattttaggaggaaggcatgaagcgttttacaaaaaagttgatcgcctttttgggaatatttgcggcagtgcttctggctcttgatttgttatcagcgacggagagatttcgcggtgcgtttgccgtgttgacagacagcagcggttacgaggaggaagccgagcgggaagtgtctgcgtatcttgcaaagagcagaatgccgggcagttacacgaagctgctggtcggtgacagtgtctgcgcacagatgacggaagcgttttttgattgtaatcaacaatactgtctggtcggaaataaccgcgcgctgaccatggcaggggaatatcttctggtaaaagaatttctggagacgcatgagaatgtctcggaagtctggctgatggcaggaccggatctgcttcagacatcgatcgatgccacatacagctattcttatgtggttcttccgtttttgcaggcggatctgctggacgaacttgacgaggagaccgcagaggaaatggaggagacgttcggaagcctttttctgaaaaagccggtggcagaactaatcgccggttcggcggtaaaccgcaagttgtatttgaattacgtgaaggagcgggaggaggcgttggagaaaggggaaagcagagagaaccagacagtcggcatgtctgatctggcagagcgctatctgcgaaaaatctatgaattgtgcgacgcgcagggggtggcatgctatctgatccccgatccgctggcagatacaccggcgcgccgcaagcaggtggagcagatccggcaggattttgaaacacggggattggagcggcttttcccggattatttttctgaaattacctattatccggcggaccagttttcggacggaattcattttggcagaccgtacaatacaaaggaagtgtaccgcgaaaaattaagagaactgtatctggacagagggtatctggatggatttcaaatatgagcctgaacggagtctgcttcctgttttgtgtagaatgcagcacaaagaatggatggaattatagccgggcagcagtgtggtgccaaatgtggcactcgaaagaaatacgataaaaagcttgacaaaacacgatatcaatgtataatacaaaatgcaaatgagttgcaaatgcatacaaattgcaaaaacgaatgagttgcaaatgtgtgcggcatgcaggtgggataacgcattgggaagcgctatgacagtgcccgggaggaatgattttatgctggatgtattattggatacagtgcttgacagtgtcaggcttttgccgtttttatttttgacttatctttttatggagacattggaacatcatacgggaagcaagctgagccggaagatacagttcgccggaaaatggggacctgtgtggggcggtctgctcggtgtgattccgcagtgcgggttttcggcagcggcatcgagcctttttgccggaagagtcatcacggtcggaactctggtcgctatctatttgtccacttcggatgagatgcttccgattctgatttcggagtcggtgccggtagtgacgattgtgaaaattcttggcagtaaggtgatcattgctgtgctgtccggtctgattgtggaactggtatatgtgagactcttgaagaaacaggagaaggagatggatattcatgtcgtgtgtgaggaggagcactgtcattgcgaggatgggattgtggtttccgcgcttaagcatacggtaaagattttctgttttattttcctgatttcactggtattaaacggtgtgatcgggctgatcggagaggaaacgctggcgggactgttttccggacttccggttgtgggagagctgattgctgccctcgtggggctgatcccgaactgtgcgtcgtccgttgtaatcacacagttgtatctggatggaattatccggtcgggcgccatgatggcaggacttttggtgaatgccggtgtgggatttctggtgctgttccggctgaaccgcgactataagcagaatgcggccatcatcgctaccatgtatgtgctcggtgtgctctggggagtcatgattgaagcatgtggaattgtattttaggagacagggatatggtttcacagacttttgcctgagcgcaaaagtgtgatataatgttcgcgaaggcaaaagtgagcatggaacagagcaggatgccatgcttgcatgcgtcgggcggatatgttccatgtgaacacgcccgcgagtccgggaaaacggagtttttccggacttttgccgaagcgtagttgatataatgaactctgacgagttcatattagaagttcctgcggaacttcggatgcgcagaagtcggcgcagaaaagatgatataatgaaaatagatgcagttgcggagggatgagatggcagggagtggatatgcgacaaacagccgcagaaagattcttgattttttaaaaagcaacagtgaccggaccgtgacggcggcggatatcgatcaatatctgaagcgaaacggcgatgccgtcaatatcacgacgatttaccgttatctggataagcttgccacagatggcaccgtcatgaaatatgtggcggaggcgggaggaaaggcagtgtatcagtacgtggaactgggacagcactgcgatgagcatcttcatctgaaatgtgtcaaatgtggatgcatcattcatctcgactgcggatttatggatgagattgcagagcacatccaaaaggaccacggatttcagctacagtgcaaaaattctatattatacggtatctgtaaagattgcagacgggaatagtctgcagtctttttttatataatgaacaaaacgaccatgacagtgaggaatggaaaacggaacagaaaggaatggagagaagcaggcggatccgctcggccgtgatccttgaggcggcactactttttttgatgggagtaatcctctgggagaatggaaagctgccgcaaaaatcagccgtggaaacaacggcggacggctatatcaaatgggtagattttaatgtgtcgtatgaggcgttgtccagggcatacgagtatgacataggcagttatggagaaaagcagcatcttgactggattgatcttctggcgtacgtcggggcaaagaacggcggagattttggagccggagcaacggaggacatgcgtaccgctgctgaaaaaattctctgcggggaggatacgatggagcatatgaccgcagatatgaagatgttttcctattacagggaggcatacggagcggttcttggcggtatggtcggtgaatatgagatccaggaaaaggaggatgggtcatatgtaaaaaagtatggtctgaaagcattttcaccgatcgcaaaagggtttgagtacagtgattatgatgatttcggggtgtcaagaagctatggatatcaaagacaacatctgggacatgatatgatggggcaggtcggaaccccaatcatcgccgtagaatccggctacgtagaagcgatcggctggaaccagtacggtgggtggcgcatcggcatccgcagctttgacgggaagcgctactattattatgcgcatctgcgccagaactatccgtaccgggaacagttgaaggagggcgatgtcgtgacggcaggggatgtgatcggctatatggggcataccgggtacagcacgaaggaaaatgtcaacaacatagacacagttcatctgcatttcgggctgcagctgatctttgacgaggcgcagaaagagggaaacaacgagatctgggtggactgctataatctgacgcgctttttatataagaaccgttccgcggtgcagaaagtgggggaaagcagggagtggaagaggacgctgcagatgacggatccggcggttgtaaaatatcagaaaaccgtaaaaaaacagtgaaaaaatattgacaatagaagcgggagggtggaaaattttgatatacggatagggaggaggagtgtctgtgatagaacgtcgatggattcaaaaagggtgtcggatttttttcgctattgcacttcttatctgtgtgggaggcattccggcatatgcagaagaactggtgccggacgctggggaaatcaccggcagggtattatttatcagttcctattcctatgcatgggagacggttccggaacagattcgcggtataaaagaagcattgggcgctggtgtacagctggattatcagtttatggataccaaaaatgtcgagacagcggagagtgaacagctattttaccagacgctaacatactatctgaagatggttccggcgtatgatgttgtgattgtaggagatgatgcggcgtttcagtttgcaatgacgtatcgggatgagttgtttgcgcagacgccggttgtttttgagggagttaatgatagggaactggcgaagaaagcggcagcagatccgcttgtgacgggcgtggttgagacgctctcttatgagaatacgatcacgctggcaaagaagctgtatccggatgcaagacaggtggtagggatactggatgatacggtgaccggagagggcgaacgcaaggaattccagtattacgatactgtttttccagagttggactttgtagagatcgacacttcaaagctctcccaggaagaattaaaaagacaggttgctgcgctggaggaggagagcattttggtctatattatgtgcagcagggatggcgacgggaatgtatacgcggcggcggaagcgatccagatgctgagtgatgtggcgcagattccgatgttttcgattgtctcgcacggtatgggaaaagggtttctgggcggcgagattgtctcgcaggaacagatgggaaaaagggcaggagaaatggcggtgcagatactggagggcacggattgtgcagggatctccattatgatggagccgccgaaggtatattgctttgatgaaaatgtgatgcgcaggtttggaatcagtgcatcaaagcttcccggggatgcagtcatcatcaatcacagggagaccttctgggaaaagaaccgggatacgatcagggcaacgctggtgattgctgccgtggcgttggcaatggtggcatggctggcggtggacaatatgcgccgacgcaaaatgaacgaagtgattaccagagcaaacgaaaaactgtcctacagtgcacattacgatgtactgacacaccttaagaaccgcggtgtctttatggaagatatcaggcatcggattgcctcgggggaagaatttacggtttttatgtatgatctggataattttaaacgggtgaacgacacctacggacacaatacaggggatgaggtgctgcgcgaagtggcactccggtcgctggcggtggaggatggccatttcacaccgtaccgcctggcaggagatgagtttgtagcactgatcgactgcggcgattacagggtcatagagcgatatgcatccggtttgatggaacgtctgcaaaagccgtgcagaatgggagcggcggacgaggcactgggagtcagtcttggaatcgcggtgtggccggagcacggagcggatgcaacggaacttctggcagcggcggatgctgcgatgtatacggtaaagaaaaacggaaaaaatggatatgcattttataaggagccatgtgcaccataggaaacggtgcacatggctcctttttaagagtagaaatacgacttattttttcatgccggcgcgttttcttaaggttggatcaagaatacgcttgcggatacgaagactctccggtgtaacctccagaagctcgtcgacatcgatgaaatcgagcgcctgttccagacttaaaatcttaggcggaaccagagtcagcgcctcgtctgcggaagaggaacgcgtgttggtcaggtgctttttcttgcagacattcaattcgatatcctcggctctggaagaagagccgatgaccatgccggcgtatactttttcgccaggtccgataaagagcgtaccgcgatcctgtgcggaaaacagaccgtaggttacggactcgccggtctcaaatgcgatcagggaaccgagtttgcggtaagcgatctcgcccttgtacggtgcatagccgttaaaaatggtgttgatgataccgttacccttggtatccgtcataaattcaccgcggtaaccgatcagaccgcgggacgggatattgaactccagacgtgtgtaaccgccggtaatcggcttcatgttcagcatttcgcccttgcgctggcttaacttttcgataacggcaccggtaaactcatccggtacatcgacataagcaagctccatcggctctaacttcttgccgttctcatccgtgtggtagagaacttcagctttgctgacggcaaactcataaccctcgcggcgcatgttctcgatcagtacggacagatgaagctcaccgcggccggatactttgtaggaatccgggctgtccgtctcctcgacacgcagagagacatcggtgtttaattcgcggaacagacggtctcttaaatgacgggaggtaacgaatttaccctcctgtccggcgagcggactgtcatttacgatgaaattcatggacagtgtcggctcggaaatcttctggaacggaatggcaactggattctcaggtgcgcagatggtatcaccgatatggatatctgcaataccggaaatggctacgatggaaccgatctttgcctctgtgacgtccaccttgttcagaccgtcaaattcgtaaagcttgctgatgcggacacgtttctgcttgtccggctcgtggtggttgacaacaaccgcctcctgattgacctttaagcagccgttatcgacttttccgataccgatacgtccgacatattcgttgtaatcgatggtgctgatcaatacctgggtgttggcatccggatcgccctccggtgcagggatatagtcaaggatcgtgtcgaacagcggagtcatatcctttttgttgttcaccagatcgtcaagctcgcggacagcgtagccgtctcttgcagaagcaaaaaggaacgggcagtcaagctgctcctcggaagcgtccagatccatgaaaagctcaagcacttcgtccacaacctcgttcggacgtgcctccgggcggtcgactttgttgagacacacgataaccggaagagaaagctcgagcgctttcatcagaacgaatttggtctgcggcataacgccctcgaaagcgtcaacgaccagcacaacgccgtttaccatcttaaggacacgctcaacctcgccgccgaaatcagcgtggccaggggtgtcgatgacgttaatcttagttcctttataagtaatcgctgtattttttgaaagaatcgtgataccacgctctctctcaatatcattagagtccatgacacgctcctgaacctcctggttctcacggaacacgccgctctgttttaacaattcatcgaccagagtggtcttgccgtgatcgacatgggcgataattgcaatgttacggacatcttcacgtttcattttcatatacaaaatctctctttcctgtgtgaaacctagtctaaaaaagtaaccaatctattttatcatattttcggagatgcgcaagtggtacatgcgacaaaatccgccatttcattccctttgttatcgacatgttgcatgaaaattctggcaccggacgtgataaaaataatgtgtcaggcagatcataccagcagaacggaacgaaaaagaagaacaacgcaaaaaagagtatggtcgtaagaagggagaaagattcatggcagataaaatttttgaaaacaaccaggtgtcaattatgggagagattgtatccgatttccggttcagtcacgaagtgtacggagagggattttatatggtggatgtggcagtgaaccgcctgagcaattatctggactacattccattgatgatatccgagcggctgattgacgtaaatgctgattacataggacagatcatttatgtgaccgggcagttccggtcgtttaaccggcatgaggagaaaaagaaccgccttgtcttatcggtgttcgtgcgggaactggagtttctggaggaactgcaggaggatatgaagagcaaccagatttttctggacggatatatctgtaaggaaccgatttaccggaagacgccgctgggacgggagattgcggatcttctgatcgccgtcaaccgttcctacggaaaatcagactatattccatgcatctgctggggtagaaacgcccggtttgcctccggctttgaggtgggaggacatgtgcaggtgtggggcagaatccagagccgggaatacgtcaaaaagatttcggagcttgagacggaaaaacgggtggcttacgaggtgtccgtcagcaaggtggattttttagaggaataatcgaaagttccgttattgacaaccgttgttgatagtgctatgttaattttaactatatgatacatattttgatagaggttgcgtgctttaagagtagttttccggatgtgacaggcacaggggaagggaagcaaaaggaaagcatgccgaaagagcaaggcacctgctgccctggttcttgggcataaagctaagaactttatgactgtcatctttgcagatggggcgctatcggttctgtataatggcatgcagatatgcggcagaagaatcagaccggctcatcgagccggcttttttttacttttttattctgactctgatctgacaggggcaaaattgtaccatgggcatatattaacataggagaaacggaggattggcatggcgatattcaagggcgctggtgtagcgattgttacacccatgaaggaaaatgaagaggtaaattacgacaagttggaggaactggtcgaatggcagattgagcagggaacggatgcgattgtgattgtgggaacgaccggagagagttcgacgctcactacggaggagcattccgatgtgatccgggcagcagtgcgttttgcaaagcatcgtgttccggtcattgccggcaccggttccaactgcaccagagaggcgattcacctttccgaagaggcggaaaaggcaggagcagacggacttttggctgtgaccccgtactacaacaaagcgacacagggcggattaatccgttactatacagagattgccgaggcggtaaagcttccgattatcatgtacaacgttcctggacgtaccggctgcaatattatgccggagaccgcagccacactctttaagaacgtggagaacattgtgggtatcaaggaggcgaccggtagtctggctcaggcatccaagctgatgtacttaacggacggcaagattgatttgtattccggcgaggacggcatcgtggtgcctctgatggcaatcggtgcaattggtgtgatttccgtgtggtcgaatgtggcgccggcggatgtgcacgatatgtgcgcggctttctccgcgggggatcttttgcgcgctagagaactgcagttaaaggcacagccgcttgtggatgcgctgttttccgaggtaaacccgattccggtgaagaaagcattgaatctgatgggactggaagtgggaccgcttcgttccccgctcacggagatgacaccggagaatgccgcaaagcttgcggaagcgatgaaaaattacggaataaagttagcataaaagaacagatgactccggcggaagggagccgtaaggccatccgccggagtatgtgtctgcaccgccggctgcatgcggcacgcggagcgggcagtacagagaagagaggataatgtacgatgattaaggcaatcatgaatggatgcaatggtaaaatgggacaggtcatctccgcaatctgcaaggaggatccgcagattgagatcgtggcgggagtggatctctatgacgggatcaaaaatgactatccggtattcccgaatatttccgtctgcgatgtgaaggcggatgtcatcatcgatttttccaatgcgaaggccgtggatgatcttctggtctatagtgtggacaaaaagattccggtggttctgtgtacgacgggattgtcggaggaacagatggagcaggtaaaggcggcatcggggcaggtagcagtattaaaatctgcgaatatgtcgctgggaatcaatctgctgatgcagcttttggcacaggcggcaacgattcttgcgccggcaggatttgacatggagatcgtggaaaagcaccacaaccagaagctggatgcaccgagcggcacggcactggcgctggcggattccatgaatgatgcgctgggacatgtctatgagtacaaatatgacagaagcagcgagcgcaaaaagagagatccgcacgagatcggaatctcggcagtgcgcggaggcagcatcgtcggggagcatgaggtcatcttcgcgggactcgacgaggtcattgagttcaagcataccgcatattcccgcagcgtctttggaaaaggggctgtggaggcggcaaagttcctcgccgggaaaaaggcaggattttatgatatgcaggatgtgatccgggcaacgatggaacaggcagactgattggacaggcagacggataaggcagattgaaagcagatacagatggatcgaatgggaacaggagcgtggaaacgttttctgttcccatttttatacagggcagaaaacgaacaaaatctggtcagcagtgcgcggatatgttactatttgagaggtatcttcgattttgatattctgagggggaacatatggaaaaatatatggaaacagatctgcggtatttaaaaagtctggcaaatcagtatccgaccgtggctgcggcagcgacggagatcattaacctgcaggcgattttaagcctgccaaagggaacagaacatttcattacagatattcacggcgagtacgatcagttccagcacgtgatccggaacggttccggagcgattaagcgcaagatcgaggaagaattcgggaatgcgatcagtgcgggagagaagaaagcgattgcgaccctgatctattatccggagcagaagctagagcaggtgttaaagacagaagaaaatatggaggactggtataaggtctccctgtaccggctgatccgcatctgcaagagcgcttcgtcaaaatataccagatccaaggtgcgaaaagcgctgccgaaagattttgcgtatgtgatcgaggaactgctgaccggcagaccggatgtctccgatcaggaagcttattataatgagatcatccggtctgtgatccgcacaggcagggcgccggagcttgtgattgcgttctgcaatctgatccgcaggcttgtggtggatcatctgcatgtggtgggagatattttcgacaggggaccgtacccgaatctgattatggataccttgatgcagcatcattccgtggatattcagtgggggaaccacgatatatactggatgggagcggcggcgggaagcagaccctgcatctgcaacgcgatccgtatctctgccaagtacggcaatctgaaccttttagaggacggatacggcatcaatctggtgccgctcgccagacttgccatgagcagatacgacaaggatccctgcacctgctttaagctggattaccgggaggatgagtacgatgtgcgtgacgccatgctggatgagaaaatgcacaaggcgattacggtgatccagttcaagctggagggacagatgatcatgcgtcacccggagttcgggatggatgagcggcttttgctggacaagatcaatatcgaaaaaggaacggtgtgtgtggaggggaaggaatacccgatgaaggatctgaacttcccgacgatcgactggaagcatccgtatgaactgtcatcggaggaggaggacgtcatggagcggatcacgcaggcgttcttgaactgtgaaaaattacagcgtcacgtccgttttctgttcacacagggcagcctgtacaaggtctacaacgggaacctgctctaccacggctgtgtgccgatgaacgaggacggaacctttaccagagtaaatgtgtacggaaaagaatattccggcaaggcgctctacgatgtgctggagaattacgcgagaaaagggtactacgcgattgatcccggggagaagaaaaagggactggatatcttgtggtttatctgggaaaaccagaattccccggtgttcggaaaagcaaaaatgacgacgtttgagcgctattttatcgcggacaaggcgacgcaccaggagccgaagaacccatactaccgcctgctggaggaggaagaggtggtcaaccgcatcctctcggaattcgggcttgagggcgcggaggcacatatcatcaacggccatattccggtggaggcgaagcggggagagtccccggtaaaatgcggcgggaagctgctcattattgacggcggattctccaaggcctaccagccgaagacggggattgcgggatatacgctgatctataattcctacggtctggtgcttgcggcgcatgaaccgtttgagtcggtcgaaaaggcggtgcaggacggaagcgatatcgcgtcgcatacgattctggtgcagcatgtcgtgcgtcgcaagctggtggcggatacggacattggaagggagctgcgcgcttcgatccgtgatctggaggcgctgctgcaggcataccgggacggtatcctggtggagaagatttaaagaaagatagaaggaagcaggaaaagaatatgtatatcggaaatcatctttcggcgtcaaagggctatgcggcgatggggcggatggcagtgaagctgggagcaaatacatttgcattttttacaagaaatccgagaggaggtgcggcaaaagcgattgatccggcggatgtggaaaagctgctggaactgatgcgggagcagcagtttggaaaactggtggcgcatgcaccttacacgatgaatctgtgcgcggcgaaggaggatatccgcaagttttctaaggagatgatcgcggacgatctgcgccggatggagtacacgccggggaattactacaattttcacccgggttcccatgtcggacagggggcggatgccggaatcgaatggattgcggaggcacttaacgaggtgctcacgccggagcagacgacgacggttctccttgagacgatggcgggaaaaggcagtgaggtgggcagaagctttgaggaactgcgcgcgattattgaccgtgtagagctgtccgataagcttggcatctgtctggatacctgtcatgtctgggatgctggatatgatattgcgggagatctggatggtgtcctggagaaatttgaccatgtgatcggtctgaaccgcctgtgcgcggtacattttaacgacagcatgaacgaccgcggttcgcacaaagaccgccatgcctgcatcggcgagggaaagatcgggctggatgcgatgcggcgtgtggcgacgcatccgctgctttcggacaagccgtttattctggagactccgaatgacgatgagggataccgcagagagattgcacttttccgggagtggagggagtagataagaatccagagaaatacattgctttttagaagtgtgtgtgttatacttcaaatcacatgaatgcgaaagctttttcatgcaaatatttgcccaccaagagattggttaagcccatacggacaggcggggcagctgccgatggtggagagatccacgttattgattgagttagaagctcaaattttataagttgatgacgactgcaggcgaaggactgcaggaccctgaatcgtatgcgatagagatatcacttgtgaaacggtcaataagagtagtaatagcaaatatttgctggcgaagatgccaacgtagactctgataatagtttttgcagcatgtaggacagattacataaagtatgactatgagaatgtgacaaggcaggtgatgtgtgcgcagcatacaggcatctgtctttttttgtgtaataggaaacttcgtccctattacataaaaacgctccgggcaggattctttcttgtgctacagaagatgccatgttatgcgaaagcatgaaagtcatgcttcctgtagagccaaaagctctgccggacggcatgcgcactgcggcagggagcatcaaaacagaatgtgaggagaatcatggaagcaggatcccagaagcgcgctccggtctacgaagcgctggaacaattaaaaaagagaagagtcgttcctttcgatgtgccggggcacaagagagggcgtggcaacccggagctcgtggaacttctgggggagaaatgtgtgagtctggatgtgaattccatgaagccgcttgacaacctgtgccatccggtgtcggtcatcaaagaggcggaggaactggcggcggaggctttccgggcagatcacgcgttttttatggtgggaggaacaacgtcctccgtgcagagcatggtgttgtcggtctgtcgtgccggggataagatcatcctgccgcgcaatgtacataagagtgtgatcaatgcactggtactctgcggcgctattccggtctatgtgaatccggaggtggacaaaaagcttggcatttcactcggtatggagatctcggaggtggagcgggcgattctggagaatccgggcgcggtggcggttcttgtgaacaatccgacttattacggaatctgttccgatttgcgctccatcgtgaagttggcacatgaacacgagatgcttgtgcttgtggatgaagcgcacggcacccatctgtatttcggggaggaccttccggtctgcgcgatggatgccggtgcggatatggcgtccgtctccatgcacaaatccggaggaagcttaacacagagttccctgcttttaaccggcaaaaatgtcaactgggagtatgtcagccagattatcaacctcacacagacgacaagcgcgtcttatcttctgatgtcaagtctcgacatctcgcggagaaatctggcgctgcgcggaagggaatcgttccgcaaagtggcggagatggcggaatacgccagggcggagatcaacgacatcggcggatattatgcttacggcaaggatatggtgaacggcggaagcgtctatgactttgatgtgacgaagctctcggtctacacgcggggaatcggtctggcaggaatcgaggtctatgatctgctgcgggatgagtatgatatccagattgagctgggggacattgccaacatcttagcctacatttcaatcggcgaccgcatccaggatatcgagcggctggtgggagcgttggcagacgtcaaacgcttgtattccaaggatcctgcacagatgttaaatacagaatatataaatccgaccgttcttgtttcaccgcaggcggctttttacgcagagaaaaaatgcatgccgatccgggagacggcaggaaagatctgcggagagtttgtgatgtgctatccgccgggaattccgattctcgcgccgggtgagatgattacgccggagatcatcgaatatatcatctatgccaaggagaagggctgctccatgcagggaacggaagatccggcggtggagcacttaaatgtcctggtggatgaccggcaggtgtggaaataagaccgccggaagaatagctcttaaggaagagcatacggtcaggaagaaccggcgtaaggaagcagcagaccgtggaatacggtctggggaaggtggaagagagcgtggagttatggttttcggataatcagaccgatcatgtgaaggtgtcggtcaaagtggagaagcagctgttcggggagcagacggattttcagaggatcgacgtgtttgaatccagagaattcggcagatttttaagctccgatggcagcatcgtcttctcagaaaaggatgagttcatctacgatgagatgattgtgcatgtgccgatggcggtgcatccgcatgtgaaaaaagtgctggtcatcggtggcggagacggcggtgtggcgagagaactttcctattatgaggagatcgagcagatcgacgtcgtggaatccgaccggacattcgtggatgtgtgcaggaagtttttcccggacaacgcctgcggactggaagatccgcgcgtcaatatctattacgaggatggactgcgctttctgcgcacaaagcatgatgcctacgatctgatcatcaatgatgcgatcgatccgctcgggcatacggcgggattgttcaccaaggaattttatgggaactgttaccgcgcattaaaagaagacggcattatggtctaccagcacggcagtcctttttatgacgaggatgaggagtcctgccgcgtgatgcaccgcaaggcgagtcacagtttcccgatcagccgtgtgtatcaggcgcacattccgacctgttcctccgggtactggctgttcggatttgcgtcaaaaaaatatcacccgctgacggatctgaatgtggagcgctggaaagcgcgcgggatcaagacctggtattatacgaccaatcttcataagggagcgtttatgctgccaaaatatgtcgaggatatgcttgaggaagaggaaggcagaaggtagatggcagctgcgggacagaacggactctgacgggacagtcagtggagcgttctgtcatccgttggcagaatgatataaataatataaaaatagaaaatacagccgcaggacggcagaatgagaggataagtagatgggaagattattgattatcggatgtggcggagtagcaggggtggcaattcacaaatgctgccagaacagcagaactttttcggagatctgcattgcaagccgcacaaaagaaaaatgtgacgcgttaaaagaaaagctgcagggaacgacggatacagtgatcacgacagcgaaggtggatgcggataacgtggacgaactgatcgcactgatccgtgactacaagccggatgccgtgttaaatgtggcgctgccttaccaggatctgacgattatggatgcctgcctggcatgcaaggtggactacatcgataccgcgaactacgaaccggaagataccgacgatccggcgtggcgtgcaatttatgagaagcgctgcaaggaggcgggctttaccgcgtacttcgattattcctggcagtgggcatatcagaaacgctttgcggatgccggcatcacggcgcttcttggcagcggctttgaccctggcgtgacgagcgtgtttaccgcctatgcgctgaagcattatttcgatgagatcgagtacatcgatatcttagactgcaacggtggagaccacggttatccgttcgccaccaatttcaacccggagatcaacctccgcgaggtatccgcaaacggctcctactgggaggacggacactgggtagagacaaaaccgatggaaattaaaagagaatataatttcccacaggttggcgagaaagacatgtatctgcttcatcatgaggagatcgagtctctggcaaagaatgtgccgggagtcaagcgcatccgcttcttcatgaccttcggtcagagctatctgacccatatgcagtgtctggaggatgtcggaatgctctccacttccccgatccagtatgagggaagagagatcgtgccgatccagttcttaaaggcattgcttccggacccggcgtcactgggtcctagaaccgttggcaagacgaacatcggctgtatttttaccggcaagaaggatggcaaggaaaagacgatctatatctacaacgtctgcgatcaccaggagtgctacagggaggttggctcacaggcgatctcctacacgacaggagttccggcaatgatcggtgcagcgcttgttgtagataaggtgtgggataaggacggcgttttcaatatcgaggagtttgatccagacccgtttatggatatgctgaaccagtacggactgccgtgggttgtcgatgagaaccccaagacggtagcgtagccgttcgtaaaaagagccggacagggagagacgagagcaatgaagtggaatgaacttccgacaccatgctatgtggtggatcagaaaaaattaaaagagaatttaataatattgcataatctggagcaggatacgggatgccatgtcctgctggcgcagaaagcgttttccacatatgcgctctatccgttgatcggacaatacatcagcggtaccacagcgagcggactctacgaggcgcgtctcggcgcagaggagatggggcgtgagaaccatgtgtttgctccggcgtacaaggacagtgacatggaggaactggtcacgctctgcgaccatgtgatttttaattcctttgcgcagtatgtcagacacaggaagaaggtggcggcgcagaatgtcgccagtggtacggagcaccgtgtcagcatcggacttcggatcaatccggagtattccacgcaggagggacatgcgatctatgatccctgcgcgcccggttccagactaggcatgacaagagaggcgtttgagaaaggacttgccggacttggcatgagacggcaggaggatggaagctatgaactgccggaggatgtggagggactccattttcacacgctctgcgagcaggacgcggatgatctggaacgtacgtttttggcgtttgaggagcagtttgcttcttatttgaaacaggttcggtggctgaatctgggcggaggacatcatatcaccagaccgggttaccagatagagcgtttaaagaagcttatcggctatatcagggagacctacggacttgccgtgtatctggagcccggcgaggcggttgccttaaatgcgggatatctggtaacggaagtgtgcgatattgtacacaacgggatggatattctgattctggatgcgtctgcggcgtgtcatatgccggacgttcttgagatgccgtatcgcccaccgctacgggacagctttccggcgggggagcagagatacacctaccggctgtcctcgctcacctgtctggcgggggacgtcatcggggactacagtttcacacacgagattcagatcggcgaccgtctggtgtttgaggacatggcaatctactcgatggtgaagaataatacctttaatggaattccgcttccgtcgatcgcaatgctccgggaagacggggaggttgagatgataaagcagttcggctatgaagatttcaaagggcggttgtcataaccggttttgaaagacatccgggacaagggaagatgacttggatgagggtagaggaaatggagaaaaagatgcaaaagtgtgcagaagacccaaaagagagaatgacaacgccgcagacggacggattttttatgccgggggagtacgaaccgcatgacggctgcattctgatctggccgtcgcgcccgggttcctggatttacggcgcacgcgatgcgcggattgcattccgggatgtgattgcagcgattgcgcagagtgaaaacgtatatgtggcagccgggcgggatgccattgactccgcgcgagagatgctgaccggtgaggacgcgccgtggaaaaagcgggtgacggtctttgaactggagacagacgatgcctgggcaagagatgtggcaccgacttttgtgaaagacggcgccggcagggtgcgggcagtgaactggtcatttaacgcctggggaggatcggtggatggactgtatgcatcctgggcgttggacgatgcgtttgcaaaggcgtttgccgcaaagtacggctatgcgtgttacgatgccgcgccgtttgtactggagggcggatcgattcacagcgacggtgaggggacgcttctggtgacggaggcgtgccttttgagtgcggggcgcaatccggggcttacgcgcgaggagatcgaggagaagcttagaacgtatcttggcataaaaaaagtgctgtggctgccgcgtggaatctatcaggatgagacgaacgagcatgtggataacgtctgcgcgttcctgcgcccgggcgaggtggtgcttgcatggacggacgatgaaacagatccccagtatccgctatcacagcagacgcttgcgtacctggagggcgagacggatgcgcgcggaagaaagcttgtcattcacaagcttccgattcccgatcatccggtctgcattacagaggaggaactggcagggtattcgtttgccgaaggggaggatgagcgggaggcgggagaacgtcttgcggcatcctacgtgaacttttatttttccaatgaggcagtcgtccttccagcgttcggcggggagaatgaggagagtgacaggcgcgctgccgcactgcttgcgcagtggaatccggggcggaagatcattccggtgcaggcgcgtgcaattttagtcggcggcgggaatatccactgtattacacagcagatcccggcggcaaaaatgcagcagcaaaaatgcagcagcggtaaagtggacagagacaaaaagaggaaaagagtatgaacagagtgaaagtggcggcaattcagatgcgctgtgcggcatctgtggaggagaatttaaaaaaggcggaagccatggtgcgaaaggcggcggcagagggagcaaacgtgatccttctgccggaactttttgagcgggaatatttttgccagcagcgccggtatgacttctatcattatgcaaagcctgtgatggagaacgatgcggtgcgcatgggcatgcggcttgccgcggagcttggcgtggtgctcccgatcagcttttatgagcgggatgtgaataacctgtacaattccatcgcctgtatcgacgcggacggaacggtgctcggcgtttatcgcaagacgcatatcccggatgatcactactatcaggaaaagttctattttacgccgggggataccggatttcaggtattttctacgcgctacggcagaatcggcgtgggaatctgctgggatcagtggtttccggagagcgcgcgctgtatggcgcttgcaggggcggagctgcttttttatccgacggcgatcggatcggaaccgatcttagagtgcgacagtatgccgcactggagacgctgcatgcagggacatgcggcagctaatctgatgccggttattgcggcaaaccggatcggtgaggagacggtagaaccctgtgaggaaaacggcggacagcgttcggcgcttgttttttacggatcgtctttcctgaccgatgagaccggagaaattctggcggaggcagggcgcgacgaggaagagatactggtgcaggaatatgacctggacgagctggatgccagacggctggagtgggggctgttccgcgacaggcgcccggagtgctacggcatcatcagcggcaggtaaaagaaatatattgttgacatggaaacaataatgagatacagtaggaactgggaacaaaataccatgttagaaaaaggaagagtctgcatgaaagatcgggaagagctgttaaaagaaatcgcgctcatgctggagcggcaggatatgctttccaaactgacggaaaaccagtgtctggatgaatacggctattcggagacacactgtatcgactatatcggaagactggaactgccgaacgtcacgaaggtggcggagcacatggggatgacgcgcggcgcgatcagcaagatgaccaagaagcttcttgccaaagggctgatcgaaaaatatacgctggagacgaacaaaaaggaagtatatttcaagctcacggatcagggcaggcttttgtttgatgagcatgcgaagcggcatcagcgatgggagaagcgcgatatggaatttctggcgcgctattccgtcgaggatgtgaggacggtgagccgttttatgacggagttcaacggctatctggaagagcagatcgagacgattacagggacgcaggcagagggatgatattctgtaataggaacggaagtttccagttacagaaaaaagaatcctgcaggcaggattctcatgtgttacggttgcatgaaatgtaattgttaagcgtttaacacctcaagaagcgtaagcagcttctctaccgtgtcctggctgatgttgtttgcggcgataaaattgcttaccgtcgttgcaatatcttcggaagtctctgaagtggatgcggatgcgacggtgttcgtatcgcttcccatataggagagaaccttctggacataattctgtgtctcgctaaacggtggaataccgccgtatttatcgacatttgcactgccggcgttgtatgccgcaagcgcaagagaggtatcgccgttgtacttggcaagcagctgggagatcagattcgcaccgcccatgatattctggtaggcgtcgtaggaatctgtgacaccgagagatgctgcggtggcaggcatcagctgcatgataccgacggcaccggcgctgctgacagcgcttgtattaaaattggattctgctcttgcgattgattttaaaagagtggaggagacgccgtaggtgtttgccgcctcgtcaaagatggcggaaaggtcttcggagcaggtcgtgctgccggagtaggcgtcggtggcattcgttaaaacagaagaaaagtcagatcccgcagcctgtgctttggcagcttcggcggcagatctctccgcttcggcgcgggcagcagcctcggcgttgatctgatccacaaatgcctgatcgtgataatttaagatcgtaatactcattggtaactcccttgaaaacaacttcactgaatgtataactagaaaaagtatagcataatttacgggattaggaaagaaaaaaatgaaaaccaagcaagtcgaacagaaaggaacatatttgcgtgcattccgggcagcatttccctacacggtgccggtgctcaccggctatctgtttatcgggatggcgttcggagtgatgatacaggaaaaaggttacaacttcttgtgggcaatgctcatgagcctggtgatctatgcgggcagcggacagtatctggcagtcaacttcttcgcgccgagcgtcagccttttcaatgtggttttcatggaatttatggtgaatatccgccatattttttatggattgtcactgttggaacgtttttccgagatggggaaaaagtggctctacatgatcttttccctgacggatgagacctactcacttttctttgtcacaaaagtgccgaaggatgtgaaggaggagcagttcttatttgcgattgccgtgcttgaccagagttactggatcatcggctccggcatcggcgccctgcttggaaatgtacttccgttctccgcggagggaattgactttgcaatgacggcattgtttgtggtaatcatggtggaacagtggatggagaagcagaaccgtccgagcgtggtgatcgggctggtatgtggactggtgtgcaggctggtgttcggagcggacaattttatccttccgaccatgatatgcgtcatggtcatcctgctttcttgcaaaaaaatattcgataaaatgattccggaggacggaaaggaaggaggcgagccggagtgccagtaagtgttggaagatcgcttgcgatcatatttaccgtggcgggaacgatattttttaccaggctgattccgtttctgtttttcccgaaaggaaaagagattccgccgatcatccggtatctggggagagtgctacccccggcggtcatcggaatgctggtgatctactgcctgaaaaacgtgtcggtgcttgcggcgcctttcggcctgccggaatttattgccgtggcggcggtcatcgtgcttcatgtatggaagcgcaacaatctgctcagcattggtgccggaacggcactttatatgtttttgatacaagtcgtattctaggaagaaaggaagaaccgtatgaagaagaaaccatttgtaaccaaagaacagttagaggaaatcgtaaaaaaatacccaacgccttttcatctctacgatgaaaaaggaatccgcgaaaatgcgaaggcagtgaaggaagcgtttgcgtggaatccgggattccgggagtattttgcggtaaaggcaaccccgaacccgtttattcttgacattttaaaagaatatgactgtggatgcgactgtgcgtcgctgacagagctgatgcttgccgactcccaggggtttgacggaaaacacatcatgttttcctccaacgatacgccggcggaggaatttgcgtttgccaatgagctcggcgcgatcatcaacctcgacgattttacgcacattgattttctggagaaaacgatcggtaagattccggagacaattagctgccggtacaatccgggcggtgtctttaagatgagcaacggtatcatggacaatccgggtgatgcaaagtacggttttacccacgagcagatcattgagggattcaagatcttaaaggagaagggagccaagcattttggcgtacatgcgtttcttgccagcaataccgtgacaaacgaatattacccgaagcttgcgagagaactgtttgaactggttgtggaactgcgcgataagacgggatgcgatatccgttttatcaatctctctggcggtgtcggtattccgtacacaccggatcagacgccgaacgacatccgtgtcatcggagagggcgtccgggtggcatatgaggagatcttagttccggcgggacttggcgatgtcgcaatctacacggagatgggacgttttatgctgggaccgtacggctgcctggtgacaacggccatccatgagaagcatacccacaaggagtacatcggtgtggacgcgtgtgccgtgaacctgatgcgcccggcaatttacggggcatatcaccatattacggtgatgggcaaggaggatgcgccgtgcgaccacaagtatgatgtgacaggctccctttgcgagaattgcgataagtttgcgattgaccggatgctgccgaagatcgacatgggagatcttctggtgattcatgataccggtgcgcatggtttttccatgggatacaactataacggaaaattaaagtcagcggaggtgctgctgaaggaagacggatcgacacagctgatccgtcgtgccgagacgccggaggactatttccgcacgtttgactgctttgatatcttaaaggatatgaagcacccgaaataagcggcagatcattccggaaaaagcacagcagcgaggatgagatatgtgcattgatacagaacgttttgagcgtgccaggggcagagtcattggaatcgagcggcagaggcttggaatcggcacactctcggagaagacggtacatgcagtgctcaagaattattatgcaccggatgaggatatgcatgagatcccgattgagaattttgttgcggatatttttgatggggaggcagtgatcgagattcagacgcggtcgttccagaatatgcggcggaaacttgccgcatttctgccgttatacccggtgaccatcgtctatccgattccgcatgtgaagtggcttcactggatggatgaggagacgggggagatctctcccgggcgcaaatcgcccaagaagggaaatgcataccaggcattcatcgaattgtataagatccggccgtttctgaaagatccgaatctgagactacggctggatctcattgacatggaggaataccgtctgttaaacggctggagccgggacaaaaagaagggaagcgaccgcttcgaccggataccgcttaccttcgtggaggaagtgcgtgtggatcggagggaggactacatgcagttcatcccctatgagattccggaggagtttactgcaaaggattttgcggcatgcgcgaagattccggtgcggctggcacagacggtgctcttgattctgacggatctattgattgtggagcggattggaaagcagggaagaagttatctctaccggatctgcgagattgaatgaatctcttcccaagcggggcattctgtgttatactgactgccggatgtatatttatgcagtatctatgtgagagataaggaagcatgaggtagatagtacgatgaaaaacacagcaatcaaattatccggcatactgcttgccggagcggtctttttttcgacgctgttaggttacggcacacaggttgccgcggcgacggcgataggcagcgacacggaggcgggacaggcatccggcgacggttctgtcgcgtcggttgcggatcttccgggaaagcatatcggtgtacagctcggcacgaccggagatatcatggtcagcgactatgagacggacggctcgggcacggtagtagagcgttacaataagggcgcggatgccgtgcaggcattaaagcagggaaagttagactgcgtgattattgacgaattgccggcgctggcatttgtggagcagaacgaagggcttaagattctcgaggagaactttgttgaggaggactatgcgttcgtaatcgcaaagggtaacgaggcacttgtggatcaggtcaatgagacgctgcgcgaactgaaggacgagggtgttctcgataacattgcgaagaattataccggaacggacgaggagattggaaagtatccgtatgaaattctggatgtggaacgcacgaacggcacgcttaccgttggtacgaatgcggagtttccgccgtatgaatactatgaagagggaaagatcaccggaatcgacatggatattatgcaggcggtctgcgacaaactcggcatggagttgaagatcgaggacatggcgtttgattccgtgattcctgcggtgtccaccggaaaagtcgacatcggtgcatcgggttttacggtgacggaggaacgcaaaaagaatgtgaatttcacggatacctatgcaaaatccaagcaggtcatcatcgtgagagatacatctgtcacagcagagaagacagggatagcagagaagttttatgataactttatcaaggacagccgatatacctatttgttaaagggacttttaaatacactcatcatcaccgtgtttgcggtaatgatcggtattgtgtttggatttttgatcgcgattgtaagaaccaaccacgacagaaacggcgggcttaagatcttaaatgcactctgcaaggcataccttgccgttgtgcgcggtacgccggtcatgattcagcttctgattatttattatgtcattttccagagcgtcaatacgggaaaactgttcgtggcagtcattgcgttcggactgaactcggcggcctacgtggcggaaattgtccggtccggtattatggcggtggacatcggacagtttgaggcgggaagaagccttggattaaattataagcagacgatgttaagcatcatcctgccgcaggcagtcaaaaatattctgccggcactctgcaatgagtttatcagtctgttgaaggagacttcgatcagcggttacatcgggctgatggatctgaccaagggcggagacatcatccgaagcgtgacgtacgaggcgttcatgccgttaattgcggtcgcggccatttatttcctgattgtcatgggactgagcaaggcagttggactgttggaaaggagattgagaagcaatgagcgataatacggtaattctggaagtaaaagagcttcacaagtcttttgacggtcatgaagtgttaaaaggaatctcgacgacgatcaaaaagggcgatgtgctggcgctgatcggaccgtccggctgtggtaaatccacgtttttgcgctccttaaatctgctggagattccgacggcgggacatgtgctgtttgagggaaccgatctgacggatccgtcggtggacatcaatcatgtccgggagaagatcggcatggtgtttcagcagttcaatctgtttccgaacatgacgattctggaaaatatcatgcttgccccggtaaaactcggcaagatgacaaaagaggaagcgaatacgcgcgcgatggagctgttaaagcgcatcggtctggcggataaggcgggcgcgtatcccgcgcagctttccggcggacagaagcagcgcattgccatcgtgcggtcgctggcgatggacccggacatcatcctgtttgacgagccgacctcggcgcttgatccggagatggtcggcgaggtgctcgccgtgatgcaggaactggcggaggatggcatgacgatggtggtcgtgacacatgagatgggatttgccagagaagttgcgaaccgtgtgatgtttatcaacgacggcgtgatccaggaggagggaaccccgcaggagatttttggcaatccaaagagtcagagactgcaggagtttttatcaaaggtattgtaagaagaaataaggacgggctgtccggcgcaaaagaggtgccgcggcccgttttttgtgcaacaggcaaagaatgtgttttgtatactgcatcaggaatacctcccgcaggcggagagcggggcggaacatcgtttgcaagatgtgcgattgtatgataagataaataacgatttttaggaacggaatcgtaagggaaggaagaacgcatatgaaatggaataaatacacgatagagacaacgacggcggcggaggactacatgagtgcgatgttagccgaccttggcattgagggagtggagattgaggataacattccgctgtccaaggaagatcaggcggatatgttcatcgattttctgccggagcttccgccggatgacggtgtgagccacgtcagcttttatcttgaggatgacggcgaggaccgcaccgaactgttaaagcaggtaaaagaggcgttggaggacttaagaaaagtcgtggatgtcggaagcggcgtgatcacctccgaccagacggaggatctggactggatcaacaactggaagaaattcttcagttccttctatattgatgacatcctgatcaaaccgacctgggaggaattaaagccggaggatgccgacaaatttttaatcgagattgatccgggtgtgtcgtttggaaccggcaagcatgaaacgacgcagctgtgcattcgccagctgttaaagtatatccgcgggaacgatgcgtacacatcggaaaaccgcacgccgaaggtactcgacgtcggctgcggaagcggcattttatcgattgtggcgttgaagcttggcgcgtctgcggtagtcggaacggatctcgatccggactgcatgacctccacacatgagaacatggcggtgaaccatctggacgcggcgctcggcacattttatgttggcaatctgatcgatgatgcagcactgcaggagaaagtcggcacggaggaatacgacattgtggttgccaacattctggcagacgtcattattccgatggcaccggtgattccggcacgcttgaaacgcggcggttattttatcacctcgggcatcatcgatttcaaggagaacgcggtaaaagaagcgatcgaagcggccggacttacggtggtggagatcaatcatcagggcgagtgggtgaacattacggcgagaaagccggaataaggaagacgatccgaaaaaaggaagatgatccgaaggaatggcaggcagcccggaaatgaggagtttatgtatcagttttttgtggaagacgagcagattgcaaatgatctggtgataattgagggaagcgatgtaaatcacatccgcaatgtcctgcgcatgaaatgcggggaaaaagtgcgcatcagcagcacatccggcaggaatttcttcggcatgattgaccggattacagagaatgtggtggaggtgtgcatcacggaggagacggctttagatacggaactgccctgccggatctgcctgtttcagggacttccaaagagcgacaagatggagctcatcatccagaaggcagtggagcttggcgctgcggaggtgatcccggtggcgatgaagaactgcgtcgtaaaactggatgcaaaaaaagcggcggcaaagacggcgcgctggcaggagattgcaaagagtgcggcaaaacagtcaaagcgcagcagaattccggtggtgagagaaccggtgaattaccgggaggcagtcgcattggcgggagaactcgacgtggtgctgctgccgtatgagaatgagcgcggcatggcggccacaagggaagtgatggagcggattgcaccggggcagagcgtcggcatttttatcggaccggagggcggattcgatccgtcggagattgcgctggcaaaagaggaggggatgcatctggtgtccctcggaaaaagaattttgcgcacggagacagcgggacttgcaaccctttctattctgatgtatcatatcgagagtgtgtcggaagcggaagaagagcgggatcagccgtgattctgcgtcggcgtttgttagaaaggcatggttttaaaacagatggaagcatatttggataattctgccaccacccggtgcagtgagcgcgccaaaaacaagatggtgcagatcttaacggaagattatggcaatccgtcctccctgcacaacatgggaaagacggcggaggactatattaaagaagcaaaagagcagatcgcgaagacgctccgctgtgacgagaaggagatcatctttacgtcgggtggcacggagtcgaacaatatggcgctgatcggcggagcactggcaaacaagcgccagggaaagcatatcatcacgacagcgattgagcatgcgtcggtacaggcgccgcttgcctacttaaaagaactcggctatgagatcacggaattgtctgtggatcatgacggtattatttcgctggaggaactgcgggatgcagtgcgggaagatacggtgctggtgtccatcatgatggtgaacaacgagattggtgcggttgaaccggtcgaggaagcggcgaaggtcatcaaggcgaagaatccggacacgctgtttcatgtggatgcgattcaggcgtacggcaaattccgcatctgcccgaaaaagatggggattgatctactctcggtgagtggacacaagatccacgcgccgaaaggaaccggatttttatatatccgcgacaaggtaaaagtaaaaccgatcatctacggcggcggtcagcagaagggaatgcgctccggcacggagaatgttccgggcgtggctgcactcggcgaggcagcggcggagatctatgagaactttgacgcgaagatcggtcatatgtatgagatcaagcagaggttcatcgatgaggtgacacagatcccgggagtgacggtaaacggtaaaacgggacgggactctgcgccgcagattgtgagtgtcacgatcgaggatgtgcgcagtgaagtgatgctccattctctggaagaatacggcatctatgtgtcggcgggaagcgcatgctcgtccaataagccggcaccgagccgcaccttgcagggcatcggtctgccgaagcagaagttagagtccacgatccggatcagcttctgcgtcaacacaacggaagaagaagtggattacgcggtcgaaaaaatgaaagagatcattccgttccgcagaaagttcaccagaaagtaaaggagaaaaccatgacatataaagcatttttgattaaatatgcagagattgccatcaagggaaagaaccgctacctgtttgaggatgctctggtgagccagatgaatcatgccttaaagaaggtggacggcacgttccatatccgcaaggagcagggcagaatctatgtagagatggagggcgaatacgattacgatggagctgtggaggcactgcagcatgtgtttggcatcgtgggaatctgtccggtcgtactgctggaggacgagggctttgatgcgctggcgggggaagtcatccgctatatcgacgaggtatacccggacaagcattttacgttcaaggtcaatgcgcgccgcgcgagaaagaattacccgttggagtcgatggagatcaatgcccagataggcgagcggatcttagaggcgttccccgagacgagcgtggatgtccacaagccgcaggtgatgtttaatatcgagatccgcaaccagatcaatgtgtactcgacggtcattccgggaccgggcggtatgccggtcggaacaaacggaaaagccatgttgctcttatccggcggaatcgacagcccggtggcaggctacatgattgcaaagcgcggtgttaccatcgatgcgacctattttcatgcgccgccttatacgtcggagcgcgccaagcagaaggtcgtggatctggcaaagatcatttccaaatataccggaccgatcaatctgcatgtggtcaattttacggatatccagttatatatttacgaacagtgtccgcatgaggaactgacgattatcatgcggcgctacatgatgaagctggcggagcattttgcaaaagagaacaagtgtctcggactgattacgggggagagtatcggacaggtggcgagccagaccatgcagtcgctcgcggcaaccaatgaggtatgtacgatgccggtttaccgtccgctgatcggatttgacaagcaggagatcgtggagatctcggagaagatcgacgcttatgagacctccatccttccttacgaggactgctgtacgattttcgtggcaaagcacccggtgacaaagccgagcttaaacgtgattcacaatgatgagagaaagctttccgagaagatcgatgcgctgatgcaggaagccatcgatacggtggaggtaattcacatcgaggcgtagatgtgcatcctcgcggtgcgggtttatgtaataggaacgaagtctcctgttacataaaaaaacagccgcgggaaatcccgcggcgtgtacccctgttatgtatgaattagattaagtatggctttaaagtctccataatctcgtccatgttgttctctgcatggattgcaaggtcgataggcttggataaatctaaactgaagatacccatgatggactttgcatcgatgacgtatctgccagagatcagatcaaaatcatattcatactgcgtaattgcattgacgaaggactttaccttgtcgatcgagttaagggaaatctgtactgttttcatgataaaaaacctccttaggattatctgtttcaagatagttttatagtaatagtttttcgtggaaaagtcaacacaaaaagcggatgaaaccataagaaagcgtgaacaaaaagcaatacagaaatgaggaaacaagaatgaaagcagcattgcataatttgggttgtaaagtgaatgcatatgagacggaagccatgcagcagattttggaggaggcgggatatgagatcgtgccgttttcggagtatgcggatgtctatgtgatcaatacatgctccgtgaccaatatggcggaccgcaagtccagacagatgctgcaccgggcgaaaaagcagaatccggatgcgattgtcgtgggagccggatgctatgtgcagaccaaggaggcacaggctctcgtggatgagtcgattgacatcgtgatcgggaataataaaaagcatgagctggtgccgctgcttcgggaatacgaagcatcccaccgcaagatggcgtgtgtggcggacatcaatcacgagaagcaggcatacgaggaattgtcgctttcgcgcacggcagagcacacccgggcgtttatcaaggtgcaggatggctgcaatcagttctgcacatactgtattattccgtttgcgagagggcgtgtcagaagcagggagcttccggacgtcttacaggagatacggacgctggcaaaaagcggctaccgcgagatggtgctcaccggaatccatctgagttcctacggtgtggacaacggggagtcgctgctgcatctgatcgaggcggtacatgagctggaggggatcgagcggatccgcttgggaagcctggaaccgcgtatcgtgacggacgcgtttgcaaaaagactctcggagctgccgaagatctgcccgcattttcacctgtcattgcagagcggctgtgatacggtgttaagccgcatgaaccggcggtacgatacggcggaatatgaggtgggctgtgcgctgctgcgcaggtattttgaacatccggcaatcacaacggatgtcattgtaggattcccgggggagacggacgaggaatttgagacgacggagcgttatctggagcggattcatttctatgagatgcatattttccagtattcgagaagagagggaacgaaggcggcggcaatgccggatcaggtgccggaggcggtaaaaaaggagcgcagcgaaaaactgctggcactcggtcacaggatgtcggaggagttccgccggtattatctcgacagacaggtgacggcacttctggaggaagagtttttatatgatggaaagcgttactacaccgggtacacaaaagagtatgtgaaagtggcggtggagacagaaaaagatctttccaacacgtttgtgacgggcaccttaaagacacaattaacagaagacatctatcttttagttgaattttaagacaaactatattagaataaaaacagcaatgctttttcgacaagagagcggtggctggcagcaccgctttaaagtccgggcagatataagggcgtgacaaatatgcaggagatcaataacacacaatattttaaagtggaaaaaggaccggaacttcgcgtgagcgacgtgctcgcgattgtttatcgtgcgcttatggagaagggatacaatccggtgaatcagattgttggatatattatgtcgggagatcctacttatatcaccagtcataataatgcaagaagcctgatcatgaaagtagaacgtgatgagctggtagaggagatgctgaaggcttacatcaggaataacaactgggaatagaagatgcggatattaggtttggattttggctcgaagactgtcggtgtggcagtcagtgatgaacttatgttgacggcgcagggactggagatcgtgagaagacagtctccgaacaagctgcgtcagacgctggcaagaatagaacagattgtaacagaatatcaggtggagcgcattgtgctcggctatcccaagaatatgaacaataccgagggagagcgttgcgagaagacgaaagagtttgcacagatgctggagcgccgcaccgggctttctgtcgtcctatgggacgagagacttacgacggttgcagcagaccggcacatgatggagagtggaatacgcagagagaatcgcaaacagtatgtggatgagatcgcggcagtgtttattctgcagggatatctggattcactcgcgtttcagaaacagtgaatggagtaaatatggaaaaagtaaagtttgtggatccggacaccggggaatcgcttgcgttttttgtggttgaggagacaaaggttggcggcacgcactaccttctggcgacggaagaggaagacggcgactgtgatgcgtatattttaaaagaggtggaaacgaaagatgaggaatctgtctacgtgcttgtggaagacgacacggagctttctgccatcggaaaagtgtttgcagagctgctcgacgacgcggacattgcattttaagagacaaataataatggaggtaatattttgaaaaaagaaaaaaaagagaatagtggaaagctcaaaatcattccgttaggaggattggagcagattggtatgaacattactgcctttgaatatgaggacagtattattgttgtggactgcggtctgtcttttccggaggatgacatgtacggaatcgatctggtcatcccggatatcacctatctgaaggacaacattgacaaagtcaagggattttttatcacacacggtcatgaggaccacatcggagcaatcccttatgtgttaagagagatcaatgtgccgatctattctaccaagctgacgaacggtatcattgagcacaagttaagagagcacaatatgctcaccaaggtaaagcgcaaggtcgtaaaatacggacagcatatcaatctcggctgcttccgtgtggaattcatcaagacgaaccacagtattcaggatgcggcggcgcttgccatctactccccggcaggcattattgtgcacaccggagacttcaaggtggattacacaccggtattcggagatgctatcgatctgcagcgtttcggtgagatcggaagaaaaggtgtgctggcgctgatgtgcgacagtacgaacgctgagcgcccgggatttaccatgtcggagaagacggtcggcaagacatttgatgagattttcgcggacaacaagaatcaccggatcatcattgcgacttttgcatccaatgtcgaccgtgtgcagcagatcatcaatacggcgtataagaacggtcgcaaagtggtggtcgagggacgaagcatggtcaacatcatcggaattgcttccgaactcggatatatcagtattccggacaatacgttaatcgacattgaggagctgaagcgttacccggatgagcagaccgtcatcatcacgacgggaagccagggcgaggcgatggcagcactgtcccgcatggcaagcggcgtgcacaagaaagtgacgatcaagccgaacgatacgatcgttctcagctccaacccgattccgggaaatgaaaaagctgtatcgcgcattatcaacgagctgtcgatgaagggtgccaacgtgatcttccaggatgtccatgtttccggacatgcctgccaggaggaaatcaagctgatttattccctggtgaagccgaagtatgcgattccggtacacggtgagtaccgccatctgattgcgcaggcgaaagttgcggaggagctgggaattccgaaagagaatattttcctgctctcctccggagatgtgcttgagttaaacgatgaggcagcggcagtgacaggacgcgtacacaccggagccatcatggtggacggtctcggcgtcggcgacgtcggcaatatcgtgctgcgtgaccgccagcatctggcagaggacggtatcattatcgtcgtgctcacactggagggcggttccggacaggtacttgccggaccggatatcgtatcgcgcggatttgtctatgtccgcggcgcagagggactgatggacgatgccaagcatctgcttgatgatacaatgcagcactgtatggataaaggcattacagactggggcaagatcaagacggagatcaaggattctctgggggattttgtttggaaagagacgaagagacgcccgatgattatgccgataattatggaagtgtagaagattatgaaatggaacaaagtcgttttcaaatttgtcagtatcagcttttccatcctggttgcactgcttgttgtggtgggactgattgaacttggctcctactgctatgacttcggataccgggtgtttaccgagagcccggtggacgaaactccgggcagggatgtgaccgtatccgtgacggcggatatgtcggagcatgatatcggaaagatgttaaaagaagaggggctggtggaggatgcgaatctgttctatgcccagctgaaactatctgcttactccggaaaactcaaaccgggtgtttacacgttaaatacctcgatgactgcgcgggagatgttcgtgatcatggcagcggatgccggtgatacggaaagtaccgaggacaccgaggataccgcagacaccgggaataccggggcggcggatctgacagatgagacggacgatacacagaccgcagaagatgcaggggatgcagaggagacaccgtgatagtagatgagagacttgtgacctatatcaattctctggatgcgggaaatactgcgatgctcgatcagattgagcgggaagcgacagccgattacgtgccgattattcggaaggagatgcagagctttttgaagtttctgcttgccatgaagaagccggcacgtattttagaagttgggactgcggtgggattttccgccatccttatggcggagtacgatcctgtgccgtgtcagattacaacgatcgagaattatgaaaagcggattccgattgccagggagaactttaagagagccgggaaggaagcgcagattgcgctgctggagggcgatgccgcggaagtgttaaagacgctggaaggtccgtatgattttatttttatggacgcggcaaaagggcagtacattcatttcctgccggagattctgcgtcttctggcgaaggacggcgtgctggtgtcggacaatgtgctgcaggacggcgatgtgatcgaatcaaggttcgcggttacaaggcggaaccgcacgattcataagcgcatgcgggaatatctgtacacgctgacgcacagtgaagaactggtgaccgcggtgctcccggtgggagatggcatcaccttgagcacaaggcgttaaggacggcatggattacgcaggatgggaagatggcggaatccgtgcgggattacatgaagcatgaagatgcgatgcatgcgtgtgagaatagagaggaacgagaatatgagaagaccggagttactgataccggcgagcagtctggaagtattaaaaattgctgtgatctacggagcggatgcagtatatatcgggggcgaagcgttcggactccgtgcgaaagcgaagaacttttccatggaagagatcagggaggggattgcttttgcacatgcccatgatgtgaaagtatacattactgccaatattctggcgcacaacggagatctcgacggtgtgagagagtattttgctgagcttcgggaaataaagccggatgcgctgatcatttccgatccgggggtctatatgattgcaaaggaagtatgtcccgagatcgagcgccatatcagtacgcaggcaaacaacaccaactacggtacctaccggttctggtatgagcagggggcaaagcgcgtggtgtcggcgagagagctgtcgctggctgagatcaaggaaatccgtgccaatattccggacgatcttgagatcgagacctttattcacggtgcaatgtgcatctcctactcgggaaggtgcttgctgtccaactattttaccggaagggatgccaaccagggggcatgtacgcatccgtgccgctggaaatacgcggttgtggaggaaaagcgcccgggagaatacctgccggtttatgagaatgagcgcggtacttacattttcaattccaaggatctttgcatgattgaacatattccggaattgatggagtcgggtattgacagttttaaaattgagggtagaatgaagacagcactgtatgttgccacggtggcgagaacgtatcgaagagccatcgatgactacaagcagtcgccggagctttacagagagcatatggcgtggtatcaggagcagatttcaaactgtacctaccggcagtttacgactggatttttcttcggcaaaccttcggacgaagcgcagatttacgataacaacacctacgtgaaggagtacacgtatctgggtattgtcggagaacagaacgaagagggactctaccgggtggaacagcgcaataagttttctgtcggggagagcattgaggtcatgaagccggacggtgccaatatcacggtgactgtgcagcgaatcgtggatgaagaggggaatgatatggagtccgcaccgcatccgaagcaggtgctttatatcgaccttggacagccgcttgccatgtatgacattttgcgaagaaaagaataggatggtggaagacgatgaagcaggagaagtatgttgcatatgtaggaacttatacacacgagaacagcgtaggaatccatatctatgatgtagacgttgaggcgggaaaactgacggagcgcaaggtggttccgatcaacaatccgtcggatctggttgtctccaaggatcgcagatttctgtattctattgcggatgagggcgtggaatccttccgtattgagaaggacggcgatcttactccgatcaacaagcagtggatcggtggaatgagaggctgctatgtggaagtggatgacggcaaccgctatcttttcgtgggcggacatcatgacggccgtgtgagcatgatgcatctggaagcggacggaagcatcggcgggatcgcggacggtattttccacaaaggaatcggaagaagcattgcacagcgcaacttcgtaccgcatgtggactgcgtgaagctgacgccggaccagaagtttctgtgtgcggttgacaacggactggatcaggtaaaagtctaccgcgtggattatgagaacggtaagctggagctgattgacattatccgtggaccgctcgagtctgcaccgcgtatgatccgtttctccagaaacggcgaatatgcatacattctctatgaactgctcaacatcgtggaggtatatcattattctgtgcaggataatgagccggtatttgagaagatccagaccatcagcacttccccgaagaaggaggaggatacttgtgcggcatcgggtatggagatctcgaagagcggtaagtatctgttctgcagcaatgcaggcgtgaactctgtcgtgtgctatgagatcgaggagaagacgggaatgctcaccccggtatttacgacgaaggtgaacagcgattacccgaagatgcttgccatctatccggatgagaagcattatctgacactgaacaacaattccaacgatattttcagctacacgatcgattacaaggacggttattcgcttgagaccggttccccggtgaaggtagacaagccgaactgcatctatatgctgaagcttgaggtggaataagcaaataaagtgcgaatcaggaactgccgcaataagcatatcgttctttggacgataagtaatattacaagaaacacacttgaggatttcatgtggaaatgcagatggaatattcgttggagaaaaatgtgagcatttcttccagctgaatgtttgcatcggattccgtgtctcttccacgtttggacaatctgacgggcgcatgcccgacacaccggagacaatgggcggactttctggtgtccctaatggcatctcttcacagacaatataaaaccgcgcgaaccgaaactcgccggcatctgctattgaaaataaggcagatgccgactcagacatcggcttcgcgcggttatgtttgaagtgctatactgaattttcggctttaatggtaattagtttcatagtgtatatttaatgctccttgtaagatactaactgcattctacatctaagaataaggataggcaagattatcgtttacaaaagcattctggtgatttgacatgaaaataggaacaaaaacaagaatttttccacacataaaatgaatcatatttctataataaatgtcaagaaagagagggcagatcaatgaaaacagacgcacgagttcgctacacagtacatatgattcagaatgtttttctggaacttctaaaagagaaaccagttgccaagattacggtaaaggaaatctgtgaacatgcagaaatcaatcgcagcacgttttataaacactatcaggatgtgtatgatcttatggaaaaactggagaatgaagccgtagaggcatttgaaaaattattggattcctatgtacagaacgaaactgtaccggcattagtcactctgctgacctcactccgagaaaatcgagaacttcttttgccgttgcttgcaaattcttcgaatgatgattttatgaaacggcttacggatgcctgttccggatatgcgttatctcacctcacaccggaggcggactatacgagtaatccaaaacaggcggccgtctatgcttatcttgcaggaggaacatcaggaatcatcagcaattggctggaaaccggtacacaggagcctccgcagcaggttgccgaattgattcagtcgttgaatgaaaccgtgttgacggtattggttccctgaagttttccaatttccttcaaccatgcaatctcatctcgaatcgtctcatggaaaggtctggtcttgtagccaagatctttttttgcttttgaggagtcgaaagcattatttcttgacagattataaatcatgtattttgtaagtgcaggtgtggagcccttcttctgcgcctgcttttccaatatatttgcaacgaaagaagccagtggaagaggaaggaagaagagcggacgtttgcagcgaccttcttttgcaacaatgtttgcaaattccggataagtaatgacttcatttgccagaatatagctctctccggattttccattttctactgccaggatgactgcgtttgcaaggtctcttacatcacacaagttaaaggttccgttgattccgatggcagcttctccgttcatctgtttgagcagtccatcggttacctgtccgattgcattgtctccaggtccaaggatgccgcttggaagtacaaggcaggcgttcagatgctggttctttactgcatctaacacaagctgggaggccattgctttggattttccgtaagcactgatcaccggttccggatcgtaatagctgatttctttcattacggagcctttcggcgcttccggaatggaaccagtgcttcctacatatactaactttttgcattctttatgctccagacacagatcaataatattctgagttccgcctacattgatgtccatcacaatcttcggcatctccatgccgagtgcaacgatgcttgcacagtgcagaaccactgtttctgtatccgcatctacatggaagatagtttctaaagatgctttatctctgagatcaccttctacaatctctacgtcctttggaatgtattgaattgcaggatcgttcggcagtacaaatgcacgtacgctttcgttctgctccaacagctgtctgcatacttcacttccgagatatcctgccgcaccggttactaaataagttcttttatttgccatgataattcctcctgatatttgtgaataattctaccggatcttgctgctgctcatgagatggatgcgaacagcaacaagaggtgtttctgtttttttgggggggtacaattgccagtatagcgagaatgaacagaaactcaatcatcaatgtggaaggaaatgtaaaataatcgacaagggagaagaatctgttggagaagtgggcacggatgatgaaattgatgttataatattaagaatgaatttactaaattactgaatagagggaagtatttgaaataatgaagaatatgaagttaaccgaaggacctattgtgaaaaatatgctactctttgcattaccgatgatgctgggtaatttcttgcagcaaatatataatatcgcagatatgtttattgtgggacggtttatcggttccgacgcattggcggcagttggatcggcatacacattgatgacatttttaacatcgctgattatagggctgtgtatggggagtggagcattattttgtgggaatagtctttatatttttgtataatttctatgcgtatcttttgcgctcagtaggaaattcgattgtaccattatattttttggcagtatcctcggttttaaacgttgttttggatttatattttgtgatttccctaaaaatgggaacgcccggagcagcgattgctaccgtaatttcacaaggaactgcgggaattggctgtctgtttcttctgtatggattttacagagggattgggcgtgcagaaatgtcttttatactgactgtcatttctcttggaacaagagttgtattagcttatgtctttgcaccgattatcggcgtaacagcaatttggtgggcaattcctatcggatggcttctggcggatacggtgggactgatatattacaaaaatgcctccctatcatatattgacagggaaacactttattcaaatagaaaatcataaagttatgaaccgtgtagccttttttgggtgctcctgtagttttgcttgaaacgagcaaagctacgggagcatttttattcgctatctttatatgtccggaattagaggacctccttattccgaacccaattatagtcaggtattccctaaaaagtaatacatgttcttaaaatcgagaaaagataatgaaaatgctaacaaaaacgtgaattcctattcatggaaaaaagtactttgagatattctatacttgaaaataggaaagctgtaaagggcagcataattgaaatgaaaaaggagagaacgaaatgatgaatacattaccacaagattttctggtaggtgcagcaactgcagcacatcaggtagaaggtaacaacatacacagcgattactgggcaatggagcacatgaaatacggaaattttaatgagccctctttagatgcggtggatcattacaaccgttatgaagaggatatcaagatggtcgcagaagccggtctgaatgcatatcgcttctctattgaatgggcaagaatcgagccaaagcagggtgtctatgatgagaacgagattgaacattaccgtaaagttcttacatgctgccgagaaaatggggtagagccgatcgtgacgatgatgcatttcacatctccaaaatggttgattgagaatggcggttgggagaatgaagcaaccgtagaggcgttcaagaactattgtcagtatgtaacagagcagttgggcgatctgatgcattatgtctgcaccatcaatgaggcgaatatgggaatccaggtagctgcaatctccgcacgttacagagcacagatgatggcaaagatgcagcgaatgcagcagggtggagcagaagagaaaaaggatctggaaggaactgctcaggttggaatgaatttcaacgacatgatggcaaatatgcagaaacagaaagaagagaacgtggaaatattcggaacagatactctccagacatttgtcagtgcaagaacaccggagggtgacatgcttgtgattcgtgcacatcaggcagcaagagcagctatgaaagcagtaaaaccggaacttcagattggtcttaccttatcactgcatgatattcaggcacaggaaggcggagaagagacagctgctaaagaatgggtggatgaatttacacactacgttccttatatcaaagaggatgatttctttggtttacagaactactcccgttcactcattggaccaaacggaattcttccggttccggagggagcagagatcacacagatggattatgaatattatccggaaggcttagagcatgtgatccgcagagtatatgaggaaatgccgatgccgatcatggtgacagagaacggtattgcaacagcagatgatacacgaagagttgcttacattcagacagcgatgaaaggtgtggagaactgtattcaggatggcattccggtcaaaggatatatgtactggtctatgatggataatttcgagtggcagaaaggattcggaatgacatttggtctgatctccgtagaccgcacaacacagacacgtacagcaaaaccaagtcttactgtacttggaaattatacaaaataatgaaaggtaaagattattagaatatgagaaatgtaatggaattaaaagacaactggatgtttgtgaaagaagcagagaatgcagcagatgcagcattaaagaaaggaactgcagtaagtcttccgcatacatggaatgccgtagacggacaggacggcggcaatgactaccacagaggtacctgctggtatgtgacaaaatttcagaaaccggaattagaagcaggaagtcaggtatatgtggaattccttggtgcatctgtgatcgcagatgtctatctgaacggagaagcagtggcacatcacgagggtggatattctacattccgtgtgaatctgacagataagctgcaggaagaaaacgtgctggcagttgccttgaataatgcagacaataattatgtgtatccacagaaagcagactttacattctatggcggtctgtatcgtatggtgaacttgattgttgtaccggaaagccatttcgaactggattatgcgggaggaaatggaattgcagtgactccgaccgtagagtgtgacgaaaatcgcgtgccgacaggaaaagcatctgtgaaggtggagacatgggtgacaggaaatgcggattcagtcgtgattacaatcacaggagaagagagtgaatcaaagacagtttcggttgttgacggacacgcagaagcaacattcgaactggagcacgttcacctgtgggacggtgtggatgatccgtacttataccatgcaaaggcagaactttcaagcggagatgtgacagagactacatttggatgcagaagcttctacacagatccggaaaaaggattcgtattaaatggacgcgtatatccactgcgtggtgtcagccgtcatcaggatcgtaccggagcaggaaatgcattgagctatgagatgcacaaagaagatatggagatcatcaaggaaatcggtgcgaacacaatccgacttgcgcattatcagcatgcacaggaattctatgatttgtgtgatgagtatggaatggttgtatgggcagagattccgtatattactatgcatatgccaaacggacgtgctaacacattaagtcagatggaagagcttgttgtacagaattacaatcatccgtccattgtatgctggggactttccaacgaaatcacagccgcaacaccggttgacgaggatttactagaaaaccacagattgctgaatgatctgtgccacaagttagacaagactcgtttcacaacgatggcaaatgtattcatgcaggagacagacagcccgttgttggagattccggatgtgaacagctataacctgtatttcggatggtatctgggtgaactggaacagaatgatgaattttttgatgagtatcatgcgaaatatccggatcgttgtatcggattttctgagtatggtgcagacgctaatccacagtaccagagcacaaatccgactcacggagattattctgagacttaccagacagtatatcatgagcatatgttgaaaatgattgaggaacgtccatatctgtgggcaacacacgtatggaatatgtttgacttcgcggcagacggccgtgatgaaggcggcaagcatggagtgaaccagaaagggcttgtcacaatggacagaaagctgaaaaaggatgcattctatctgtataaagcatactggaacaaagaggacgctttcgttcacatctgtggaagcagatatgtagaccgcaaggaagacacaactgaagtaaaagtatattccaatcagacaacagtatctttgtatgtagacggaacattgttagaaactcaggacggaagtcgtattttccgatttgcagttccgatgacaggggagcatgagattgttgcgaaagcaggcgcagaagaggacagcatccacatccgtaaggtagaggaagcaaatccggattacgtgatgggagaaatcaaagatgttattaactggtttgatgatgaaccatataaaccggaatgctattctatcaaagataaaatgagtgagattaaggcaagtccgaaagcaggtgcaattctagcagaactgatggcacaggcacctggagcagaatcaagaggagatgtggcagaaagtgtcaaagacaatccgaatctggtccgcatgatgggaagaatgacgctggaaagtatgttaggacatatgaaagacagtatcacagaggaacaggtgaagggcttaaaccgcatgcttcagcagattaaaaaaggcgaataggcaggccgtcagttacaacaagaaaaacgtaaagaaaagaaggcacatccgggagtttggcttaaaccgggatgagcctttttctttgctaactacagctttgtatttttattccgataatcgctcggtgacatcccgaatgccttctggaaggaagaggagaaataacttcgggagccgaaggcgagttcatcgctgatttcctgaatattcatagtggttgcactaagcagcagctttgctttttctaattttacctgtttaataaagtctgcaatactgataccgatttctttcttgaatttgtgggaaaaataatattctgtgtagccggttctttcagcaagttctgcaattgagaacttctccccggggttcacggagatgtagtcgcaaatattctgaatctgggaagaaacatcagtagtctgttttgcagagcggacacgctgcataaaatcttccagcatagtatgggttaagttatttatggtagatgcacttttagcttcttcgagcttctgcatgtaatagtcgtttaatgtgtaggcaatggaaggatttaatccgccttcaatcgaagcacgtgagcagagtacgagcagaacaattacatcatttttctgtttacggagagaatcaccgatatcaaactttacaccactgcttagattggtggatttgccaagagccttcctataatcaggacttccttcccggaacatctgaagcatctcctgctcggctttccagataccggcatgttcatcagatatcagtttgaggtcattagaatctgaagtctgcccctgtggataagaaatgtcggcggtagtaattttttcacctgtaacagcatagtgaaacatcagggtgtactggtaaagacttgaggaaggcattaccggaatctgatcgatctgccgaaatattttcgagcgaagttttacagaaagcgtacgcgaatccaggtcttttttaattaacaaatgcgagttcttgccccttaaaataggtcccagcatatgaatgtgctttaattcagtctcctcgtattcgaaaacagaaatgtaaagaagacccatagaggaatccagccatatcggtgtgcgttttccggatgtgacatattcttgtaaagtgtcagcaaaatccagaatagaggaggcatcactgattacaagatcctgagggcagtttgtatgaataagttctaattcaggagtatacgtccataaatacacatcataattgcagcgcagcatttctttgaaaaattccagccgttcatttattgtcatctcatatcctccacttttcattattatttattcaaagatttcgaattctatatttcttctatccacgggagaagcaacgatatatcggattcatactcaaatcgaagtgttccggtttcaaaaagttccggttcattggcaatcgtacagaagatgtactggctcagtgcagatttcaaagcaaggcagtctccgtcgggcgtttcaaaaaacacctctccggtacatttcttcaattcttttaaaaaagccatcatatcaatctttccttttagtttcataagattaagtcctttcttctttctattataatcctttccttttattatggaagataaagctgagtgaaaagacaattttatcgtgaaaatgttatgagattcgtcatgtgatatatatatcatgaaaaaagaaacgaaaacacgaaaaatttgttacacaaccggggtggcacttttataatcaagataaagaatcaaaacaaaaaaggtattgggaggaacataagaatgaaagaaaagaagaaaaaattaacccaaagtgaaattgacggtgtgcagtatcgccgtgcgaaattgtggcagatcatctgttatgcatgtaacgccttcattggaatgagcgtgtattcgttgattggaatggcaagctacagtgcaagtattggattcggagttgcaacggccgttgtgggtgtgattttgacatgtacacgtattctggatggaattacagacccgctgcttgcatttgtgtacgaccgcgtaaacacaaagtttggtaaaattcggatcctaatggttgcaggatggggcattgaagcaataggactgctgggaatgttcagctggttgacagggaagtttacaggtattgcaggtatcgttgtattcacagtactttatgttgtatatgtaattggatatactatcgtaaatatgacaggacagacaattccggtactgatcagtaatgatccaaaacagcgtccgacaatcggcgtatgggtgacagcattgaactatctgctcccgatgacattgggaattgtatttaatgtagtacttcttcctaagtttggcggaacaatcaacctggaatacctctcagcagtatgtaagttagtaattatgatttcatttattggacttgttcttgtatgtctaggggtaagtgagtttgataaaccggagaactttgaaggattgaatgtaaaaaaagaaccattgaaagtgaaagatatggttgctgttctgaaggaaaacaaacctctgcagtgttacgttgcggcagctgcatcagataagattgcacaggtaacagcgtcacaggcagtcattacgacaatgatgggtggaattattatcggaaatatgggattatcttctatattaggaatggtttctatgctgccatcgattatatttgcaatttttggtgcaagatatgcaggaaagcacggaagtcaggaagcaattaccacatggacaaaggtatgtctggtattgggtgcaatcttaattgtattcttcgttgttatagatccgagtaaaatcggtgtgatgttcagttcaagtatgattatctatgtggtactgacattatttttaaacggagcaaaaatgtgtgtgtcgacggcaaatacttcatttatggcagacatcgttgactatgagttagacagaacaggaaaatatgttccggcagttgtatccggtacatacagcttcctggataaaattatcagttcatttggtgcgttgattgcatctgcatcagtagctctgattggatatacatcaacgatgccacagccgggagatgagtgtacaactggtgtattggtgttgacaattggtcttacatatgcacttccgatgttggggtggatctgcacattggttgctatgaaattctgtcatctcaatcgtgaggatatggtagcggttcagaaacgtatcgcagaaaagaaagaggctctgaaacagcagaaggctcaataatatggaaaatgtagaaattacagtttggcggaagctaaactggaatttttacaataaggcatatggggaaggagaaaacgatgcaaaatcaggaaatatttaagagaccggtatggaaagcaatattttccatggggatcccatccttgatctcggttctggttatgataatctacaacatggcggatatgtatttcattggctttttgaatgattacacacaggttgcggcagtatcccttattatgccggtgttcagtattatgacagcggtcagtatgctgcttggaaatggtggctgcaccctgattgcgcaggcactcggagcaggagagaagaaacgggcacgcagctatatgagcttgtgtatctggacagccattttattaggagtgattatagcaggtctgattatagttttttcgaatcctttgttgaaattcctcggaaccaatgaggaaatgtggcagtatgcaagaaattacatgcttattctggcagtggggtcaccggcaatgcttttgaattatacaattgcctgtcttgtccggggagagggtgtgattaaaccaggtttaattgccaattttgtctcaaccggtatgaatattctttgggatccggtgttgatccttggggtgaaaatgggtgtatcaggagccgcactggctaccgtgctgagtaatgtaattggcattgtctatctgatttggtataaaatgcatcatgaaatgattctgacattcaatccgaaaccggcgagagaaagtgtacgacatctggggcgagtatttgcacttggatttccaaatgccatttccaacattttaaatgggtttgcatcaacattcagcaaccaactccttgtactgtacggaacaagtgcagttgcggcgatggcggcagcaggcaaggcaacgatgatagtaggattactccagatggggctctgtatgggtgttcagccactgatggcgtattattacggtgccggggatatgagacgtatcaaagaggtcgtgatgaagttatttattcttacattagggattggcgttgttttcggagcggtgggaatgcttggaagcaaagctctggttggtctgtttatccgggatttggaagttgttgagctgggacagaagattgtctgcattcagttgttgtctgctccatttgcagggatatattatatcggacagaattttatgcaggcgacagggagtgctttgatggcgacgattacatcagttttgaggcaaggagtactactcataccgcttctttacattatgaatgcgatcatgaagatgatgggtattccaaccgcacatgtgatggccgattttatttcgattgtagtgacatcggtacttacggtaattatttataaaaaagtgaagaatcaactgaaacaaaagagggaggcttaattatgaaatatttttgtaatccggtaaatatcaattaccgctatcagtttaacatggatccaagagagggggcgttgaaggttgcccgcgaggcggcagacccgtccatgatttatttcaaaggaaagtattatattttcgcatcgatgaacttaagtgtctgggtgtcagaagatctggctcactgggagagtcatcgtctgccggagaaccttccgctgtatgattacgcaccggatgtgcgtgtgatgggcgagtatgtgtacttcagcgcatcaagacgcggagaggtttgtaatttctaccgcacgaaagacatcctaaacggagagtatgaagagattccgggaacctttgatttctgggatccgaacctgttcgtagatgatgacaaaagagtgtatttctactggggatgttccaatacaacaccgctctggggcgtggagatggatccgaaaaccatgctgccactcggcgaacgccaggtgatgattgagggagatgcatttgccaaagggtacgaacgtgcaggagaggatcactgtcagtggccactctcagatgaagagattgagatccgttttcaaggatttttgaaaatgaatcatcagacagaggagcagcttccgaaagaactagttccgttgattaaaggcatgctcagtcagaaaccatacattgagggtgcatggatggataagtgggacggaaaatattacttacagtatgcatgtccgggggcgcagtataatgtctatgcggacggtgtctatatcggtgacagcccgctcgggccatttacattggcgaagaacaatccattctcctataagccgggcggatttctcccaggtgcaggacatggttcaacgatggaggatacagcgggaaatctgtggcatacctcgaccatgcgaatcagtgtgaaccagcagttcgagcgtcgtgtcgggctctggcaggcaggaagggatgcagacggagagttattctgcaaccagcgttatggtgactggccgatggaagtgacaggcgagaagcaggatccatgggagaatccaaagtggtatcttttaagttatggaaaacaaatgacagcttcttcttgtgaagaaggaaaaggtccggaaaaagctgccgatgagaatgtacagacatggtggagagcagcatctgagaagccgggagaatggctacagattgatcttggcaaaaactatgatgtgcgtgccgtgcagatcaactttgcagatgataagattgacattccggttccagggaaaattaaaggaacacagacacagccaagatatatcgaagagcaggatcatgtgacgagatggattctggaaggctctgtggatggcgagcattatgaagtgttggagaataaatcacaggcggagacagatctgccgcatgatttggttgtgatggaagagggaaaacagattcgttatgtgaagttgacgattctggagatcccatatgatcaaaaaccatgtatctcaggattacgtgtattcggtatcggggaaggtgcgaaaccagaagtgccagaattcgaggcagtacgcgaaggtgatgtggatatgaacgtgtccatcaaggaaaatggagcaatgggctacaacatcctatggggacatgcgccggagaaactgtaccacagctatatggtattcggaaataccaaaaaggtaggagcgcttgttaaaggacaggactactgggtgagagtggatgctttcaatgagagtggaatcacagaaggtactgtgaagaaattataaaaaggagcgtcacacgatgccaaaattatttgcaacaggaaattcagaaatcagttcccgtgaaaagagaaacatggagcgtgccagaaaggtggcatcccagggaatggtattattggaaaacaagggagtacttccgattgacaaatccgtcaaaacaattgcattgttcggtaacggtgcaagaagaaccatcaaaggcggaactggttcgggagatgtcaacagccgctttgtggtgaacgtggaacagggactggaagatgcaggcttcagtctgacgacgaaagcatggatggatacatatgatacacaggtagagactgccagaatgggatattttggagaacttcagcaggagatggcagcaaaaggaatggctgctgtgatgaaaatctttacggagccatttgtagagccggcaatttccggagtgagtcagaaagaaattgatgcgatgaaagcagaccttgccatttacgtgctctcccgtaattccggagagggaaaagacagaactccgggggcaggagattatgagctgagtgatacagaaaaaactgcaattgcaaatcttgccaacgcctacgggaatctgattgtagtgctgaatgtaggcggcgttattgatacaaaattcttacgtgcacaggaaggcatcggtgcaatcttgctaatgagtcaggcgggcaatatcggcggacatgcgcttgcagacgtactgacaggcaaggtatctccgagcggtcatctgacaacaacatgggcagagaactatgaggattatccgaatgcgaagacgtttagccatatgaacggagatatccatgatgaatattatgaagagggaatctatgtcggatatcgctatttcgatacctttgatgtgactccggcttatccgtttggctatggaaaatcctatacaacatttgacgtaaagacagaagaagtgactgcagatgcgaaacagatttccgtaaaggtatgtgtgacaaataccggcgctacatacagcggaaaagaagtggtgcaggtatattattccgctccgacaggcaaactggaaaagccgtatcaggaactggcagcctatgcgaagacaaagaaacttgctccgggtgagagtgaagagcttattatcacttatcaggtggatcgcatggcatcttatgatgtacagagagcctcttatgtattggaagcaggaacctattatgtcagagttggtgtgaattccagagcaacgaaggtgtcagccgcagttgtgctggatcaggagactgtgacagaagtactgtcgaatcgccttgtattggactgcgagatgaatgagttatcatcagcagatgtgacaccttatggttatgcagaggaagaggctgaaaaagagcaggcttgtaagctcgatatcgcttccactgatatcgaaacaaaaactgtgacctatgaggaaacgaatgcagagattgctgcaaacacttcagagaaaaagattacgatgcaggatgtcatgtcagggcaggcgaccttagatgatctggttggtcagctgaccattccggagatggcagaattatgcgtcggtacatccagaggaaatatgggcggtgacactgctatcattggcagttcctctgcagttgtaccgggggcggcgggagacaccacttccctgatgattgaagatcgtgacattcgcaatctggtactggcggacggaccggcaggacttcgactgtcgaagcatttcaaggcagatgcagaaggcaatgtgattccgggaacaagtgatgcgccaattccgggaatggacttacttatggccggttcaccaaagccggagattccggaagatgccattgactattatcagtactgtactgcaatcccgattgccacactgcttgcccagacatgggatgtggatgcaatcaaagaatgcggagatattgtcggggaagagatgaaagaattcggtgtgacactgtggctggcaccggggatgaatattcacagaaatccgttgtgcggacgtaacttcgaatattattccgaggatccgcttgttgcagggaaatgtgcggcagcagatacattgggcgtacagcagcatgccggagttggcacaactatcaaacatttcgcactgaataatcaggaagataacagaatgcacacgaatgcacacgtcagtgagagagcggctcgtgagatttatctgaagggattcgagcttgcagtcaaagaagcaaaaccgatgtccattatgacatcctacaatctcatcaacggaatccattctgccaataataaagatttgttgacagccattacgagaaatgaatggggatttgacggaatcgttatgacagactgggggacaaccggcggtatggagatgaatcagggaatggaattcaagtacggatgctccagtgcagcaggatgtatcaaggcaggaaatgatctgacgatgcctggaaaacaggaggatgtggatgagattatcgcttcagtaggtgcgaaagatggcgatgtagtctgcccgatcacacttggagatctgcagacctgtgcgaagagaatgttgaatacgatcatgaagagttcggcatatatggaataagtgaggagacaagataacatggcagtaaaagcaattcagttaattcagatcggaacggcaatgggttccgaagaaaaggcaagagaaacgatccgcctgatgaaagaagccggatatgacggaatcgagctgaatggattcatgatgaaaaagatgccgccgatcgttcgtgttctgacaacccttgcggggatgccgattggaaagacagcgaaattagactggaagaagttgattgcggacaccggacttaaggtggtcagtatccacgaggatcttggaagcattcttagaaatccgcaggaaattatggaagaagcaaaaacattttccacaaagtatattgtcattacgggaatgcatcggtttgattattccaatatggcagcggtactggaattggcacagaagctaaataaggcaggaaaaattctgaaagaaggaggcatttccttgttatatcacaatcacaactgtgaattccgcaaagtgggagcgggaaaatgtgcctacgatgtgctgattgaaaagacaaatccggaatatgtcaacttcgaattcgattcttactgggcgacagaggccggtgtggatacgattgctctcatggaacgcttgggagagcggatgaagctctaccacatcaatgaccgaggaacaaggatgagcggaccgggaggacagattctcaaatcggacagtatggaacttggatacggtaatatgaacctgacgaagatggtggagattgcacagaaaagcggtgtggatgccgtgatactggaaagccataagaactgggtggacaagtccccggtgaagtcgttccagctcagtgcgaagtttatgaatgagcatgtgaaaaattagcttcaaaaaatgttgctctcaaattcagaaagaatcatttgaataacaggagaaaatgggaatatgaagaaacaaaaattcaatcatgactggatattcacagttggaagcggaagctccctggatgcattggctggtgggaacaatacggcaaaacaggtgactctgccgcgtgatgcatcaataggaagagagcgaaacccggaagaaccgaacggaagcggaaatggatttttccgagaggaaagctatgtgtacaccaagacattttcgatgaatgcagatgataaggataagaatgtatatctggagtttgaaggggtataccagaatgcttttgtatatgtaaacaattcatttgccgggaaatgcccgtacggatatagtaatttttatgttgatatcacaaaatatctgaactacaacgaaccgaatgcattaaaagtagttgtcaaaaatggagttccgagcggacgctggtatacaggaggcggaatttacagagatgtcaatctgatgattgctgatcgtcttcatcttgttccggacagtgtacagcttgcagcaattgaagtggaagatgatcaggcaatcattcgggcaaagtcaacaatcgcttacacaggaatcggaatccgggagattgcactgtgcacggaactgatggatgcagaaggaaatgtggttgctgcagatgaaatgccggtgatggtcgaggaacattctgaacaggaatatcagcagaaaatgtatgtaccaaatccaaatcgttgggatgcggagaatccatacctgtatacttatcgtacgtatatcaaagaaaatgattccgtgattgatgaggaaacaggaaccttcggaattcgtaaacttcagttggatacaaaacacggattgagagtgaatggaaaagttataaaactccgcggcggatgtattcatcatgataacggaattatcggaacagcagaatttacgcattctgcggaggagcgggtaaagaaactcaaagaaaccggcttcaatgcaatccgcagtgcccattatccgatgagccggaagctgttggaagcatgcgacaaatacggaatgtatgttatggatgagtattcggatgtatgggtaagtaccaaggtggaattcgattatagtacacagatgacagaatggtgggaacacgatatcgaaaatctggtgaaaaaagattataaccatccgtgtgtgattatgtactccatcggaaatgagattccggaggcgggaaataaattcgacgtgcagtggggcaaaaaactagcagataaattgcgttctctcgatgataccagatatacgacaaacagcctgaatctccttctggccatcatgaatgatcttccaaaattaatggcgcagaatgcagccgcacaggcagcagcgaatacagaaacagatcagcctcaggaaatcaacagcatgatgaacaatctgggggcaatgatggcacagttcatggcaagtgattttgcagctgagaaagtgaaagaggcatgtgcccaggtggatattaccggttacaactatgcggcagcacgctatgagattgatggaaaactgttcccaaaccgcatccttgtaggttccgagaccaatccgccggatttggacaaaaactgggaactggtcgagaaattgccatatgtaatcggggatttcgactggacagcatgggattatatcggagagacaggaattgggaaaattaattacacagatcagcagagcatgggattttacgcaccatatccttgcaaaattgcctattgcggagatatcaatattctcggaaatcgcagaccgatttcctattggagagaactgatctggggattaagaaaagcaccgtacattgccgtacagctcccgcagcattacggagaaccacagagtacgacacagtggagtatgtccgatgcagtccgcagctggaactggaacggatacgaagggaaacctgtaaaagtagaagtgtatgctgcagccgatgaagtagaactgttgattaacgggcagcgtgtggagcgtaagaaagtcggagaaacaaagaaatacatcacaattttcgacaccacatatcatgccggaaaagtagaagttattgcgtacagcgacggaaaagaatgtggcagagatgaaatactgacagcttcagacgaggttgtgattgccgcaaaagcagaccgtacacagattccggcagatggaagtgacatcgcctatatcgacatctgtatgcaggatgctttgggaattttgaatccaaatgcagacaaagcggtatctataagccttgacggtccgggagaaattatgggatatggaagtgcggatccggaatcggaggaaaactattacgatatggttgcgaaagcatacgaaggaaaacttcgtgctgcagtacgcggaaccggggaaacaggcaaaatcgtagtaacattatcggcggatggattagagtcagtaaaagtagatgttgaagccgtataagtacagtaatcattgaaatgatttcataatagaaggaggagctgacataagttggctcctccttttatctctcaaggagaaagggaagagtttacaattgctccaattctcccagcatatttgtaacaacatcctccggcagtccgagcatcggagcgagagctttgaaagtcataccgtaagcggcctttgcctgttcattttctgcaaagccaggcagatacttgtctacaattgctttggcgtcagtgttctccatgatagcagcaattgtgctgtctgcgtttaattttcctcaggtcaggatttcaggatgcttccagcttgtcacattcttgcttccggcggagagtgcaccatcgacaggaattgcagctccggtgatgtaccgtgacatatcacttgcgaggaagagtgcaagataggcacattccatcggatcgcccatacgtccggcaggacagtcatttgcgaagaaatccattgcctgttccggtgcatctccgaagatacttgttttcgtgtatcccggacagattgcattgactgtgatcccgtatttagcataatccagtgcagcgacgcgtgtcattccgacaactccgaatttggttgcggtgtaaagagcctgaccacgttgcggcatgagtcctgcgatagaagcaacattgatgagaaatccgccttcacttttggatttgaagattgcttccgcaccatatttcattccggcaaagacgcctttgctgttcaagtcaaagattttctcataatcatccaaatcatattcatgaagaggacttccgcccatgccgatacctgcattgctcacaactccgtcgagacgtccataatgaacaactgccttatctacgagatctttaatcgcatttccgtcactacaatctgtctgaacaaaaattgcgtcccctccattgttgataatatcgttcactacagcttgtccctgttccacacttcgtgcggcacagattactttcatgccatttgctgcatagcagcgggcaattgcctctccaattccacggcttgcaccggtgacgattgctacttttccttctacacttttgaaatccataaataatatcctcctgatgagttcataattgaatttagaaaatacatttctatgagacaagtttaaaaggaagaatgaaaatgaaggaataaaaaatcgtgattttgagtgcaaattcgtgtaaaagaggttgtgacatgtattcggaaacaaaatcaagagaaatagaacttgagatggggagagtgatgtgggaaggggctgaccccaatgtgatgccatttcaatttatagaaaaatatgttctaaggttatcagaaaagtgagattagtgaattggtgtgattgctgagagaaagagcaaggctccgtgcaggaaattcaccggttcctcttttaatgctgtagagcttgcagcatctccatcgttagaacttgcatatatcgtagctgccccgagaatggcatattatatgacctacagtacgagaatttacgatatttatttaaaatacattgcaccggaagatatgcatgtgtattctatagatgaagttttcatggatgtaacggcgtatctttcaacctacaagatgacagcccatgagttggcacttaaaatgattcgggatgtccttggggaaaccggtgttacggcaacggccggtattggcagcaacatgtacctttgcaagattgccctggatattgtggcaaagaagatgccagcagataaggatggggtgcgtatcgcagagcttacggagcgaagctacaggaaattattatggaatcatacgccactgaccgatttctggagaataggcaatggatacgccaagaaacttatggaaaacggcatgtttacaatggggatggggcctactacaatagctgagattcgggcatataaaccacagaataacagtgtaagctccaggcaggtattacattgccctatacagcagagaaagcaaagcttattgtgaaggagatgacggatttactggttcttgacctcgtggataagaaacttcttacagaccagatggtgcttcatattggatacgatatcgaaagtctgacagatccggaggttcgaagaaagtatcagggcgagctgatgggagtaagtggatataatcttgcggtctctctcgtatggtttttggcattgatgctgggaacaggagtacttccgcatgtaatggacattacaatcaattatggatctgatacatattggtgcagaggaggtatttttgttaatctctgtattgtgtttttaatcattcttactattacgggatttgggtatactatcagttacaaaatagtggagataaagtgtattcatttggacggtggattggatggagcaatggaagtaaatgatgccgctatgaatgcaaatctgaaaggacaaatagcaaaagcggcagggggagcgtatgttgatacgaaggcgcttacaggcccgatggctattttgtcaaggtattgtgtgcaaaatggtgtaagtataatgaattcgcgtgtgtttaagtggataaacagagcatgcattgcagcgcagattatatttgctgttgcttgtttctgtatctttattcaatattagtagtcgggagaagttaatgggaaagataataattcacaaatcgcttttaggccatataaagattgacggaagttttattgatgataaagttaaagagttagaaatggctagtggaatatatgatatagttggcggaatagattgcgattcatcatataatacagaaagctatcagcatggaagtaaatccagtataacctggggaatacatgaaaaagtgaaaattgacgataaatccgtttgccatgtgcatgtaaaaagaaaattgtcatttttatatattgttccggtaatcaaagtgaaatatgagagtaatgaggtattataaaatgtcagatatcaaaggtaagatagttttaaaaacacctttcatttgtgaatgttgtatcagaagtgatagggtatacaaaactctaaattctttcaaaaaaacacaatggttgaactatcagcaggcaagcatatgattaatgtgggtatcggttatgatgaaatgccagagagcagcagagtatatagtgcggatacttgggcatgggaaagcgataaagcaatagaaatcggtgaaaatgctttgcttatttcgataaagagaaaatggcatttatttaggccggttacagtagaagctgaaataataaaatagtggaaacatactgcaaggagataatgatgagtaagttgagttttgataagaaaacctttaactggggctatggttttgtctataccttccaaagtcgaagttagaagaccacagtcacaattattatgaattctatttctttttggaaggaaatgtatcgattgaaattgcaggagaaaggcgtccgcttcagtacggagatgtcgttctaattccgccggaagtggcacaccatgttgtgattcatgatgtggaaatgccgtatcgcagatttgtcttttggattagcaaagagtatgcaaatcagttgatgcagttgtcacaagcttacggatatctgatgcaacaggcagcggtgactggtaaatacattttccataatgatagaatttcgtttaacgcaatacagacaaaggtgtttcgtttgatagaagaaatccactccaatcgttttggaaaagaagcgaagatatctttgtgcctgaatgatctgatacttcatttgaatcgaacagcatatgagcaggagcatccgaagagtcagaaagaggagcagaacttatatgagaatctgatggattatatcgaagaacatctagatgaggaattgacattagagaagctggcaggtgaattctttgtcagcaaatactatattgcgcatatctttaaagaaaatattggactatccattcatcaatatatcatgaaaaaaaggctgtctgttagtagggatgccattctcaccggatacaaaatcacagaagtatacttgatgtatggatttaaagattactctagcttctttcgggcgtttaaaaaggagtacggaatatcgccgaaggaatttcgagagatgaattcggtggatgtaaacgaatttacgaacaaaatatagaaatcatgaatgtaataatttttgccattcgctataatttctattatgagataccctatgtataatggaaatgaaggagaatattcgaatatgaaagcgataaaacttagaacagagcagaaggtaaatccaatcggaatagacgggaaagaacagttcctctcatggatttgtgaggacggaatctctcagagtgcatatcagattaaagcatgtactggagatcagaccatttatgatagcggtaaagtggcaagtcaggacatgcatcatctgttggaactgaatctggaaagcagacagcgtgtctgctggaaggtgcgtctgtgggatgaaaaagacgaagccggagaatggagtgaagaggcttattttgaaatgggtctcttaagcgatgaagattggaatgcccagtggatcaatccagaactttccaaacttacaacaaaggaatacgactgcagtgatgcaatcaatgcacaggcaaagagggaatgggaaacacgggaaatcgaaggcgagtatgaagtacatcagcctgcaagctacctgcgacgtgtattcagtgcacctgagggaacaatgaaaagattctatattacctgtcacgggttatatgaggcatggctaaatggaaaacgtgtaggtgatgccgttctgatgccgggcagtagcaattacaataatgagcttatttatcagacatatgatgttgcagatttattgcgtgaaggtgagaatgagctggtgattgttcttggtgatggctggtatcgttctacatccggagtcgatggtgaccgcggtgtgttcggacaggaactgggattattatgtcagttggaagtggatggagaatcggtgcttgtatctgatgagacatgggaagcaagtcaggcaggacctctgcagcagaatgatatgcagcagggagaagtatacgatgcgagaaaagaaacatttgccacagaaaacggcgtgtggcatccggtaaaaacagaagactttgataagaacctgctgaaaggaatgaatactgtcccaatcaaggaaatggagaacttcgaaggtaaactgattcagactccgaatggagagacgatcatcgatttcggacagaatcttgccggatatgtggaatttactgtatttggtaaagacggtgaaacgattgttctgactcatggagagtctttggatgagaacgggaacttcacgacggagaatttccaggatcgtaaacgccacaaagagggcggtacgtatcagatgatttcatacatttgcaaggatggagagaatcactacaagccgagatttaccatcatgggattccgctacgcaaaagtggagacaatacttgatctgtcagatgcaacatttatcgcgcatgcagtgtattccgagatggaagagacagcagacttcacttgtggaaatgcggatgtgaaccagttggtatggaacagtaaatggagtcagaagggcaacttctgtgatgtgccgaccgactgcccgactcgtgagagagcagcgtggacaggagatgcgggactttatgtcgatacggggctgatgctgatggatagttataatgtatatagaaaatggctggcgcagtgtcgttacggacagtatccggaaggcaaggtggcaaatatcgcaccgccgaacagcaaaggaagctttatgacagcgatgctggcaggttctgtcggctggggggatgcctgcattattgtgccaatggcaatgtatcgtaagtatggagatgttcgtatactggaagaaaattatgaaatgatgaagaactggtatgcctttttggaaagccgtgcagagaacaatgcaattcagtcgggtattgattacggtgagtggtgcgagccgggaaccaatccaatgatgtctatgcagaacggaaactttgatgttgcaaccgcatatttcgcacattccggggaaacgttgtctgagattgcagcgattctcggcaaagaagaggatgcggcacattaccgtgaagtatcagaaaacgccaagaaagcatttgaggaaatctttacgaaagacggcgtggtagaatcagagcgtcagtgtcagtacatccgtccgattcagtttggccttgtgaatgaagaaaactgtgcgaagaatgcagagaagctgaacgaactggtgcttgcaaatgactatcatctgaacaccggattcctgacaacaccggcaatctgcggtatactgtgcgaatacggatatgaagataccgcattcaaacttctgcttcaggagtctgcaccgggatggctgtatgccgtgaagaaaggtgccacgacaatctgggagacatgggatggtatcaatgaagaaggaaaaccaagcgaatctctgaatcattattcctatggtgcaattaccggatggctgatcggtggcgtatgcggaattcagcaggaaggaagaaaaatcacaataaaaccaatcgcatgcaaggaattatcgcatgcaaaggcagtgtatgattctccggttggaacaattgagagcggatggaaatacgaaggtaataagattacgttcgagtttgttattccggtgaacacggtggcagaagtagtgctaccgaatggggagagacatgaacttgcgccgggagtacatcagttctaatggatgtggatagttaaaaaagaaatggatacacatgtaaggggggcttaccgatttatttcgataagccccctttttgttgctgaatctcgttgattttttcatctgaaagctcggtgttatctaaaagcattgtccggaacatttgaagtaacatttgaaaagcctgtatccatgtgatatcagacatttcatctgaaaagtatagaaaaagctcgcgcagggatcgattatcattggattccctgctttccagcgacaacatcatgtatcgtgtaaaaacgactgcagtatgtgcagtcattgcatcataggaaagggagttacattctttgctgaggttaaggtagcttttgcacaccttgaagaacacatctatgtcccaacgttttccatagatccggatgatttcattctcatccagatttacgtccgtggaaataaggcagagatattccttgcgtttattacgattgcgaacataaactactttggcaggaatgatttcaccatcctttacaacatcaaccataacggaaagcagatatcttgatcttccgcgcctctttttgttcgtgttgtagatagaagttagagacatatcttcgccattgtagcggaaaaacatctttggtgttttcttgaccatgccgattacatcgtaacccatactttttactgcgtgaagagtgcttggtgatgaaaaccagctgtcaaaaagaacatatttcgccgaaattgtagctttcctggctgcatccaaaagcgtaagcatagcttgtgttcctttttccatggaaagcttccggcgtttgtagccaacagttcttttatccacttctgttgcttcattgatgcggtttttcctgttttctgtggaaagaagaacgctgttgaccggcaggaaagtacttccatctgaccagcctaaagtaagcattcgaaaaccaaagcgatatttatgttttgcatggtcatagactttggcaaggagttcaaccttttttgagcggttacgctcaaacatggaatcatcaatgataagaacatttgcacgatcctcagaattcaaaggcagaatggcatccctgatgattcgggttgaaagtattgttgtgaagcggatccagttgatctgaatcattttcataaaacgatatacagtatccttcgcaaaatcaggagtgttccgtcctgtgatcaggttcatgtacatgcttctgttagaaaaaatcagcagaaacagatactggaaaatttccattactggaacgcctttctttttgtaggcattggatgctttcaaagctgaagaaacatgaaatctcgtaaaaaatcttttgatagattttgaaatctgcttatcatttctggaaaggaatgtgcggacgtcgtgcatggaatcgcttcccggtggatatagttattaggagaaaacatgacgcggaggattgccatggagcgggaagagcggatcagacatcagaaagaattccttattaagtttgcatactgggcggtgtggggtggacttgtcctcgcggcggtaaaaatgatcggaccggtgctcctaccgtttattgcggcattttttgtggcgtggattctttcgtttccggtggcgtttgcgacagagcgcatgcatataaggcgcaggattgcagcggtggcggtcgttctgctgttttacggactggcgggactggtgatcggattccttggaaaccgcatcatgcttttgggacaggaactgctcggggaagtggtgcggtttgtctcggagacgatttttccgatgatgaagcatttctgcgcgtggacggcaggtttgactggagagacggtgggaggagaggtgctgcggacggcgggtacggagtcggcggaggcggtcagccgggcaggggagcttctgaccggaatgtccggcaccctgctgcagcaggtctccggcattgcggtgaatattccggggatgtgctttaaattgctgctcgcggtcatatcgacggtgttcatggaactggatttcccacagatcatgcatttcctcgaaaagatcataccggaaaaatggaaggagacggtgtctgccgtcaaaaagggaaccttcggaacgatgggaaaatgtgtggcggcgtacgttttcatctttttgatgacgtttgcggaacttgcggcaggtctgcttcttctgcagatcgagggtgctttcgcgattgcgtttctgatcgcggtgttagatattctgccggtgctcggcacgggaaccgtgctgcttccgtgggcggtgattgcgtttgccggcggcaatgccagaatgggaatcggggtcatggggctgtatctgatcatcacggtggtgcgcaacattgtggaaccgaagctggtgggaaaacagatggggctctcgccggttgtgatgctgccgtgcatgattctagggcttcactttttcggaatccttggactgttcggagtgccgcttctggcatcgtttttgaaaaaactctacagtgacggctatttttctgaaaaactttccggagattgtcaaaagaaaaattgaacttgtcccgcaaaacatgtataataaagcaagaatatgtttgacaggggaaatgacaatggcagaaaagattattttgacaggtgaccgtcctaccggcaaactgcatgtgggacattatgtgggttctctgaagcggagagtggaacttcagaattcggggacgtttgataagatatttattatgattgcggacgcacaggcgctgacggacaacgccgacaatcctgcaaaggtgcgtgacaatattatggaggtggcactcgactacctttcggttggaatcgatccggcgaagtctcatatttttatccagtcctacgtgacggagctgacggagttgacattctattaccagaatctggttacggtctccagattgcagcgcaacccgacggttaaggcggagattcagatgcgtaatttcgaggcgagcattccggtcggattcttcaattatccgatcagccaggcggcggacatcacggcatttcatgcgacgacggttccggtcggcgaggatcagatgccgatgcttgagcagaccaaggagattgtacataagtttaatgcggtgtatggcgagacgctcacagatccgcagattttacttccggataacaaggcctgcttaagacttccaggtaccgacggaaaggccaaaatgagcaagtcgctcggcaactgcatctatctctcggagagcgaggcggatgtgaagaagaagatcatgtccatgttcacggacccggatcatatccggatcgaagatcctggaaaactcgaaggaaataccgtatttacctatctggatgcattctgtacggacgggcattttgcggaatatctgccggagtatgcgaacctggatgagctgaaggcacattacaaacgcggcggtctgggggatgtcaaggtgaagaagttcctgaataatgtcatgcaggaggagctgtctccgatccgtgcgcgcaggaaggaatatgagcagcgcatcggcgatgtgtatgatattttaaaggcgggaagcgaagtggcaaaggaagaggctgcaaagacactttccgaggtaaagcatgccatgaagattgattattttgatacaccggagttcctggaggaacaggtgaagaagtattccgagtaatcacaaattgttttttacaaattcaggcaattcatgttatattatacttgcaccttgacggtgtatcatgtatgatatttcatgagttgctttctctttttttgacagggaaagcagaccggacggcaggctgtccggattgtaattgaggaggatgcgacattatggaaaatgaaaatgtctcaaagaattttattgagcagatgattgacaaggacatcgaggaagggcactgcaaggttgttcataccagatttccaccggaaccgaatggctatctgcatatcggccatgcgaagtccattcttttgaattatggtctggcacagaagtatggcggaaagtttaatctgagatttgatgatacaaatcctaccaaggagaagaccgagttcgtggaggcgatcacggaggacatcaagtggcttggcgcggactgggaaggcagacttttcttcgcatccgattatttcgatcagatgtatgagtgtgccgtagagctgattaaaaaaggaaaagcttatgtctccgatctgtctgcggagcagatccgtgagtaccgaggaactctgacggagccgggcaaggaagatccgtacagcggcagaagtgtcaaggagaacttaaagctgtttgaggagatgcgggaaggaaagtacgcggatggtgagaaagtgctccgcgcacgcatcgatatgagttcttccaacatcaatatgagagatccggtcatttaccgtgtggcgcatatgacacaccacagaaccggcgataaatggtgcatctatccgatgtatgattttgcacatccgcttgaggatgcgatcgagggaatcacgcattccatctgtacgctggagtttgaggatcacaggccactttatgagtgggtcatcaacgaggtgggcgcacagattattccggataaggatgagatgccgccgagacagattgagtttgcaaagctgtatctgaccaacgtggtaaccggcaagcgttacatcaagcgcctggttgaggaaggtattgtggacggatgggatgatccgcgtctggtatccatcgcagcgctgcgcagaagaggatttacaccggaatcgttaaagatgttcgtggaactgtgcggtatttcaaaggcaaacagttccgttgactatgcaatgttagagtactgcatccgcgaggatctcaagatgaagaagtcccgtatgatggcagtccttgatccggtgaaggttgtgattgacaactatccggaaggacagactgagtatctggacgttgtgaataatctggagaatgaggcgctcggttcacgtaagattccgttctcaagagaactctatatcgagcgtgaagacttcatggaggagccaccgaaaaagtatttccgtatgttcccgggcaatgaagtgcgcctgatgaatgcatattttgtaacctgcaacagctttgagaaggatgcagacggcaacgtgacggtgatccattgtacttacgatccggcgtcccgcggcggcaacagcccggatggcagaaaggtaaaaggtacgattcactgggtatccgcagcacatgcggttcctgcaacggtcagactgtatgagaatatcgtggacgaggaaaaaggggtatacaatgaggatggaagtctgaacctcaatccgaattcactgactgtgttaaagaactgtatggtggaggagaatcttgctggggcaaaggcttacgacagtttccagtttgtacgccagggattcttctgtgtggatgcaaaggattcgacgccggagcagctggtgttcaaccgcattgtgtcactgaagagttcattcaagctgccaactgcgtaggacgcggtctgagatttaggaggaatagatatgaatttattatccggtttggaaaaatttggtttaaaggcagaggataccacgaatctttttgcggaagagaagaaagaagtcgtgggagaggacggcacaaagcaggaggcggtgccaacagaagacagctttcttctggacaaggctgtgcgttgtgcagtgtgtgacaaggtatttaagacaaagatgatcaagagtggaagattaaagcgtcttgagtccgatatggatctgcgcccgcgctatgagcacatcgacaccttaaagtacagtgtgatttcctgtccgtactgcggttataccgcgattacgcgctattttgaacacctgtcctccatgcaggtcaagatgatcaaggagaagatctgcgtgaatttcaagccggcggacaatgtggagccgacgctgatcgattatgataccgcgatcgagcgctacaagctggcactgttcaacacgattgtgaaaaaaggaaagaacagcgagaaggcgtacacctgcctgaatcttgcatggctgctgcgcggcaagcgtgagtctttagacgcgaaggatccgaagatggcagagcagatcaaggagtgcagggagcaggaagaggcgttctatgcacaggcgtatgaaggatttacaaaggcggtatccacagagacctatccgatgtgcggcatggatgagtgcacgatggattacctgctcgcgacgatggcataccactacaaaaagtacgatgttgcatcgaagtgcattgcaagaatcctgcagtccgcagcggcgtccaagaagatgaaggaccgcgcgtatgaactcaaggagcgcattgtcgaggagatcaagagaagcaaggcataacgacggataaggttttataatgatagagattatgatgaacttacaggggggagcgaaagctcccctctatgagaaaatatacgaatacatcaagagtgagattacagacggcaggattccgagaggggaacggctgccgtccacgcgtcttctggcgaagaatcttgcggtgagcagaagcaccgtagagatggcatacgatcagctcctggcagagggatatatacaagcggaaccctgccggggtttttttgtatgcgacatcgcggagctgtaccggcttcagggaaacagcgctggagaaacgggacgggtacacagagcggaaaaaccggtctgtctggttgatttttccccgtatgcgattgatacccgcagttttccgtacaacgtctggcggaagatcagccggaatgtgctgttggatgacagcgaggaactgctgatggcgggggacggacagggggagtacagcctgcgcagtgagattgcggactatctgcatcacgccagaggtgtgaactgccgcccggaaaacattgtgctcggagccggtaatgagtatctggagattctgcttacgcagcttcttgggaaaaataagactgtgctcatggagaacccaggatatccgcaggcataccacacgtttcggaatatgggataccgggtggtgacggtgccagcggacgagcaggggcttagcggcggtacggtgcgcgccgtagagccggaactggtctatatgatgccatcacatcagtttccgaccggcagtgtcatgcctcttggaaggagacttgaacttcttgcgtgggcggcagagcgggaggagcgctatctgatcgaggacgatcatgacagcgagtaccgctaccgcggaaagccgattccatcgctgcagagcgtggatggacttggaaaggtgatttaccttgggacattttccaaaagcatcgcgccgtctctgcgtatcagctatatggtgctgccacagcagctgatggagcgctaccgcgccgtctgcggattttattcgacgacggtgccgcgcatgcagcaggagattctccgggagttcttgcgggacgggcattttgagcggcatcttaataagatgcgcggtatttaccgcggcaggcatgatttcctgatcggtgaactgaaaaaaagaagctgggtgctctcagtcagcggagaccatgcgggactccatgtgctcgtggaggcagataccggatgcagcgagagggagatctgtgagcgtgcggctgcgcagggcgtgaaagtatcggggctcggcgaatatgcgctgacgaaagagaatggcagtgacagaaaatgtccggtgctgctgcttggatatggcagcctgaccgagcaggagatccagatggggcttgccgtgctggatgcgatactggatgcgcaggaaagcgcatgatcaggaagaaaattatcggaatgtgaataaccggacagaaaaggaacccccggaaatctgccgaaacggcagatttccgggggttcttgtgtaagcaatccggatgtacgatttattcgtatttgtttttctcgccgatttcctgcatcttcattgcacgaacttttaacggcagtccgaacagtgtgatgaatccggaagcatcgtggtgatcgtagagatcgccggtggtgaagcttgccaaggactcgctgtagagagaatacggggaggtcgttccggccttgatgatgttgcccttgtaaagcttgaacttgacttcaccggtcacatattcctgtgtggaggtgacaaatgctttcactgcgtcgcagagaggggtgtaccatttgccctcgtatacgatctgagcgagcttgttgcccatatcctttttcacttccatggtagcacggtcaagtaccagctcctcgagctgctgatgtgcttccatcagaatggttccgccaggagtctcatagacaccgcgggacttcatgccgacaacacggttctccacgatgtcgatgatgccgacgccgtgtttgccgccgagacggttcaactcacggataatatcggaaaccttcatcttcttgccgttgacggaggtcggaacacctttctcgaaggtcatggtcacatactcgccctcctcaggagctttttccggggagacgccgagtaccagaaggtgatcgtagttcggctcacaggcaggatcctcgagctcaagaccctcgtggctgatatgccagatgttgcggtcacggctgtagctggtgtctgcggagaacggaagatgaatgccgtgtgcctggcagtatgcgatctcatcctcgcgggactgcatggtccacttgtcgtctctccatgcagcgataatcttgagatccggagcgagagccttgatggcaagctcaaaacggatctggtcgtttccttttccggtagcgccgtggcagatggcggtagcaccttcttttcttgcgatctcaaccagcttcttgccgattaacggacgtgccatggaagtgccgagcagatatttgttctcgtagatggcgtttgcctgtacgcacggcatgatgtagtcatcgcagaactcgtcgatgatgtcgacgatgtaaagcttggaagctccgcaggagatggctctttcttccagaccgtccagttcttcctcctgaccgcagtcgatgcagcagcagatgacttcgtaatcgtaattctcctttaaccagggaatgatggcggtggtgtccagaccgccggagtaagctaagataactttttctttcatgggcttttttcctttctgtaaatcattaactgcaatcaatatacaacatatgcaacggaaaagcaagtgaaaaaatatacatatatttcaaataaaaatgcatatacatgtacaaagcatacagaatgaaaatagggaaaacctatataaattaaggaaaaaagaaatctaaaacaagaaaaacgttgcataaatagtaaaacaatgcttgcataaaagaaaaaacggatgtataattatgcaagaatatttctaaaaaacggacaaaaaatactttactatggcaaagaggtagactaatatagggatatagtgtgaaaagattttttgcaggaaaaggaaaggcggaatacgaacatgataaaggcaggaatcataggtgcgaccggttatgcgggaaatgagctggtgcgtcttctgatgggacataaagaagtggaaatcaaatggtacggttccagaagttatatagatcagaaatacgcagaagtatatcagaacatgtttgagatcgtggatgacgtgtgtatggacgacaatatggaagcactggcagagcaggtggatgtgatctttacggcgacgccgcagggatttctggcaggcgtcttaaacgaaggacttcttgagaagacaaagatcatcgatctgtccgcggatttccgtatcaaggacgttgcggtgtatgagaaatggtataagatcgagcataagagcccgcagtttatcggggaggcggtgtacggcctttgcgaagtgaaccgcgataaagtgaaaaatgccagactggttgccaatccgggctgctacaccacctgttcgattctgacggcatatccgctggtgaaggaagggctgatcgatccggatacccttatcattgatgcgaagtccggtacctccggcgcagggcgcggtgcgaagctgccgaatctgttctgtgaggtcaatgagaatatgaaggcgtacggtgtcacgagccacagacatacaccggagattgaagagcagctcggctacgcggcaggcagaccggttgttgtgaattttacgccgcatctggtgccgatgaaccgcggaattctggcgacagaatatgccaccctgacgaaaaaggcggacggaagtcttccttcttacgaggagatcaaggcggcttacgataagtattatgcgaaggaaaagttcgtccgcgtgcttccgaaggatgcgtgcccggagaccaaatgggtcgagggaagcaattatgtggatatcggttttaagatcgatgagcgcacgggcagaatcgtgatgatgggagcgcttgacaatctggtcaagggtgcggccggacaggcagtgcagaacatgaatctgctgtttggatttgacgaggcggaagggctttgtctggtgccgatgttcccgtagatacagagcgaaaacagaacccgggaaggattttccacggaaggaagcagcgggaaaatgaaccggaaatgataaagagaagagatggaagtatgaaagagacagaaccggtcatccgcgtgatgacaatggatgattttgagacggtacatgcgttatggatggagattcacgggtttggaatccgcagcatcgatgattccagagagggcgtggagcgttttataagacgtaatccgaccaccagcatggtagcggtggcggagggaaagattgtgggcgcgattctctgcggacatgacgggagaagaggctgcctgtatcatgtatgcgtgcaggaggcgtaccgcaagcacgggatcggacagaaactcgtgggtgcctgcgtggatgcgcttgcggcagagcatatcaacaagatcaacctgattgcattcaagaaaaatgaagtcggaaaccgtttctggcagggactcgggtggactttccgcgaggatgtcaactattacgaatatgtcacaaacgaggataatatcacgacctataatccataggaagaaaaggagtgcggaatgataaagatgataaagggcggagtgaccgccgcaaaaggattttgtgctgccagcacggcggctggtatcaaatatcagaacagacaggacatggcaatgctctacagcgaggttccctgtgcggtggcgggaacttttaccacgaatctggtgaaggctgccccggtaaagtgggatcagaagattgtatacgagagcaaaaaggcgcaggcggttgtgatcaatgcggggattgccaatgcgtgtaccggcgaggagggaatgcgctactgcagacagacggcggagaaagtcggtgaactgcttccggttccggaagatcaggtgctcgtggcatcgaccggagtgatcggcatgcagcttccgatggagcgcatctgtgcgggaattgaggcgatggttccggcattgtcgggtgagacagagagcggtcatgcggcggcacaggcgatcatgacgacggatacccacgagaaggagattgcggtggaagtcatgcttggcggcgttcctgttacgatcggcggcatgtgcaaaggctcgggcatgattcatccgaacatgtgcacgatgttgagttttgtgacaacggatgcggcgatcgcacagcccctgcttttagaagcgctgcaggcagatgtctgcgacacctataatatgatctccgtggacggcgacacttccaccaatgatacctgtctgcttttagcgaacgggatggcggagaatccggtcatttcagagaaaaatgaggattacgacaggttctgcgaggcattgcggacagtcaatgaatatctggcgaagcagatggcaggcgacggcgagggagccacggcgctgtttgaggtgaaggtcatcggagcagagacgaaggagcaggcgaagatcatcagcaagtcggtcatcacatcgaatctgaccaaggcggcaatctacggacacgatgcaaactggggaagaattctctgtgcgatgggttactcgggcgcacagtttgatccggagaaggtggatctgttctttgagagtgcggcaggaaaaatgcagatcataaaggacggcgtggcacttgactacagcgaggaggaggcgacgaagatcctctcggagccggaggtgacggcgatcgcggatatcaagatgggcacggaggaggcgacggcgtggggctgtgatctgacatatgattatgtcaagatcaacgcggattaccgttcctaagcagagacgtaaaaattcagggagagtggagagaaaatggacgagaaaaatatgcaggaaattctggcaaaggcggaagtgctgatcgaggcgctcccttatatacagcgttttaaccgcaagatcattgtggtaaagtacggcggaagcgccatggtggacgaggagttaaagcgccatgtgatccaggatgtgaccctcttaaaactggttggattcaagccgatcatcgtgcacggcggaggcaaggagatcagccgctgggttggaaaagtcggcatggagccggtgtttgtcaacggactccgcaagacggatgaggcgacgatggagattgcggagatggtcttaaataaggtcaacaaatctctggtcaagctggtggaagagctgggtgtcaatgcaatcggcatcagcggcaaggacggcggactgctcaaggtggagaaaaaatattccaacggggaggacatcggatttgtcggtgagatcacggaggtcaatccgaagatcctctacgatcttctggagaaggattttctgccgatcgtgtgtccggtcggaatggatgatgcctacaacagctacaatatcaacgcggatgatgcggcttgtgcgattgcaaaggcggtcagcgcggagaagcttgcatttttgacggacattgagggtgtatacaaggatccttcggacaagagcacgctcatctcggaactgaccatcgacgaggcgagagcattgatcggcgacggctttatcgggggcggtatgctgccgaaactgaacaactgcatcgacgccattgaaaacggcgtgtccagagtacatattttagacgggcggatcgcacattgtctgctccttgagatctttaccaacagaggtatcggtacggcgatccttagtgagaaagagaagaggtattacaatgaataaagagacatgcatgaaagaggcggaggagagcatcctccatacctataaccgtttcccggtggtgtttgaccatggggagggtgtatacctgtatgacacggacggaaaagaatatctggattttgcggcgggaatcgccgtgcaggcatttgggtatcataacagggagtacagcgaggcgctaaagacgcaggtggataagctgatgcacacgtccaacctgttttacaacgagccgatcacaagcgcggcgaaacgtgtcttaaaggcaagccggatggatcgcgtcttttttacgaacagtggcacggaggcaatcgagggagccttaaaagccgcaaagaaatacgcgtacaccagggacggtcatgcagggcatgagatcattgccatgaatcactcgttccatggcagaagtctcggagcactctcggtaaccggcaataaacattaccaggaaccgtttgaaccgctgatcccgggaatccgtttcgcggaatttaatcagttagacagcgtaaaagctttgataaatgagaaaacctgtgctattattttggagacggtacagggcgagggtggaatctacccggcaaccgacgaattccttcagggggtgcgtgcactctgcgatgagcatgacattctgctgatcttagatgagatccagtgcggcatggggcgcaccggcgagatgttcgcatggcagcactacggtgtgaaaccggacattatgaccagcgcgaaggcgcttggatgcggtgttccggtgggagcattcctgatgactgagcgcgtggcggaaaagtcgctggcaccgggcgatcacgggacgacctacggcggcaacccgtttgtcggagcagcagttgacaccgtgcttaagatgatggagcgggatcggattacagagcatgtaaaagagatcacgccgtatctggagcagaagctggatgcgcttgtggaaaagtatgatttccttacggcgcgcagaggtctgggactgatgcagggcgttgtgtgtgagaaaccggttggaaaaattgcgtcagcagcattggaacacggacttgtcgtgatcacggcaggcgccgatgtgcttcgttttgtacctccactgattatcgggaaagagcatgtggatgagatggcagagaagctggatgcggttctggcagagatgtaattccctgataatgagaataaaaaacggattagggaaataaaatgaaacgattatacaaaagactgacggcggcaggacttgtcgttgtgcttggaatgacaggaatggctgttatgaatacagcgggatgcggcagcagcggggatggtgtgccctccacggagacgggagaaacggcggcggatgaagcttaccggagcgcaccggcagaccttacgctgtggtatgcggatgacagctatgcagactttttttccgaggcggctgtgcgctattacgctaagacagggaaaaaagtagccgtgcagtatcaggataccattgattatcttggaactatttacgataagaccatgcaggatgatgcatttccggatgtttacctcttaccgggggataatctggaggaagcatacctctatggtcttgtttccgtgaatcagacggatccgtcggaaaacggcgtgttggaaaaggcagtcgaggcggcgacctacgaagagcgcgtgctcgggtatccgctgtcctacaatgcgtgcgtgtttatttaccagacggattattttaccgaggcgccggcatcactgcaggcaatcatcgactattccaatgagaacgagccggcagagaatgtggaatatctgctggagtgggatgtcaaggatgcgttctatgattttccgtttgtcggcaacagcgtcacgttcgcaaagagaggatcggacgaattggatatcacctacgatgatacgctctatcagcaggatctggagtattttgacacgatactggcatctttttccattgatgcggatcaggtgtccgaacagcatatcgtgaacaatttccgggaagggcggactctttcggcaatcctggatactgatacactctggcagctggacggatatgactatgggctgatgcagatgccggagttaagcgatacgctctcggcggcgacatgtgcgtctaccgatatgatagtggtcaatgattatacaaaagacagtgcagcggcggcagattttgcacagtttgtgacagtcggcatggcggacgaattgcatggattgtcgggacattactccgtgattccgtcagagacgccggataccgtggagcagacggcgttggacgcgtatgagggggcagttttaatgccggattccaaggatgccaaaaatttctgggtaacattggaagaaacaattttgaaatatttctgaaacactcttgtcacggctgtaaaatttcgttagaatatgaatatcgggcattgaggactccttttatatagaagaaggagaatgcttatgatacgaacatggaagaagataggggctggcatgattctgtgcatttttatggcgggatgtggcagtcagaacgaggtttatctggagacggaagtctcgcaggataccgggaatgtgcaggagacggaagaaacggaggctggggagcgtctggatatactggacgtttccggcggggagcagacgggaagtgtggatctgccggaggtttccggtgaggaatgggcggctgaggcagctcttgcaccggaggcgacggaagatgctgataaggcagaccgtgcgtcgggaaaatgttatgtctatgtctgcggagaggtggcagagccgggcgtgtacgtgttagagcccggagaccgcatctatgaggcggtcgagatggcgggcggcatgacagcggatgccgggatgtgtgcagtcaatcttgcggagagcgtgtacgacggactcatggtgtatattcctgacagcgaagaagcggccgggatggcgggcagtatgacttctgcgggcggcagcacagtttctgcgggaggaagtgtgacttctgcggacagcagtgtcaggaacggtgagggaacttcgggagggacggcatcgtctccggaagacggacgtctgaatctcaacacggcgtcgctggcagagcttatgacgctttccgggatcggacagaccaaggcgcaggcggttgtaaactaccgggatgcgcacggaggattttcttccgttgaagagattatgaatgtagatggaatcaaagagggattgtataatcggatcagagatcagataaaggtgaaataaatggcgaaaaaagttcttgtggtggatgatgaaaagttaatcgtaaagggaatccgtttcagtctggagcaggacggcatggaagtggattgtgcctacgacggtgaggaagcgcttaagatggcgacagagaatgcatacgacatgattctgctggatattatgctgccgaagatggacggattcgaggtgtgccagcatatccgcgagttttccaatatgccgattgtcatgcttacagccaagggcgatgacatggataagattcttggactggagtacggcgcggatgactatatcacaaagccgttcaacattctggaagtgaaggcgagaatcaaagccatcatgagaagaactgccgcatcgcagcccaggaaagaagaatccaaggtgatcgaggcgggagacttaaagctggactgcgagagcagaaggctgtttattctcggcagggaggtcaatctcactgcaaaggagttcgaccttttagaactgctcgtgaataatcccaacaaggtatatggaagagagaatcttttgaatcttgtatggggctatgagtatccgggggatgtcagaacggtggatgtgcatgtgcggcgtcttcgggagaagatcgagagcaatccgagcgaaccgaaatacgttcacacaaagtggggcgtcgggtactattattcacagaattaacgggtgtacacaatgtctaaatttaaaaaattaaccgattttctcaaaagtcttaagtgcagactgattcttctctgcattctgatcggaattgtaccgagcgtcctgctgcgtgccgggatgctcggctcttatgaaaaccgtgcggtgtcgatccgcacgagtgagattctaagccaggcgaagattctcgccaatcagatcgtttccaatgattatctgaataatgcggagagtgagtctgcgatcaacgtgcagttagagcagctgtcaacgatctatgacgggcgtgtcatgattatcgatgaggagttccatatcataaaggatacctacaatcttgacaccggaaagacgattatttccgaggaagtgatcaagagtatccagggggaggagatcagcaaatatgattcccagaaccgttacattgaaatgacgattccgttggtgcatgtggacccggagacggagaacaagcggacgatcggtgtgattatggtgagcgtttcgaccgacagcatcaatctgaatctggaatatctggcgcgcaatacgcttgtcatggaactgattgcgatcgtggcgatcatctttgcgggaacgtttatcgcgattcatcttgtggcgccgttccatgccatggcaaagtcgatcgaggagattcagaccggatacggggatgacacattaaagattgacgcgtacaccgagaccaggcagatctgtgaaaagttcaataagatgttgggacgcatgaaggtgctggatgattcaagacaggaatttgtgtccaatgtctcgcatgagctgaaaacgccgctgacttccatgaaggtgctggcggattccatcaacagcatggaggacgcaccggtggagctgtatcaggaatttatgtcagatattggaaatgaagtggaccgtgagacgaagatcatcaacgatctgctgtctctggtaaagatggataagtccgcgggagatttaaacatcacgaatgtcaacatcaacgaactgttagagcagattttaaagcgcttaaagccgattgcggaaaagcagaatatcgagctggtattagagagtttccgaccggtcagcgcggatgtggatgaggtaaagattacgcttgcctttaccaacctgatcgaaaatgcagtcaaatataaccgcccggacggatgggtacatgtctctttgaatgccgatcaccagtatttttatctgaaagtggaggattgcggaatcggtattccggaggagtcgttagagcatatttatgagcgtttttaccgtgtggacaagtctcattccagggagatcggcggaacgggacttggacttgccattacgaggagcgcggttctgatgcaccgcggagccatcaaggtgttcagtaccgtgggagagggaacgattttcaacgtcagaattccgctgaattatatttcttagataagggagagtctatgagccgagaagcttatcgatggagaaaaaagttaatatgtctgggactggcatgtctgatgttcctgtcaggctcgctcgcggcgtgcggcaggcagacggagcagagtgcctatcatatcgaatatctgaataaggacaagaaccgtctggtggaagaaccttatgagccttcggcaaccgataccgacggaatgatcaaggagttccttgcgaaactgagttcggattcggacaatgtggattaccggaagccgattccaaatgatgtggaaatcacgaattattcactggacggtgtgcttttaaccctgcattttgatgaggattacagcaaaatgagtgctgtcgatgaggtgctgtgccgggcggcggttgtccggacgatgacacagatcgacggggtggactgcgtggcattttacattggagacgcaccgcttacggatgcgaaggggaatcttgtcggtaccatgaatcaggacagctttatcgaaaatccgggagagcagatcaattccattcagaatacaacactcacgctgtatttttccaatctggacggggacggtctggtcaaggaagtgcgcgaggatgtctactacagcagcaatatttccatggaaaaactgattatggagcagcttttagacggtccgaagaccaaggatgcaaagtctgcgattccggaggggaccaagcttgtctctgtgtcggtggtggacggcgtctgctacgtcagcctggatgaagcgttcaagaatcaggattacaaagtaaacgaggcaatcgttatctattcgatcgtggattccctgtcggagctttccacgatcagcaaggttcagatttccgtcaacggcgatacgagcggagtctaccgcgacaatttcccgcttgcggatatgtatgaccgcaatatggattatgtcacgggggcagagagcgccttttcggaaacggaggaacctaccgaaacggattaaagggggaagtgtgtgacaaaacggcctttgtgtcttggcgcagcgggcgttctgtcggggattcttgcggcggcatacggctggagcgtattcgcgcgggcattgctagcctgcggcgtcctggcctgcggaatccttggcggcatttttgctgacgggtaccgtccgggcgacgggatttccccggcggaaagaaagagaacggcttttggcgccggagtttttttgctgatgtttgctcttggaagcggaagatatttggaggcggaggagagcaggcaggcgtatctgggagaactgcaggatggcatgtatgtgaccgtacagggacagcttgcgggaaaacaggtacagaaaaatcgatatgtctatgaattaacgtcctgtatgtttcggacggattcgtcgaatttcttacagacagaaccggtatcgtgcggtggggttctgatctattctgattccgatgattgttccatcggagatattctcatataccacggagagattacattatggaagcgggcatcaaatgagggtgcgtttgatgcgaaggcttattattttgcgcgcggatttgattttgcgatggaaggtccggcacttgatagaaaggtgtgtgcaaagaggcagacggcggaagccctctggcagcttggccagcggattaaagaggtctaccttaagacgatgggcgagcgcgatgcggggatactggcgacgatggtcgtcggcgatagggagtttttggatgcagagacgaagagactctaccagatcgggggattgtcgcacattctggcgatttccggacttcatatctctgtgatcgggatggcgctctaccggatgttaaagaaagcgggactgccgtttggcatggctgcccttgcagcggcaggagtgatgtacggatacggcgggatggcgggatggggcgtttccgtgagacgcgcggttctcatgttcctgctgtttctgggagcacaggtcagcgggaggagctatgatacattttgtgcgctcgcatttgccgcagtggcgcttctctggaaaaatccctgcctgttctgggacgccggattccgcttttcctttgttgcaatctttggcgtcgtgtgggtcggacagagcatctcttatgagaaaaaaggaatcggggcgctgcgcggaaaaatatttgcggcatcggcggtctggtttacgacactgccgcttgtggcatggtatttttatgagattccggtctatgcggttttcgtcaacctgctcatgctgccgatgatgggggtgctgctcggattcggagcggcaggcggaatggtggggctcctgtcgcttccattggcaaaagggatgctttttccatgcagaattctgctctttatggggaagcatatatgtgcgcttgccggtatgcttccgggtgccatgtggattgtcggaagaccgcagtgctggcagatcgcggtatattatgcgtttctgggagctggaacatgcttagtgcaccggcagagagaacaaagggaaagggaaaaggaacacggcaggagggcagagcaaaagagtggagggcatccgggcgttttccttgccgcactattgctgcttgccgtattgggagttccgcggagcggggaggcggaactggatatgctggatgtcgggcagggggacggctgctatctgcagacgaaggagggttaccacctgtttgtagacggaggaagttccaatgtcggaaaggtgggcacttatcggattctgccgtttctaaagtacaaaggggtcaaaaagattgactgctgggtggtgtctcataccgatgaagaccacatcagcggactgcgggagatactgtcgtcgggatatcccgtggagtatctggcagtggcggaacagatgccgcgggataaaaactgggaggaactggaagcgttggcagaggatgcgggaacaaaagtggtgtggcttgggcggggtgacatctggcattttggaaacgcaacgtttacggcactgcatcccggtgaaacggaggccgcgtttgggggtcagtctgtggacaaaaacgaggagtcgctggtacttttttatcaggaggatgactttaccggtgtctttaccggagatattggagcggcgcaggaagaggagattctgatctggctgcagaagacaaaaacgggagctgacgtgcagaaaatcgatttttataaggcggcgcatcacggatcgcgctattccaattccaccgggtttctggaggcgctggcaccggagatcgcactggtgtcgtgcagcagaacaaaccggtacggacacccctccaaggaggctgtcgggcatatgcagcaggcggggagccaggtgtattatacgatggaaagcggcagactgtgcgtcaaaaagacggacggacaagccgtctgccgggggtatctggaagaaaaagaacagtggtggcagtgagggaagtttgcggcactggtgaaggtatgctataatgtgcgtaagcaatgagcagtgccataaggagaaaatatctgatgcagtgcttgcacaatgcatcggatatttttgacgaatgatagggcgaatgaccgtcagtccaggaaatctttgatttcctggacgtgcgctgcgtttggaataaagcaagcgccacgcccggacttttgccgaagcataatatgtatatgatgccggagcggctgaaactatttaagacaggaagaacaggacagaaacctttatgaaaacaattgacgaagatatcagatccggaaatttaaaacagatctatttattatatggaacggaagattatttgaaacgccagtaccgggacaagttaaagaacgcgctcactgcggcgggagaggattccgggatgggcggcatgctgtcaggcggagacggcgatatgaactttaaccgcttcgagggaaaggacatcaacccgaagcaggttattgatcttgcggagacccttccgttttttgcggagcgcagagtcattcttatcgagaacagcggctttttcaaaaatgcctgcgatgaactggcggagtatctggcacagcccgctgcaagcacctatttcgtgtttgtggaggaggaagtggacaagcggtccaagatgtacaaggcagtcaagaacgccggaaaaatagtggaattcgccacccagacggaagaactgattacgcgctgggtgctggcgcgcctgaaaaaagaggggaagaatattacgggatcggtgatgcagctttttttgggcaagacgggatcggatatgggcaatatcgaccgggaactggaaaagctgatctgttataccatggacaaaagtgtcattgaggctgcggatgtggaagcgattgcgacagagcagacgacgaaccgtatttttgagatggtcaatgcgatcgcggaacacaaccagcgcagggcgctcgatctgtattatgaccttctgacactcaaggaaccgccgatgcgtatcatgtatctgattaccagacagttccagattctgcttcatctgcgggatatggcgggcaagggatttgacaatcagacgatggcacagaaggcggggattccgccgtttgccgtaaagcggaatctcacccaggcgcgcggttttggcgcagggcagttgagacaggcgttggaggacggtgtggcgctggaggaagcggtaaagacgggacggatgaacgatcagatggcagtggagctgtttatcatccgctacagtgcggcaaagcagaaaaaataaaaaagggtacaaaaaaacaccagtatgacggtactggtgtttttatacggttgggttaggaccgtatgtttagatctattctctggaattaagccagcgtgttaacaagctttgttaaacgggaaacttttctaccagcgttgttcttgtgatatacgcccttggaagaagcgctctcaattgtggaaatagctactgtaagggcagctttagcagcttccttatcgttagcagcaacagcagcctcaactttcttgattgctgtctttacttcacttctgatagatttgtttcttgcagctcttgtctctgttactaaaattctcttcttagcagatttaatgttagccaatctgtacacctccaatttgttatgattatgattctaactggtaacggcacatgcagtgcatcgttacaatgaaatgtacatcgaagccggacacggacagttcaatgtaaacatactatgatagtataggctcttttgagtgacctgtcaagagaaaatgctgaaatttgtcagaaaaatttgcggataactttttttttctgtggcagactagacagaaagaaatgtcctgtctgcaggaatacaaaaaatggaggagactatgtatcagatacgcaccgatcttgcattggagacacaggaaaaaatgcaggaagatcatgtggaacttaagggagtccgtttcctggaggaaaaactcagcccgaacctgacggtcagcacggttgtgatcgagacggagaacggggcaaagacaatgggaaaacccaagggaacatacatcaccatcgaggcggcagatatggatgaggaggacgaggactaccacagagaggtatccgaacagcttgcgcgggtgatcagacagcttgtgcggttaaaaaaggagagcctctcggtgctgattgccggacttgggaatcgtgaggtgacgccggatgcactgggacctggagtggtggacaatctgtttatcacgcggcatgttgtgaaagagtatggaaaatatgcatttggcaaacagacggtgaaccggatcagcagcattgtgccgggcgtgatggcgcagaccggcatggagacgcaggagatcattcacagcattgtaaaggagacaaagccggatctggtggtcgcggtggatgcgctggcagcgaggagcacgaaacggctgaaccgtacgatccaggtgacggataccggtatcaatccgggaagcggagtgggaaatcacagacatgcgctggatgaaaaaagtcttggcgttccggtcatttccattggcgtaccgaccgtggtcgacgccgcgacaatcgtgaacgatacgatgtacaatctggttaccgcgctcacacagagccaggcgtttgcagcgatgggaaattcattagaaaaattaaatgatgcggaaaaatatgaactcatccgcgaactgctgtcgccgaatttaaatgccatgtttgtgacgccgaaggatattgacgagtcggtcaagagactctgctacaccatctcggaagggctgaatctcgcttttgcgggcgggtgcctgcatgcgctttaaagagagcagatgggcggcataaaagaaattgccggtgcataaagtaaattatgcatgtttatcgataccaatataaaaattataatagaagtcatgataagagaaaaaagcggagacgaatccttccggtaaccatactgattgtggcggcggcagtgatattatccggcggcgtaagactggatccgggagaactgggttttttgctgcaggaggagatcgtgggatttttcctgccgcaggcttgcgggcaggcgcaggggacggcggagcttacgattgcagaccggcttttcgcgcacttttttttgctcccggaagagagtggtgtatctgccgattatcagacgcaggtggagagtgactggtcctacgaggctattctggcgcgggaggcggcggacgagaactatgtggatgcggcgacgggggaagtcatcatgacgcaggaggcggcggagcaaagcagtacaagcatgcgggagggagagacgaaggagcagacgcagggaaccgtaccgcatgctgcggagggacagcaggcggaagcacagacggcacaggcggaagcacagatggaacagcaggcggagacacaggcggcacaggcggcggagacacagacagcacaggcggcacagatacagacggcattggctacagaaaaggtggtggtatatccgcgggaaaaattgaatgattttgactatctgattcagaatttttatcaggtggacagcacaacgacgatcaacagcagccagctgaatgccgatgcgctgctgggaaaagatctgcgcctgtcacacgatgcatcgacgccgcagatcctgatctatcacacgcattcgcaggagggctatgcagattctgttccgggggatgcatcgacgtcggtggtcggtgtcggggattacctgacaaagcttttgacagagcagtatggattcaatgtgattcaccacaagggagaatacgatgtgggggacagggatcacgcctattccaaggcaggaccagggcttgaggcggtgcttgcggaaaatcccggggtggaggttgtcattgatctgcaccgcgacggcgtggcggagagtacaagactggttacgcaggtcaacggaatacagatggcgcaggtcatgttttttaacgggctgagcaggacgacggcgatgggggatattgattacctctacaatccttatattgcggataatctggcaatctcgtttcagatgcagctaaaggcggcggagtattatccgggatttacccgaagaatctatctgaaagggtatcgctacaatatgcactattgtccgaaaacactgctgattgaggtgggagcgcagaccaacacggtgagtgaggcgatgaatgcgatggtgcctctggcagatcttttgaataaggtgctgaccgcacagagatagcacgtccggtgatggcgcaaggcacaaaaagaaacgcacttgtaagcggcgcagacgggtgctataataagaatcctcaaaagagaaaaagaggggatacataacaatggaacaatttttgattgactgggaaggaccggtgcttctgtggattcaggagcatatgcggaatgatttcctcacgccggtactcacgtttctaacacatctgggcgaccacggttatttctggattgcgctgacgattctgttccttctgctgaaaaagaccaggaaggtcggcggattgatgacctgttcactgctgctcaatacgcttgtgaacaacgtactgctgaagaatctggtggcgaggacgagaccctacgaggtcgtggatgggctgcacaggatcatagaggcgcagagtgattactcattcccatccgggcatacgggaagtgcatttgcggtggcagtcgttgtatttctcatgtgtccgaggaagatcggcgtgccggtgctggtgtttgcatttgtgattgcattctcaagactgtatgtcggcgtacattttctgacggacgtactaggaggagcgctgatcggagcggtgattgcatatctggtctgtgccgtctaccggagaaaaaccgggcagaagggatcaatatggaacttcgagcgctgaatgacttccttgcgatcgcgcgggaggagaatattacacgggcggcggagcagcttcatgtcaccccgccgatgttatcccggcaaagcgccgatttggaagaagtgcctggagtcaagctgtgttatagaatgacaggatgcatgtgtatatatgctctgcgtacaagtaaatccaaccaggactccggctaacattaccagtacagaacaaatcaatgtgccgctatatttttttatcatttccttcataatctgatgctcttttcaaatctgtaatccacaacataacgtcttccaatacggaagtgtttcgttcataatagataaactttccctcccttttgtcccggattaaatcagcctctttcaatattgccagatgtctggatattgatgctcccgtcacagaaaaatgttcacatatctctccggcagaaagccgtccatttttcaataaattcaaaatctcacgccgtattggatctgccagtgcttttagtgtatcttgtatacccaagcatccatcacaacctttcatttaacatttaacctaattgttaaatgttaaatgaaaggtatatgctatgtcaacaacaaatagaaaataagcagcacctgcaatagcagtcagaacgaaaatagtcattcgttgcaatatatggtcatttggtgcaatgaattaacgatacaaactgctttttccgatataatgggtaagatctatgaatggattatggggtaaatattttatcaggaggataatgtatgagtgacagtacacttcacatcggagcgcttgcttcaaacaatgtaaacaatattgtaaatgaggcgggcaaatatgacgaatacaaagaaaaggtaaaggatttgacaaaagaaatccaaaccagaaaagacacttttgagaaaatggcagaaccactcgtatatgtatgtgactgttatcaaaaatttaatgcagtgacagggatgcccaagagtaccttcggagatacctttggctatgatatgcagaaagatatatccagtcatatgaacgatttttatgccggaaaggtaagcagggaggaacttaattcctattttgaggaatgttgtacgtccatgcgtacctaccggacaagtcagcaccagacatccggaaccaatgaagtagataatacacagatcgtaagtgagatgtatgaggtttttgcaaaagaaaatgcaagggcggcaagtcaggcgaactatcaggaaggaaaggcattgaatgagaaatactattctgatagtcatagtgactggacttattataattcagattattactatcagtgcaatgaaaccaatgcggcattgagggaatctgtccagcagatgaccggaaaatgggatttggctgagattgactgtgataaaatcgaagcaaattccagtcttacattagacggtggttttgattttaacagcacatggaattttgaatttagaaatcaggcgggcaggagcagtctggcaaaggaatcagcgataccgcctgagaattttaagatgtttttcaaggaacaggtaacatcttttacagaggacaataaatttaatggaaatctgaaaataacaatcggagagaataattacgatttaaaggttccatttcagacgttacgcaccggatcggaaggggaaattcgtaatgtctgggatttaatggagaattattatccgaagtcagaagatacttctaaagttaaaaatttcttgggaaatatgtctgtatttacacgatggtatgcatatgaaacaagaattaatgacatatttggtgattatgaagtgtcaaataaggagttgagttaatgggtatatcattgtcaggtagcagggagtaagggtatttaaagccgtggttattatatgacaaaatagtcatctggtgcaggaaataggagattggcgaaaaatgcccgtatattgagagaaagtgtccgatatatgaaatagaaaaattagggagagagtgattgtgaatatataagataacataggttggataaatatctgccgaacagatccttcaaaaagttatgtgattggtggttcggaagaagcaaatgaggaaataagaaataaatatcttggcagtgattttaaattgcctgagagtgcaaaaccttattacgatttatgtgtagacagcaaaagcatttcccaattagaacttacaagtgagaattacaacgatattatgaaaataaaaggaatgccggcatcctgtctaagtggaaattatggagaacaggtcataaaagatatgaaagatatgatgcattcctattattcaggggaaatatcagcggatgatgtacaacagaaaattaaaaatatttgtgtggatatgcgtgtggatatggttcagcagagatacacaaatggatataatgcaaaagataaccagcagatattagaagatgtgtatggttttttgcaaaaaagtaatgtgaacgccgcttatgctgcaaatgaaagggaaggagccgaaatagcatccagatatggtgggacagacgatgataactggatgtattataactcagactactattacaaagaagaagatatgagaaacagcatcaggcagaccattcaggaaatggcgaaagaatgggaaacagaggatgtcgattttgataaagtggagcaaaatccaaatttagcacttgcagggggtacagagtacaataaagtatggcagcatcatgcatttcaggggcgtgttatcagcatgaccgatacagaagctataccgccaaagaattttacatttttttatcaatccaagaaagttccaggctgggatgaaaacaataggctggaatatcaaaagggatatgtggaaatttcatataacgataaaaaatggtcagccgatgtaccttatgatgtgtatggtgatacaattttaggattttaccatatgcaggattttatgaatcaatatctgggcggtaacatggatgaagaatgtagcaattttgtaagtaaatttgatatttttacaaaaatttgggcttctacaaaaggtaacgatatatggaataattgcggctaagatgaagttaaaaaagaagtctggaggagataagaacgcagattaccaataatatatattcatataaaacagcatcatcagtatctaccacaaatagtaataaagctcgtacaacagttaaaacagataaaacaactcaaacagaaaaaagcacagcaggatacgacactacagaaaaatcatatgacacttatacaaaggaaggtttgacacggaatacggtcacagagaatgattcttttccagactgtaatccaatccaaagtcttgcgaaatatgtgaaggcttttaatgaacattatgaaaaagtaaatgaggaaaataaaaaatttgcagatcccaagcagcatatcatggaaaagtattacaataaaaaatccccctattatgtagaaggactgacaaatgcagagcgaaaaatctgtgtagaaaatgaaaccaatatttttgatggatatgatattcattgtttatatgatcccgcagatatggaagaatttggtggaagtaatgtgtttgtcagggagatggaatataatcaggaaacgcgtgatgcgataaatgatgtagtaaatcatttgtttcgcaaaaatgggattgtaatttcagaagatacggcactgcgactgaccgttgatccgtatgattattatattcatgcagaaggtgtggatgaggaaatggcaggaagaatcgaagcagcactcaatcagggcaaaaatggatacaatctttatcagcatatatattcctgcaatccgcagaattacaatgaaacgccgccagatcagtatttacagggagacagagaaaaaatggtattgtaccattttgtagacaagctgactggattggatcttcggaaactggaaaatcgggatggaaaatattatacaccggatggagaagaattgtggagtgcccttgagaagaagtatgcggatttagtagcagaaaataaggcagatgcttttggtctgggagaatataaggctgcatatgacagaatcgcaaaaaatggatgggataagagcacggactgtaatctgtcacttgactataaaaacggatatttatgtgacattgatatggaacatgggtacggtcagggacagaccgaatggcaggacagagtacgagaatggtatgatggtgtaaaggcagaagagcagaaacggagaagggaaacgatacttcgggaagccaatgagcctacggcggcagaagcgttgaatttacaggaagataatcaacagaatgtatgagaaaaagtgttcggaacaggaaaaaacagtgcagagggtgaatcctttgccaagttagttcgtggagatgcagatgccatatagagattactgaatcagttatgggaagaaggaaaaataacaccgataacaaatgagattatcagtctgccacaggagaaaaaagcggtttagggatttgattttaaagtttaggattatttggatcaggatagaccatcttttgacatgaaagcataagaaatgtctgaggatttcaaaagggagacaaatcgaatggaagtatacagcacaaatcagcaaagcagcacatggggagcagctttcaataaacctttgatattactgacaccccaagagggagcagcattattagagcgaaagatgcagcaaaaaagtatgggaaacatgactttgcaggagaataacagcacacttgccacaaacaacagttaccggaatcagaatacgatttatgaggtatcaggcaaggacaatagcagtacatttttagatttccgctttttgatgcgggatgaaacaagctgcctgaaaggaagcctgagtgatgcaggagatgttgatttttataatttttccataccatataaccgcacgctgcaaaatcaatttgcaatagagattaagatggaaatgccagaagaaagcaattatagaatgacattgtatgatgaatatgggaatcaggttggagaggcacaatgggagggtaaaaattataagacgcttacaattccaaactgggatacccagacagataaatacaatatcaaaatagaaaacgaagacggggaagaaatttcttcggagggttattataaaatcagttgtcgtattactgagaataaagagaaggaaaagacggatgcggttcatcaggcatattgtgaatgggagttacacaaaaatgatgaaaactggcaggaatacagggatcgttataacagtctgcttaaagaacaggaaactgcatatgcaaaggaagtagagcagcttcatcagaaacagtatgaaaatcttccggcagacaagcagtataaagggagtgcatctgtagatgaactgctacaggatatggcagacggaaaagaattaagtgattctgaactggagtatataaaaatttttgcaaacctcaaggattatgagaaagcaaaaaagaaagtggaattgaaagagttttctgaaaaattctcgaaagaactggagaataatggaatatcaaaagaagaactggatgaaatacacattaaaattgaaagtaacggaaaacttacagtatccggtattagtgataaaaatgttcaaaagcgggtggaagaacttgctggaaaacatcaggaagaactgtatcagttctatataggaattgcggacagtatagaaaatctgtcatctgatgtatatgaatatgctgcacagatacaggaagtgaaccgctatttgagtgcggcttcgggaggaaacattgcactggaagatttgtatttaagagcagatggcagagttggaggtttaccggaaaaagtagaaaaattgttatatgaaacaaaaaataatatcaaaacggaggatatccgggatatgctgacagatatagtacagaatatcagcaaatccgggaatgttgggattccagaattttcttcagaatttcagttccagaatggaacattatctgttgtggatggtggattttccgtagatatggatatgctttctgaccatatgacatataagacggcagataaatatgattattacaaatacaggtttgaccgggtattgtaaaatccgataacaatggaaaaatggattctggagcttatacagaatatcaaaacattagaaataatagcagcaataaaaacagtgctttggatgacctgaggcaataataaaaaggagaaaaaatgagcataggagcagtgggatgtggtgctaattattatagcacaaacgataatcagaacagaaaaacagaatcaggtggtacttttgatttttcaagtgcagtccagaactttaaagagacaaatcagttaaccgctgaggaactaaaagaggataaggactggcgtgacatgtcaagtgatgaatgggacaagacacttgagggagtagatgaatacatagatgctgcaaaagagcagatcagatatttaaagaaaaaacaggatgaggcggctgcaaaagctgctgtgcaggctgacgctgacagaaaagtgacagcggcatcatcagcagcatgtaaggctgcaacaggaacatttgttggaacagcagaagaaaatgcagatgatagtgcagattatgagaagaattggacaaagaatctgaaaacggatgatcagacagtccttagaactgcaaaagcggcacaggatatggaaaaaagggcaatgtctaaattacaggaaattcaattgatggatcatgccgcaaagggtatttcacagtcagaaaatgtgacagaatatgtgtctgtggaagaagatgaaaacgaagaaaaaatctggacggttacaagctttggagaagatggcattatcagtaccagatgtcagaatggtaaggtgttagatagctggaatataaagtatgataacccggaggatgcgaaaaaggtatgggattattttgcaaaatttaaaaatgatgatgaattggaatttgccggttcaaaagatttttggatggagtttctgagtgatgatatggcaagagatttatgataggattcataatcgaaacaattctgccgatatttaggttgtatttatcctaaaatttgtatatactatagtaaataaatcacggaggtgatcaaatgactatagatacaaaaacaatggtgtctatttcagacgctaaccagaatttttctaaagtagcaagattagtggacgaatgtggttcagcagtgattttgaagaataatgtaccaagatatcttgttatagattttagtaaagcagataaggattttactgcatctgatgaagatgtgttaagtatttcaaagcagctcatggagcagaataaggaagcatatgaggtactagctaaatgaaaaactgagcaaaaagcagattcttatgcttcatactcaattgattcagcagactggtggaagcgatggagtcagagattacaatttactggactcagctttagaaactccttttcagtcttttggaggggatgaattgtatcctacaattcaagcgaaagccgtgagattagggtatgggttgattaaaaaccattgtatgatagatgggaataaacggattggaacgcatgcaatgttggtttttcttgctttgaacggaatagagtttaagtatacgcaaaaagaattatacgaaactattcttgatgttgcagctgggaaaatagaatatgaagacctattgcaatgggttcttaatcatcaggcataaattgctgtccccattcgcacatagagtccaataaaggaatcagtgtcttgcccaattcacttaagctgtattctgttttgggaggaatgacaggatatatttttttgatgattaagttatcactttcaagctcgcgtaactgttgggcaagcattttgtctgtgatagctgggatttttttccgaatctggttataccgcaatgtgtcgctaccaagatgatataagattacggctttatatttgcctccaatttttgagattgttgcgtcaacaggacaattatatacattttgcattttatgttttacactttctttttggttagtatattacaaaaaagtacgttcttgtcttttttatatcgaatctattataatcaaattgtctagacaatacaatcataattttaaggagattttacagaaatgagtattttagatattgctaagcggcgtttttcagtaagaagctatctggataaagaaatttcacaggaaacattggagacaattttgaaagcagctcatgtagcaccaaccgcagcaaatatgcagcctgtgagactattgatcgtaaaaagtgatgaagcgaaggaaaaactggcaaaggcagctaacatttataatgcgccagttgcaatcatcgtgtgtgcagacacgaataaagcatggacgcgcccatttgatggaatgaaaacaacagatatagatgcgtcaattattaccgatcatatgatgcttacagctacagagcagggtttgggttctgtctggatttgttattttaaaccagatgtgataaaagaggaatttcatcttccgtcgggacttgaaccaatcaatatattggcgcttggttatacagaggagaaagcagatgcaaatagacatgaatcccagcgtataccaatgaatgagtttgcttcatttctttaatattgcagacatgattagaagacagggcagtgaaccaataatggtttgctgcccttttcacaacaaaaaaaggtcatttcacaacaactgtgtcagagaccatctgtttgtccgatataataaatatatttatcagacaaaaaggaagtgacaatatgcgaattgctatctgcgatgatgaagtatctatggttcagatattggaggaaaaaataaaaaggttattgccggatgcggttatagagaaatatttatcgggtgagaaactgattgcaagtggcagtaagccggatgttctatttctggatattcagatgccgggaatggatggaatggaaacggcaaagatgcttcggcaggacaatgaggatatgatactcatttttgtgacagcagcagaggagtatgtttttcaggcatttgatgtcggagcatttcattatctggtgaagccattttccgatgaaaaattgaaagaggttgtgacaaaggcagtccatgccgtaaaaaggagttccagacttgaaaaagacgaaaaatatatcatggtacagaccgccggaagccatataaaaatttttctgcgtgatattgtgtatgctgaggtgtttaaccggaaagttattatccatacacgaaatacggatattgaatactacggaaagctgcaggatttgcagaatatggctggggaagatttcttccgaacacacagagcataccttgtacattttaaatatgtagaaaaatatgatgcaacttgtgtgactatgaaaaatggaactgcattgattgcaaaacagaactatccggagtttgtcaggaggtatctgaaatacaaccagaggaaaggaaatgaagtcagatgagtttcgtggaaagatgctggatgatcacatcgaagttttctgttattgcaattttgattcttacaggaatctgttttggtgtttttgtatacccatatatgaaaaagaaaagggaagctgctctggtcagtattgtttatattggaattatgtctgtgctgtatctgataccgcagcggattggcaatttttctgcatatttgatgggagttgtggctgcatttcttgtgatgtatgtacaggacagacgaaacatctatcagaaactatttcttgcagtgacattcttttctatccgttggcttgcggttgcaatggcaggcagactggatgattttatcacaaaagctctggtttttgggaatacgattgccggaagacaatggctgcaatatggactttatgctggaacaagaattctggatattgtgctctgcatcgttttccttgcagtcgcaatcggtctgatcaataaagcctatgtatacaaaaaagatgagatgagcggcaaagagctggtaatgctcatcatgccttctctcgtaggtgtaacaggatatggtattctgcaatattatctgaatatttatgaaaaggatataggaaagagcctgattgatacgtatggattttatggagctttaagcttcgtgcattattttatctctatcatagcaattcttgttatgacaatcatgtttcaaaactggaaggtggcacaggaagaacagacagggcaggaactggtattaaatcaggtcagtgatatgaaaaagcatatcggggaagtggaaaagctgtatcaggatatccgcagcctgcgtcatgacatggggaatcatatacagatactggaacatcttgtggcagagaaccatatggatgatgcagcagaatatatggagcatttgaaaaaggagtggaatgaaatatctcctgagataaaaacggggagtcctgtccttgatgtgattttcatggaaaagttaagagaagcgaaggagaggcagattcgttttacatcagattttcattatccgaaggatacgaaattaaatgcatttgatttgagcgtgattttgaacaatgcacttaacaattgtatggagaatgttagtggtgaaaatccttatatcagtattacgtcttttcggaaaaacagtatttttatgataactataaaaaacagttacgagggcacattaaaatataaggaaagcgatctgccggaaacaaagaaatccgggaaggagcatggaattggactgcataatatccgaagggttgcaaggatgtatctgggagatatctctttagagcaggagaatcaggaagtggttctaagtattatgttacaggtagaataaaaagaagtagtatttcaggaaaggcactaacaataagaagttagtgctttttatttgcttcacaacaaaaaaagggcggttcacaacatcgctgtttattgtgaagaaagatgtgccgaaggaatcagtaaagagaaatcatgttgtacagatttttaaggaaacggatttcagaatttaagttcaaggagtctaaatcctctcctcaccagtgggttcggattttgctccgcaaaacaaggagtctaaatcctctcctcaccagtgggttcggattttgctccgcaaaacaaggagtctaaatcctctcctcaccagtgggttcggattttgctccgcaaaacaaggaggattaaatgagaattaatggatttagtgggacaaatatgcagtcagggacaatgggaatggcacaggggaatgattctgtaagtaaaaatattcagaatcagattgcaaatgccaaacagaagctacaggacttatcatcgaatgaagaaatgtcattagaggataagatgaaaaagcgtcaggagatacagcaggagattaacaatctcaatcagcagttaagacagcaccagatcgagcagagaaaggaacagcagagtaaaaattcgtcatctatggatgatatggtggctggaacaaataacacttcgaaaaagaaaggcaccggattgtccaaggcaagtatgcaggcaatgatctccgcagattcttccatgaaacaggcaaaggtgcagggcagtatggcaacacagatagaaggacgtgccagtgtgcttgaatctgaaatcaaacaggatgccggaaaaggaaataccgagaagaaggaagaagaactggcagagcttaaggcaaaggcacagtctgcgacagcagcacagatgtctacacttgctgatgcaaataaatcagtagaagaagctgcaaaagcggataacagcaatacagaaggcacagcaacaaagaataatactgaaaaatctgagaaaacacagaaagctacaggagcagcagaggagacagacagcgtaaagaatacggatatcaaaagggaaacacaggtgacagtagaaacaccgactccggaaaatgcacagaatgcaacacaacaggcagtatatacaccgattgatattcgcttatagttggtaaaggagaatgggattatgtcagagattaagagttttaatgattacacaagtaaatataacagcaatgtagattattccgcattatttggcggaacttccgacagttcatccgtaggaaacaccaatatgctttctgattatgctgcaattaaaaacggaagctatggaaaacttatgaaagcatattatgcaaagcaggatgcagaaaaattatcggggaaaggcgatacttcacagaagcttacactgatgaaaacaagtgcggattccctgaaaaaatcagcagatgcactaaacgatgcgtcactctgggaaaaaaagaaaattaaaaagaaggatgaaaagaccggggaagaaacagaggtagaggattatgactgggatgcaattaccaaaaaagtgaaagcttttattgatgattataatgacgttgttaaggaggcaggagaatccaatacaaaagatgtcctcagaaatgcttcatggatgacaggcatgacagacaaaaccagtcatttactttctaaaataggtattaccataggaaaggggaataagctggagctggatgaagatgcattgaagaaagcagatatcagttcattgaaaacggtttttacaggttacaattcctttgcaggcaaaacagcccagaaagcagctggtatatcaaatgctgcaaaccgcgcaagtgcgacttatacaaacaatggtacatatttgaaaacggattcctctctaacgtcaggtaagatagataaggaagtataatggttatttcgaccagaaagcatgacgattacaaaatcagtgggaaatatgtctgctgatttttttattacaaaaaaaaggtcggtttgttacatttgagtagataataaatgaagaaagggcgatataaaaaacagataaataaaatttcagggaaaggataataggataatgaagattcaaaatgatacaggtgttacctatgctgcaaacacgaatcgttatagcaacacacaaaatgctggcagcaaaacgggcagaacatataagaatgcccatgaatataagaactatttaacacaaaaatacgattgtttacgaagcagggattattccgtaaatataaacagttctcttttgtcagaggctatgggagatgaaaagacaaaacaatggttggagtataatttatctttaataccggaaagtatcgaaaaattaaaagctgctcaaagtgctcgtggctgtaaggtactgagtgtaactgatacaataaatggatatgatagcataacagaagaagtactggtaacagatgaggctgatccgggaacagaaaaagcaaggaaagaacttgaagaaagactcgagaaaagaaaagcagaaaagaaagagacagaagaacggctggaaaaacagcgtgccgaaaaacaggagcaggaagaacggcaatataatctgagaatagatggcaaagatgtggcagatctgacaggaaaaatggtggaactgctaggtacgtcagcttctataggagtgacggaaagcggaacatcgtcatttgatgcgctggcatagaagcgttgaaaaggagcaatattgatttagttgttggaagaaaaacactgataaagttcagaaagaaactagtcagacaaagtaaaaacagataggaaggtaagattatggcaatcacaggatcccaacaacggtatctgtatcaagtgcatttttaaagaagtgcatgaatgacccagaaaaagcaaaatatttggaagaaaatttagcggctattccggattgtgccaaaagtgcagttgctggttgtcagggaaccttggcaaatcttagttatcagattgatgcaacacaaatttacacgaaataatccaagaacagaaagcgaaggagaagcagaaaaattcatagtataattgtgacacttatggtaaaatcgcatcagatgtcgaaagatatctgatacgaagagaaaaggacgagaaatatgaacaaaagtgtcagtattattacggatttggatggttcaaaaatagcccttattaatgatataagatttaagtcgaggaaggggatagattggaatgaagtagagcagtatctgaaagaatatattggagaatactttgaaatatccgaaacctcagagaaaatatatatcggttctgattttccagatgagttcagtcattcaaatgatacaaagggattaaaaggtgctaatatgaaagcgaaagcaaacattacgcctgctattggtgaacttatccagattgcttctgaaaaggcacagtatcctgattataagaataaacatggggcaaaggcacaatttggatggtatcgttataatacaagatttggaataccggtttatgatgaagatggaaatctggagcgttataacattttttcaacaagaatgcttgtaagatgtgatgcagatggaaaactttatctatatgatttggtaagaacaaaaaaagaaacgagcaagccgcatgagcaatagctgtacggtagtaaacttcgtttcttcctaacacctatagtaaaggtatatgtattgtttgtcaagaagaaaatcttgaaaggatgtgatttcatggcatacagccagcaactttgggacgaagcaaaaagaaaatgtaagcttggggaagaagaaataagaatggcaaaagaaatgaggcttaatcccaagagccacaaaaggaaaaaataacatttaactaagccgttatggagagtacatcttcatggcggctttttttgttggcatttgaaagaaggtgagaaaattgaaaatcaaaaaggttgataaagcaaagaagggaatgttcaggcagtatcgggcagcattaaaggaattcaagcagtccattaagacaaaaaattcttccattaagatgagcattcgcaactgtgtctgcacttggaaactcggaaagcagggcatagacggaagccatatgaagtgtaggaacgaggtttcccaattcgggaaaaaggatacaaacaagtctggaaacggaagatttcagttttgctcgttctccagctaacggaatatcccactgaaaaagcggtcggcgaggcgcagcaggaaagctgccccgaccgctctgccaacagcactccttgcggcaggagaggattgtggcgattccgaagtcagttcacgcggagcgcatccagtagaatttcaatgtgaataattttgttctgtctcctgcggatatggtgcagattggctccgatatcacttcggttccagattcaccgccgggcggaagaaaatccactgtagtatctgctttgcgcatattatgagaacacgattctgaaggcgttttcttttccctacacggacagttgatatttttccatccagtcattgagctggataaaatatgccataagctgggggcccgccatgagctgaccgaaccacggtctgccaagctccttgggagcggcgaggaacgcctcggcttttttgggatcgatcagcgggtagaccggcgcgttcggatcgcttatgatccggcgcaggtgatccgcgagaagcttctcgtagcccgggtggtaagtcttcgggtacgggctttttttgcggtgcagcagttctgccggaagcagatccgcgcaggcgtcgcgcagcagcgttttttccacgccgttctgatacttcatgctccacggcacgttgaagacgtactccatgatgcggtggtcggcaaagggaacgcgcgcttccagaccggagtacatgctggtgcggtccatgcggtcgaggagcgtctgcatgaaccacttgatattcaggtagccgacggcacgcctgcgggcttcctcgggcgattcgccgggaagcttcggggaagcacttatggtctcttcatagcgggcgcgcgagtaaccggcgagatccaggcggtcagtcacgtcgccggacaggaatgcggcgcgcgcagagacatcggcagaccacggaaaaccgtcacggtttaaaagctccgggcggtagaaccagggatagccgccgaagatttcatcggcacattctccggtcagtgtgactttgttgtgtctggcgaccagagaacagaagtagagcagggaggcatccacatcggtcatgccgggaagatccctggcgtcgaccgccgaaaaaagtgcctcataaagcgtgctctgggagcattccagataggtgtggtgcgtctggcagtgtgcgagcatgatgttgacgtagggcagatcgcgctcgggctgaaaggcgtttgactggaaatatttatcgttttccgcaaaatcaaaagagaacgtatttagagtctgcccgtccttttgcatgcagcctgcggcgatcgcggttacgatggaagagtcgatgccgccggagagaaaggtgcagaccgggacgtccgagaccatctgccgctttacggcatcgcgcaccagataagagaccatctccaccgttttttcataggaatcggtgtgcggggcggcggtaagatcccagtagcacacctgctccatgccctcccgggagaaaatctgataatggccggggagaacctcgtgcatgccggaaaaaatgccgttgccgggcgtgcgtgccggaccgatggacagaagttccaacaggctgttttcatcgatggcgggcgagatatccgggtggcagaagagcgcttttggctcggagccaaagaccagtgtgccgcccggggtgctgtagaagagcggtttggtaccggcacggtcacggtacaaaagcagttcaccggttccgccgtcccagatcgcaaaggcaaaaatgccgttcaggcggctgacaaaatccttcccatagtgcagataggcgcagagaataacttctgtatcggaagtggtggaaaaagtatacccggcggcgagaagcggcggcagcagttcgtcggtgttgtagatctcgccattgtagacgatcgcgcaggtgcgtcccccgtcctgccggatcatgggctgactgccgcccgcaatgtcgcggatgctgagtctggcgtgggaaagtcccacatgcgtgtctaaataggtgccgaaactgtcgctgccgcggtgggcgagcgcgtgatgcatgtcggtgagaatacgttcccagaggacgggttcctttttaaaatttttagaaaagtcgcagaaaccggagattccgcacatataaaatactcctttcatgggagaatgcgccggcaggctgccgcacattcagatactggaatagtgtatgccgcgcaaacggaaattatgagccggcagaaaacgggtacttgcgcatctcacgtaaaccgctataatagagaagaatgtgaaagggtgagagatacttatgaacgagaaaaagaacgagctccagatgtcagaggcatttctgaccagtatttttctggcggtctccggcggatttcaggatgcctatacctataatacgagggaggaggtcttctccaatgcccagaccggcaacgtggtgctgatgagccagaattttatggtgggcagatggatggacggactgcgctatctgttcccgctgatggcgtttgcgtttggcgtgttttttgcggagcgcatacaggggcgtttcaaatacgcgaagcggcttcactggagacagggaattctgctgcttgagattgtgattttatttgcggtgggatttatcccgcaggaatataatatggcggcgacggtgctggtgtcttttgcctgcgcgatgcaggtgcagacgttccgcaaggtaaacggctattcctatgcgagcacgatgtgcattggaaatctgcggagcggcacggcggcattttccatgtatctgcgggacaagagaccggaacagttaagacagtcgctctactatttcggaatcattcttttctttgcgatcggagccggcatcggcggcaatttgtccatgcgctacggtattcacatgatctgggtgtcggtgggatgtcttctggtcagcttctttatgatgttttctgagcgggtgaaataaaaaacagacaaaaacagaatacaggcagacataacggtctccgcggcggcatctaatagaaataagatgttgttgcggagattttttatgccgaacgaaaaaatggagaatctgctgaatctggcactggcggcgacacaggaggagcgggagaagtcgctggagctggacatcggctacgacagtgccgaacagacgtgggaggtcattgtaaaatttgtcgggacaacggaagatcttgtggcgttacttttagaaaactttcccagggaatatccgcggatccgtctgacaaatctgcagaatgaatatgctattttagtgttgccggaacatctcgtggagccggtggcagcgctggataaaatcgagtacatggaaaagccgaaacttttatttttcgcggtggacaatggaaagcgtgcatcctgtattacgcagctgcaggagagaaccggcctgtcgggtgccggtgtccttgtgacggtcattgattccggcatcgattacgcgcatccggattttaggagggcggacggtacgacccgcattgtcagtctctgggatcagacgatcccggcgtccgggggcttgtcggcgccggcggggtatttccttggaaccgagtacgatgaggcacgcatcaacgaggcgctcgcgcagcccacggaacagcagcggtatgcggtctgcccgagcagggatgcatcgggacacgggacacacgtggcgggaattgccgccggcaacggaagagcgtcggagggaagataccgcggtgtggcgtatgagagcgatcttttgattgtaaagctcggcaaccagcgggagggggcgttcccgcggacaacggaactgatgcaggcggtggattactgcattagaaaagcgcaggagaggcagcagccggtcgctatcaacttaagctttgggaataattacggaagccacacgggaacgtcgctcatcgagacttatctggatgatctcgcaaactactggaagagctcgattgtgatcggaagcgggaatgagggagcggctgccacgcacacggcgggaacgcttggaatggggcaggcggaaaatgtcgagttcgcggtgggggcttacgagagcgccttaaatctgcagatctggaaatcctatgcggatgagatggcagtgcttctcattcatccgggcggcatgcagatcggaccgatccggcagatacagggaccgcagcgctttgcgctggggcagacgcagattctgctctactatggagagccgagcccatacagcccttaccaggagatctacctggatttccttcccgtgcgcgactatgtggacagtggaatctggacggtgcgcctgattccgcagcgcatcgtcacggggcgctatgatatgtggttcccggcgggaggcgttttaaacgagggcaccggattccttctgccgcgggaggagacgacgcttaccattccgtccactgcggcaaaggtgattacggtcggggcgtacgacgcgcggttcgggcagctggcgggattttcgggcagaggatttacaggaaacggacaggtcaagccggatcttgcggcgccgggtgtggagatcacctcctgcgcgccgggcggaggctatacggcgcgttccggaacttcgatggcaaccccgtttgtgacgggaagcgcggcgcttctgatggagtgggggattgtgcgcggaaacgatgcgtacctgtacggagaaaaaataaaggcgtacctgatccgcggagcgcgtccgctcggaggaggaagggcttctggtctgctgcaggaatatccgaatccgcaggtggggtggggaactttatgtttgtcggacagtctgccggagtaggaaaacaaaagaattgtggaagtgcgaaaaaagacgaaaaaagaagacaagggaaattgtgcagtatttcaaagaaagataaacaaaatataaattaatcgtgaaaaataaatgagaaaattgaaaattatgttatacttttaacaaaataaaaaaaatacagtatattttatgaggatggctggtgaaaaccggcggtttcagcttactgcgcggtaatgaaattttgttaaaggagaccgaagtggagtgaatgatattgtttatcagcatgaagtgatcgttccggacaggggacttccgtttaagctgtttctctttgagggcggcggcggaaaatatatcagggagaagcactggcaccgttctatcgagatatttgccgtgagacaggggcagcttgattttttcctgaatgagaaaaaatatgtacttgcagcgggggagtttgtgctggtgaacagcaatgaggtgcatgcgatccatgcccctctgccaaacgagacgattgtgctgcagattccgcttggcgtctttgcggattattatacggaagaacagtttatctggttttcgcacagcggaaaagaggatgaccgtcaggtgttttcactgctcgagacaatgtttgtggcgtacggtgagaaacagaccggttacgaattaaaaatgctaagctgtttttatcagctggagtatcttctggtgacaagataccggaagcttgaggtgggcgaagagatacttaagaacaataagcagcttaagcgtctcggaaggattaccgggtatctgaaggagcattatacggaggatgtttcgctggaaaaactggcggggatttttggttattcaccggcgtatctctcccggatgtttcaaaaatatgcgaagatcaattacaaggaatacctgtcgagtgtgcgtctggagcatgccgtgagggatctggaagagacggatcttgcgattggcgagattgcattaaaccacggctttccaaacagcaaggcattttccaatctgttccggaagcggtacggaatgctgccgaatcaataccggaagacagtcacatcagaaaaagaacggttctcctcatattacttaccgcataaaggcagccgtttatttctgatgtgacggcttccggtaaaacgctccgcgggggcaggggcaagaacactaatttatcgtagtaatatctatagtttctcccgcgtatccggaaggagatctgtgctaccatagatgtatataaaataaaatggcaggaggagcacagaatgacaggaccagtggcaccgagagacccggaaaaagcaagagcacatttttatattatgcgtggaaaagagatctgcggactgaagcagggagacggcaaagcagtgcagttcatctatgaaagtgacggccgtctggcaaacagtgcacagattgtcggaaatatcacggatagcagaatacttgaactgctcggtacagtgaaaggcttccgcacgcttgtacacagtattggtgtgtcggttgagatggagcatccggctgaaaagatagaatttgtttttcagatgtacggcaaaaaggatttgtatgggggcggaacgaatctggtggcaacactgcagggagatgggatggaacagaggatctgtctgtcggattatgaatggagtctggatgatgatgtgcccggacagatccgctttacatttgaccagccggaacgggtgggaaaggcagatgtccgtttttatttaaacgacggatttacggcaccggaagatctgacagaagaaaaagtggatctccattcggaagaatattataagatggtgcagcgctctcttatgaacctgggaaatacctaccgcatccggaaagtgattgagaaagcgcgagccggaaaagaagtgacgcttgcttttatcggagggtccatcacacagggggcaggggcagtgccgattcacacagagtgttatgcatataaggcatatcagctgtttcagaaacgatttgcacggaacaataatgtcagattcatcaaggcgggagtaggaggaaccccatcggagcttggaatgatccgttttgacagagatgtgctgcgtgagggggaacagccggatcttgttgtaatcgagtttgcggtgaatgatgagggagatgagaccaaaggggactgctatgagagtctggtgcgtaaggtattgaagctgccgtggagacctgcggtggtactcttgttttccgtatttgcaaatgactggaatcttcaggaacgtctgcagcccgtgggaagacagtacgaccttccgatggtaagtattctggatgcggttaccccgcagttttccggaaaagaacagaaaagagtgattacgaagaaccagtttttttatgacatgtttcatccgaccaaccttggacataccattatggcagattgtctggaatacctgatggaggtatgtgatacgtccgaccatgcgagggtggacagcttccggcagggcatgacggaggaggaagtcttagaacagtgtctgcgcggggagcctgcgatcggcaattcgtttgaaaaagtaaaactcttagaccggcgggacggatatgagggcgccagtatgagagagggaggctttgatgcgacagatcacgaactgcagtgtgtggaaatggatcaggatctttgcactacgccggaattcccatataactggatgtatgatggaactaagccggatcgggcgttttttgaactgacgatcacatgcagagcgttatttctgatatttaaggattccggcgaggtggatgccgggacagcggatgtgctggtggatggggaattccggttcacagcagatccacatgtcaataactggttgcactgtaatgcggtgctcgtatttcaggagaaggaaacggcagcacataccgtgagaatccagatgagcggtgagaatctggataagaaatttacgattctcggatttggatatgtggagtaggggggaaaagctatggttacagttaagaatccgattttgacgggattttatccggacccgtcgatctgccgggtaggagaagatttctatctggtaacatccagttttgcatatgcaccaggtgttccgctgtttcacagcagggatctggcacattgggagcaaatcggaaatattctgcagagaaaagagcagcttgctgttgggggagaggagatttccaggggaatctatgcgccgaccatccgataccataagggtatttattatatgattaccacaaatgtcagctatggaggtaattttattgtgacggcggagcacccggaggaaccgtggtcagatccctgttatctgggagaagaagcagccgggattgatcccagcctgttttttgatgaggatggcaggtgctattattgcggaaccagaccgaatcccgatggagtaaggtacaatggggactgggagatctgggtgcaggaactggatctgacgacgaagaagctggtcggagagagtatggcaatctggaaaggggctgtgagaggggcaatctggccggagggaccacatctgtacaaaaaagacggctattattatctgctgcatgcagaaggaggaaccggaccggaacacagcatcagtgtggcgagaagccgaaagctgtttcaatggtttgagggatgcccgcgcaatccgatctttacacatcggaatcttggggcggattatcctgtggtctatgctgggcatggggatctggtggaggatcaaaacgggaactggtatgtggtgatgctcgccacgagacgctgtaagaaccatggaagtatggggcgcgagacttttctggcaaaagttgtatggcaggatggatggccggtaattgctgccggaaccggacgtctggagaagacactggaagtgccgctaaaagagtaccggtttccggaagaaacaggaacgtgcgataccctgtgtttctgggagacgagaccggatcagaggctgcttgggatcgggggaagaaatgaggcatcctattcgctgacagaaaaacgcggtgtattccgcttatactgtggaaaacagacgatcggtgaaaaaggatgcagcagttatttcggactccggcagaaaagctatcatttccatgcagcggtcagattccgctttgaaccacagtcggaggatgagacggcgggaatggtattataccagaaccatgagaatcatctgaggatggagatcgggaaaaagggaacagatgtctgctttcgggtgagcacatatgttcatgccagggaagaggtcatccgtgaagttcttctgaaagaagagcaggagttatgggagattctgatccgcggagaggagcagagtgcgggtatctgggtaaggctgggagaaaaaatgatctgtgcctgcgataaggtcagcctgcttgcgtataccacggaagaggcgggaggctttgtgggatgcaccattggaatgtacgcgtcttcgcatggaactgacagtaaaaattatgcggattatgtgagctttacgtgcagtggagcagaagaatagagcaaaaggagagggagagatgagtctggagacgaaagaatatgcaaaaagactggtggaacagatgacgttggaggagaagatcagccagatgcgctatgaatcaccggcgattgagcggctgcatattccggcgtataactggtggaatgaggcgcttcacggagtggcaagatccggtgtggcgacaatgttcccacaggcaattgccctggcagcgacttttgatgaagaactgattgagaagatcggagatgtggtgtccaccgagggacgggcaaagtttgaagcgtattcaggaagaggagacagaggtatttataaaggtctgactttctgggcgccgaatattaacattttcagagatccacgctgggggagaggacatgagacgtacggggaggatccctgtctgacggcaaagcttggctgtgcgtatatcagagggattcagggcaaagatccggatcatttaaaggcggctgcgtgtgccaagcattttgccgtgcacagcggtccggaagcattgcgccatgagtttgatgcaaaggtgtcgctgcacgatttgtacgatacgtatttgtatgcatttaagcggtgtgtcaaggatgccggtgtggaagccgtgatgggcgcttataaccgcgtcaacggggaaccggcgtgcggaagcaagacacttctgcaggatattttaagagaacaattcggttttgagggacacgtagtgtccgactgctgggcaattcttgattttcatgagcaccatcatgtgacaaagacggtagaagaatctgcggcaatggctgtcaaccatggctgtgatttaaactgcgggaaggcatttttgtatttaagccgtgcctgtgaacagggactggtggaggaaaagacgatcacagaagcggtggagcgcctgatggatgtcagaatccggctggggatgatggaggattatccgtctccatatgcgaacattccttatgatgtggtggagtgccccgaacatattgcactgtccttagaagcctcgaaaagaagtatggtgctgcttaagaatgacaaccattttcttccgctgaagcaggaacagatccataccattgcagtgatcggaccaaacgcgaactccagagcagcgctggttggaaattatgaggggacatcctccagatacattacaccgctggagggaattcaggaatacaccggagagaaaacccgcgtcctatatgcgcagggctgccatctgtataaggatcaggtagaattcctcggggagccgaaggaccggtttaaggaagcgctgattgctgcggagcgggcagatgtcattgtgatgtgtctgggattggatgcgggcatcgaaggcgaagagggagatgcgggaaatgagtatgccagcggtgacaagctgggattaaagcttcccggactgcagcaggaacttttagaggcggtcgcagcagtcggaaaaccgattgtgctcaccgtgctggcgggaagtgcactggatctgtcgtgggcgcaggaacatgcacagatacgggcaatactggattgctggtacccgggagcgagaggtggaaaagcaatcgcagaggcattgttcggagaattctctccatgcggaaaactgccggttaccttttatgaaggaacggaatttcttccggattttacggattattccatggcaggacgtacctaccggtatacggacagacatgtgctctatccgtttggatatggtcttacctattcgcagatccgttattctgatgcacatgcagatgtcacagattttggaatactggagccggtaacggtgcatgtaacggtggagaataccggtacctacccggtacaggaagcggtacaggtatatgtcagattcagtgaaagagaagcttacgatcccggctatcagctgaagggaatccggtcggttgcactggaatgtggggaaaagaaagaggtttgtatcaccctttctacgcgtgattttgcactgatctccgaggagggaaaatgtctggtacacccgggaagctatgagatcgcagtcggagggcagcagccggatgagagaagcagccgtctgaccggacagacggtgagcacactttttatatgcaaaacgggaaatgtgacggaagtggaatactgatgctgccggtatccgttgcactcgatgaaaaacaatgttagtataaaaatactgggagaggatatgaagagaattctgcatgcggttgaagcctggatggatgactttaaaataaaaaataaattttatatcctgtatatcttgtgcgtgctggttccgctgattgtgacggacagtgcggtattttctgttgtcatgaagtctgagcgggaagccagagagcatgagatggcgaatattgccaatgcagttgcatacagtatttcaaatacggtcaacaatgcagcagagatcgggaagagtatttatacgagcaaatatattaaccgttttttggcgaatacctacagcgatccgttggactatgtggtgagttatcaggatttttttaaagataccctgtttgagagcggacttggcatgaacaacatggtaatcacgatgtatgcggataatgacacgatcgtgaatgggggaaaggtatgtaatatgaaggaaatacgcggtacagaagtgtaccgctattttcaggataacggattgaataagggattatatttccagtatgatgacagcagggcaccttcggtggagccgcagagacggatgctttttttccagaagctggacttttatgcggaaaataatatggaaaaggtgctgctgatcaacatcgattacagtgcagtaaaccggacattagagaaaatgaattatgacacggatgtatttatctgccagggagataagattgtcttatcaaatggcagatattccagtatcggaaaggaatttcagacatttgaccagacgggcagggtcggatactgtcaggaactcgagttttacggaatggatctggatatttatgtcatgcagcccaaacgccagctgtggacggaaatccggaaaaacctgccgctgattggattcttaattgttgtaaatgcgattctgccactccttctggtgcggggatttaaccggtcatttacgcagagaatcagcgaactcagcaaagtgtttgagacagtcggcggggaacatctggtgccgatttcgtatgtgcgtggaaaagatgagattggaagtctgatgagcaattacaaccgcatggttgcgagaacaaatgaactcattcagattgtgtataagaataagattaaagaacaggagatgctggtggaaagacagaatgcagaactgctcgcgctgcacagccagatcaatccgcattttctgtttaatgcgttggagagcatccgcatgcacagcctgttgaaaaacgaatatgagacggcagacatggtggaaaagctggcgctgatgcagcgtcagtatgtggaatggggaaacgacagtgtcgagatccgcagggaaatggaatttgtgagagcgtatctggggcttcagaagtatcggtttggagagcggttaagttacagtcttgaagtggaagaggattgtttggacattaaaattcccaaaatgacagttgtcacctttgtggaaaatgcctgtgtacatggaattgaggcaaagacagctcccggctggatttttgtgcggatctgccaaaagcagaaggcactttatctggaagtggaagataccggatgcggcatggacgcctcccagatgcaggaattaaaagagcgcatgctaaacgccagtattgatatgctaaaggatggcggaagagtgggaatcatcaatgcatgtctgcggctgaaaatggtattcggggagcaggtggcatttgatatagagggggagcagggtgtcggtacgacagtgagtatccggatgccattgtagagaagggaaggaaaaagatgggggaagcattgttaaaggtattgctcgtggatgatgagccgtttatattacagggactgaagatactgattgactgggagcaggagggatttgaagttgttaagacggcggcaaacggagaggaagcactggaatatctgcgcggggagcaggtagatctcattattgcggatataaaaatgccggtcgtcacaggactggaacttctggagaaaatccgcggggaaaagatttccgatgcacattttgtaatcctgagcggatatgcagattttgagtatgcgagaaaggcgatccgttacgactgcacagattatattttgaaaccggtagaccgggaagaattgctgaaggtgctgaataaagtccaggtattgcgaagggcggacaaccagaagaagcaaagcagccgggaaatggagcaggcgtatctgtccagacatctgatcgcattgattcagggaaagtttgacagtgtgaatctggagtatgtgaagtcgcatatggatggggcatccggtatacggtatgtagagattcagatggatgatgacggcagagccgaggaaatatcagataaggaaaaacggggctttcagcggcagctgtaccagtattgtattgagttcctgggaccccatgcatcacattgtgtctttgatgtctcaacgcatgagaagatttatgacattgggttattgtattgtgatgcgtttgctaaggagcaggggattgatgggaaaacatatctgaaccggtttcttgagtatctgattgctaacatgcaccagccggtcatcatgcttgtagggaaaaaggtgcaggatatcagcaacattgccagatcttatggaaatgcgtgtatgctccggtcttttcagggattccgcgcaaaaaagccgatctattactatgaggaggaagtgcaggttacttccgaaggaattgttttatgcaagagcagtctggatcgtctgttaaaatctgtggagcagaacaaccatgtagagatacggagtgcgattgagcagttttacggggagatgataagcagggaaatgaccggtgagacgatgaatctgaacatcaattatcttctgtttcagctgatccatctggcgagtgagcaggatgatggggtaaatcaggaagagattctgcgcctgatcagtgagagcagctttgaaaagggggtaatgcgcggcagcaaggcgcatctgacccggtttgcatgtgaatacggtgactatctgttgcagcttcgcaaaaatgtatccagaggagtgctaggagagattgagcgtgagatccgggaaaactatgcaaagaatatcacattaaagagcctgagtgaaaaatattacgtcaacagcgcatatctgggacagctgttccgtaagaaaaacgggcagtcattcaaagattatctgaataattacagaatggaacgggcagcggatctgctgttacataccgataagaagattgtcgagattgcggaggaagtcgggtatcatgatcttgattattttgtgaaccgttttattctggtaaaaggctgtacaccggcgaagttccggcgtgaggcataaaggaaatacggcaagttcaaaagcagggcaaagtatggaaataagaacctatactttgccctgcttttatctatacttcctccaattgtctgaatctgccagaaaggtaaaatagtattatcaaatagggaggtagttacaagatgaagagaaggaaacttatcagtgtattgctggcagccacaatgatggcagccatgtttgccggatgcgggagtgatgcggcatcgacagacgcaaaggaaaacgcagacggtgcagacagcacggaagccggtggggtaaaagaatttacggctttttttgcagttcccggttcagagatcaatgacgacaatgagattcagcagatcattgccgataagaccggcgtgaaagtgaaggaaacatggctgaccggacagacggcagaggaagctgtcggcatgatgatcaccggtggtgagctgccggactttatctgcgggggaagcggacagtcacagctctatgatgcagacgttctggtagcactcgatgattatctggatgattatccgaatatcaaaaacttctttacacagcagcagtgggatcagcttcgccaggacgacggacatatctactggataccgcagttcagcaatatcaagggagaagagaaggtttgtacacacaacgatgaggcattctggattcaggccagggtattaaaatgggcggattatccggagatccgtaccatggatcagtattttgatctgattgagagatataatgaggcaaatccgaccatggaagacggaacagagaacattccgtatacgattctctgcgatgactggagatatttctgccttgagaatgcgccgcagtttctggatggatatccaaacgacggctcctgtatcgtagatccggagacattgacggtgatcgattataatacgacggataccgcagtaaagtatttccagaaattgaatgaagaatatcagaagggaattgtagatccggaatcctttacacagacctatgatgagtatattgccaaactgtcaaccggacgtgtacttggcatgattgaccagtggtgggattttgcttacactgcgggagatgcaatcaagcaggcagggctggatgcacagggatgcgattacattccgcttccgattaccattgatgagagtgtggaaaatcagtggcattgttccggtggtgtattgaatgtatcggatgggcttgccattaccacaagctgtgaggatgtggaaggtgcgctgcagttcgtagatgatcttctcacacaggatattcacaacctgcgtttctggggagtggaaggcgttgattacaacgtggatgaaaacggggaattctatcgtacggaggagcagagaaccagaggagtagatactgcttacaaagcatcccatacctgtacctattcttatttcccgcagtattccggcaccagtgatgacggaatcaatgcgaacaagccggatggtcaggcaaatgaattctttgacggattaaatgatgatgtaaaggaagcattttccgcttatggtgcagagacgtatgtggatatgatcggaacaaacgaggctccgggtgcatggtacccaatgtggtcttattcaaacagcttcaccacggacacggaaggcggtatggcatggaataagatcggcgagatcaagcatgaataccttccgcaggttgtaatggcaaaggattttgacgcagcctgggcagagtacatggaagcatacaacagctgtgatccggaagcgtttatcggtgagttacagacagaacttgataagagaatggaagaagcagcgaaatacgaatagcacataaaatgaaattggaaacaggcagatgcaaggaagatttcatctgcctgttttttaaggagtgggatatggctttgacgaaaacaagatcaaaagaaaaagaaaatcagtataaggcaaagatcacctggaaagaagtaaagaggcagaaagttctgctgttctggagcgctgtgatggtaatctacggtattattttttgttaccttccgctgacagggtgggcaatggcgtttcagaattataagccgaagcttggaattcttcactctgagtttgtgggattgcagaaattccagaccttattttccgatatgacgtttatccgcgtgatccggaacacacttgcgatgggcgtgatcaatctggttgtgacatttgtgacggcgattgcatttgcgattctcttaaacgagataaaatcacgcggggggaaaaaagtagtgcagaccatttcttatctgccacatttcctatcctggatcattgtaacgggaatcctgcatgatatgctttcgggaagcggaattgtcaatgagatattgatgaatctgcatgtgattacgcagccgatcaattttttcgcacatccgaactatttctggccgattgttgcatttgccaatgtgtggaaggagacaggatggaatgccatcatttatctggctgccattacatccattgatccgtccctgtatgaagcggcgtccattgacggagcaggaagatgggctaaaatcaaatatgtaacacttccgggaatcaaaccgacgattatgattcttcttttgatgaacgtgggaaatgtgctgaatgccggatttgagattcagtaccttctgggaaacggactggtgcagaaagtgtctcagacgattgatatctatgtactcaaatggggtatcagtcagggagattattccattggtacagctgcaggtatctttaagagtgcggtaagtatcattctgattgtcattgcaaaccagattgcaaagcgcaacggagaagaaaggttattctaaggagggtgatatcatgcaacagctggcaggagcaaataaaaaaagaaagagaacaggatcctttgatgcatttcccattgtgaacggaattattatgcttgtgattgttgtaatcacattatatccggtgctgaatacgctggcaatttcattaaacgatggcacggatgcattgcgcggcggaatttatctgtggccgagaaaatttacatggaaaaattatatcacggtattgcaaaaagataatctgattaccggtgcatatgtcacggttgcgcgaacaattatcggaacggtgctggcactggctgcaaacgcgattctggcgtttgttgtcagcagaaaaagatttctgtttaagagaagcctttccctgttctgggtcattacaatgtatgtgaatggaggaatgattccgacattcctgctttacaaaggactcggtcttaccaacagtttctgggtgtatgtaattccgggcatggtgagtgcgtttaatatgttggtaatccgcacctacatgaatggtataccggacagtctggaagaatccgcacagttagacggtgccggatatacgacaatttttctaaagatttactgtccgctctgcaagccggtatttgcgacggtggcattgttcgttgcagtcggacaatggaattcctggtttgatgccatgctgtacaaccgcatgaattccgatctgacgacgctgcagtacgagctgatgaagctgctgtcatccgtcacgaatcagggaacttcggcagaagccatgaagaatgcggtgggaaccgtcacgccgacgtcggtccgctctgcggcaacgatactcacgatgctgccgattatctgcatctatccgtttttgcagaaatattttgtcacaggacttacacttggcggcgtaaaagaataattccatataaaagcgaaggagcgtatgcaatcccatcttgccggtgtcccttaaaaacagtataattgactggaaaagagggaaaacagatgaaaaagagactggcagaaggaatgaccttaatggtactgcttctggtgctgtggaacatggcggcacacacagaccgcatggcagaagcgcagataaagcattttacggctttttttccgacggagggaaacagccttgaatatggaaatatcatgaaagcgaagattgcagaggtgacaggagcagagtgtgaagaactctggctgtccggtcagaccaaggagcaggcgctcaattcatacattgccagcggcagatatccggacttcatacagggggaaaaaaacttatacgaagcagaggcattgattccgattgatgagtactgggaggaatatcccaatatccggcaatacatgacgaatgagcagtgggatatgctgcgccaggaagacggacacatttactggattccacaatttggggtgacaaatggaaaaagcagcgatgtgatccatgacggggaagcattctggattcagacgagggttttaaaatgggcaggatatccggaagttcatacggtagagcaatatttcgatctgctggaggcttatgtgaatgccaatcccatgatggagaacggaaccaggaatatcccatttacggttcttagcgatgactggagatatttctgcctggagaatgtgccgcagtttctggatggatatcccaatgacggctgctgcatggtcgatccgcagacctttcaggtgatggattacaacacgacagagacggcgcgggcttattttgaaaaattaaatgaagaatatcgtaagggaatactggatgcggaggcgttcacaaacagctatgaagagtatctgaataagctgtccaccggagcggtccttggaatggtggatcagtggtggcagttttactatgcgatttatccggcatatgacagacagaaattgagtgagcagggatgcgattatgtaccgcttccgattacgatgcaggagggggtggagaaccagtggcatgtcgagagagcggcatctatcgatacgtcctccggcctgtcggttacggtctcgtgtgaagacatagacggtgccttgcagtttgtgaatgatcttttaaagccggaggtggagattctgcgtttctgggggcaggaaggaacggactattgcgtggatgaggaaggggttttctatctgacgaaggaacagtcaaagcgtttttcggatgatctgctggcatcggactatttctgctattactcgtatttcccgcgttgggagggaatgcttccggatgggaaaaatgctttttcactggaataccagccggcagaatttttaaaaagccagccgggggatgtccagaaatgtctcagggcgtatggctgtgaaagctatgtggatatgattgggaatcataaggcaccgggaaactggtatccgatgtattcttacgctacatcgctttctgatgccacagaagcaggaatggtatatgagcagatcaatgagatcaagcacgagtggcttccgcgggttattatggcagaggattttgatacagcctggcaggaatacatggatgcatacaatgcctgcagtccacagattttgatggaggatctgcagcaggaagtgatgcgccgcatctgccggtagaacctttcattctatacgatattctcacagaagatcttatagaatgggaggtttttttatggggacagaacttaaccaggcgctggtgcagcaggcactttcgtttgcgccggagataacggaagaacggcaggcggtgaaggtgtgggaagatgggacggtagaattctatctgtatgcaccgacggctgagacggtggaagtggcgggtgtgggaggttattttgatgcggcgccgcttgcactcctgccggatggaaacggagggttttacaggaagatagagaacttcccgcgaggaatgcactattatcactggtttgtggacggagtgaaactgtttcatccgaaagccggtttttcttatggctgctttgagacaatcaacacatttgaggtgccggagcgcggagcagaattttactatctgaaagaggtaccgcatggaacggtgcatctggcaaagtacgcatccggtgtaaacggtcacctgaaagaatgttatgtatacacgccttatggaagccagaaagatcccagccggcggtatccggtcttatatttacagcatggtgtcggtgaaaatgagacgggatggatctggcaggggaagctgaattacatcatggacaatctgatcgcggagcataaatgcagggaaatgatcgtggtgatgagctgtgattatgcgtttatcgagggtgaggaggcagttttctttcccggggattttgacagagagctgatggaggatctgattccttatgtggaaacacattttccggtaaaacggggcagaaattaccgggcactggcaggtctttcactggggtctgcactggcggcaagaagtgtatgcaggcaccgggataaattttcggcacttggaatgttttccggggtatcgctttatgacgcagagaggatctgcacggatgaggcagaaaaaccggatgttgtgtttttctcctgcgggagcagggaagaggagatttcgcgcggaatagaggatatctgtaaaaaaatgcgcgaatcagaaacgctttgcgtaaagaaagtatatgaaggctatcatgaatggcatgtctggagaaagagtctgagagattttgtgccgcttctgttttgtggcgcagagactgtggaagaaacagcatctgcatgctgcatggagcgccgcctggatgaaaaacagctgtccgtccagagcatggaggagcagatgctcttttttgatccggtacaccggcagatccggtttgaaacggatgcgcaggggagaccggcagggaaatatccaaagaccataccgggcgtaaaagtgtgcagtgacggcacggcagaattctatctggaggcacccggtgcggctcgtgtggatgtccggcttaaggagaagcatgagattttggctgcgttaacggagcagcagccaggaatatggcgaggaaaaataggaggactttctgccggctatcatgaggtacattttatcgtcaacggcgtggagacgattcatccggaagttccggcagggtatgccggatataacggacagggcagttttgcatgcaattattttgagattccggaaccggagttctgttatccgcagctggcgaatgtgccgcatggcatgcttcatatggaatggtaccgggaggaagaaaatggcggataccgcctgtgttatgtgtatacaccggcaggatatgagaagcatgcaaaacagaggtatcctgttcttattgtggagagctttcggtgggagagcgaatgtgtgtggattcatcagggaaaaatcgccaacatggctgaccggcttatcgcagagggaaaaatgacggaaatgattcttgtgatgcagaagtgcagcaagcggaaagaagcgaggattccggaggagatcattcaaaaataccgtgtgataccgggagaagagcatcgggcgatgataaaggcacaggatggatctgactggacatcccgcagacatcagctggcagagcagctgaagaactctttccggtaaggagaaggattgaaaatatggaagagattatattttggatggaagaggcggcagattccggggtaaagaagatagcggataaagttgccggcgatgtggagctggtaacggacagacgcccgcgggtgctgtacggcacatcacaggaagaacttgcggatgtggcagaacgggcagagactgtgattgttccggctacggttggaaaaagcagacttctggagcagatggaggaagaaaagagaatcggtctggaacagatccggggaaaacgggagtgttatggctggtttttcctgaatgatccagaatggcacggaacacagattcttctgattgcagggagcgataagcgtggaacgatctacggactgtttcatctgtcagaacttctgggcgtatctccgtttgtcgactggtgtggtatcaggccgcctcaccgtgagcatgtgggacttcgtgcatcgatggcgtgtgtggcgggagagccgtctgtaagataccgcggtttttttatcaatgatgaatggccggcatttggaacatggtgcaaccggcgctttgggggatttgggacttcggtttatgagcatgtgtttgaactgctgctaaggctcaaagggaactatctgtggccggcgatgtggagcgctagatttggggatgacggcccgggacttgcaaacgcaaagctggcagacgaatacggaatcattatgggaatgtcgcatcatgagccgtgtctgagacagggggaggagtataagtacctgcgcggaaaagattcggtatatggcgatgcatggaatttccggacgaaccgggaaggcatcatccggttctggaaagacggactgcttcggagaggaaaatttgaaaatgtgattaccctgggcatgcgtggagaggcggatacggcaattctcggagaaaaagcaacattggaagacaatattgaactgctgcgcgatgtgctaaaaacgcagaatgagctgatccgggagtgtgtggatgaggacgtaaagcgtgtcccgagaatgcttgctctctacaaggaagtggaagcatttttttatggaaatgatcagacggcggggctgatgggatcggaagaactggaagatgttattttactgctgtgtgatgacaactatggaaacctcaggacactgccgacaaaggagatgaggacgcataagggcggatatgggatgtactatcatctggactatcacggctggcccatttcctatgaatggatcaacagttcgtaccttccgaaaatctgggaacagatgacaacggcatatgaattcggggtgcgggaactttggattgtcaatgtgggggatattgcaacgcaggagttcccactgtcgtattttctggatatggcatatgattttggacgttggggaagtggtgccgtcaatcagaccgcagagtataccagacagtggacgaggcagcagtttggaagctttacggaggaaatacaggaacagattgcggacgttctgcagggatataccagattgatacaaaagagaagacctgaggcaatgcgtgcaatggtgtatcacccggtgcatggaagagaaacgcaggatacactggaggagattaaacggatacttacggaagcggagcgtgtgtatgcgtgggtgaaggaacatgcgccggaatacgaagcggcgtttgtggcgctcatctattaccctgcggcaggaacactgaatctgaccaggatgcatcttctggcagggatgaatcaatacctggcaaagcttggagcacttcacgcgaatgattacggggatgcggtagaacagtgtctgaagcgtgaccgggaactggtgacggtatatcatcagatggatcacgggcgctgggatggcatgggagcatcggagcatatcggatttgtgcactggaatgaggatgaatgtttaaaccctgtgattcaccgggtactgcccgcggataaaccgagactggttgtgacagtggatcagacgatgcagcatgcagagggaagcccgtggcttacggaatccatgaaactgccggattttttagaccctgcgtgcaggagcgccgggatcaccctgtatgggctgagtgaatgtgaggctgcatacgaggtcacagaaaaaccggaatggctttcggtgtggccgatgcagggcgtgctggacgggaaaaagcacaattatgaaaagctggaacttgtaataaaccgggagcgttgggcaatgaaccgggatggaaatacaggtacgtctgcttgtggagtgcttgaaataaaaacgccttccggctgctgccggatcgagataccggtatgtgaaaatctgccggaagtaccggaaggtacctttgtggatacggcaggttatattgtgatggaggcagagcattatgcagaccggaaggatggatatgcagcggatggtaagcgggaaggaaaaaacgaaaaggtacggtttcaatgcatcagggactatggaaaaacgcggtctgccatgaaagcatttccggtcacagcgtatggtgtgccgggagaaaatgcaccgtatctggagtatcatttctgggtatcaaagcccggcgggtatgtacttacgctttatatgcagccctccaatccggtggcgaacgatcagaaactctgctacggtgtgcagaataacggtggtgagatccggatttataacgcggtacctgagggataccggatcggagatcagggagagttctgggcaaaaggtgtattagaccagatacgcagacaggagattccggtttcatgcagaagtggtatcaaccgtctgcgcatttattccgtcacacctgggtttgttctggaaaagctgttgatccgcccggaaggaacggatgtcctggaaagttatctgggacccaaagagacgtatcacacataaaggaaagaggagaaaaggagtagaacgatggcgggagcatttgagacgggaaagtatcgcaatgtgtttgcagagtacgggtatccggaagcggagattcagagaagagtggagcagacatttgagacaattttttatggtaatgaggaggagcgtttctatcatgaggtgggagccgacatggcatacatagaggatacgggaaaccatgatgtgcgcacagagggaatgtcctatggaatgatggcatgtgtgcagatgaaccgcagggaagagtttgaccggctgtggaaatggacccggacatatatgtacatcgaggatggaccatgtaagaattattttgcgtggtcctgtgcaacagatggcagtaaaaatgcggaaggtccggctcccgacggagaagaatattttgccatggcactgttttttgcggcagaccgctggggaaatggaaccggaatattccactatgcagatgaggcgcgggcaattctgcgggaatgcatccacaagggagagccggggcatccgggggaaccgatgtgggacacatccaggcatctgatcaagtttattacaaattgtaatttcagcgatccgtcctaccatctgccccatttttatgaattatttgccagatgggcggacgaagatgaccgggagttctggagagacgcggcagaagcgagcagagcgtatctgcatctggcatgtcatccggacaccggtttgtcggcggagtatgcggagtatgacgggactccgcatgagggacatcaggagattttcggcaggcatgactggtattacagtgatgcgtaccggacgattgcgaatattgccatggactggctgtggtttgggagagatccctggcagcaggagattgcgggaaaattacagagcttttactgcgaaaagcagagcggacactgggatggtgtgtttctgacggacggcacgcttcttagagagcgggcgctgcacccggttgcggtgatagcggtaaatgcagaggcttcgctggctgcgaagggagaaaatgcaaaggagtgcatcagaaggttctgggagacgccgcttcggacaggggaacgccgttattacgacaatttcctgtatctgtttgccatgctggcactgtccgggaattatcgtatttactgaataaagttaggtcatgaatctgatattttaatgtcgtatctggtattctgattttcaaaggaaggttatatttaatgtagaaaaccttagaaaatcaaaacaggagaaagcatatatgaaatatggatattttgacgagacgaagaaagagtatgtaattacaagaccggatacaccggcaccgtgggttaattatctcggttccccggaatatggcgcgattatttcaaacaatgcaggcggatacagttttgcaaaatccggagctaacggaagaattttaagatacatctttaaccagtttgacgaacccggaagatatatttatatcagggataataaaagcaaagactactggtcggcttcctggcagccggtgggaaaggatctgaaaacttaccggagtgaatgccgccatggaactgcttatacaaaaatgcaggcggattacagcggtattcactcagaagtgagatattatgtgccgctagaccgggcgtatgaggtgtggaatgtatgcattgccaacacatctgcagaagaaagagaactgacggttaccgggtacgctgaatttacaaacaacagcaactatgagcaggatcaggtgaatttacagtattcgcagtttattacgcgcacggttttctgtggggatcatgtgcggcagatgattcatgcgaatctggatcagatcgaggaaggcagcgatgtcgatgataaaatcgttgtcagccgtttctttgcactgaagggagcaaaagtgacatcctggtgcggcgacagagagaagttcctcggaagatatcacggatatggcaatccggcaggtgtggcagagggaacattgtgtaacgagggaaatgagaacggcaacagctgcggagcactcagtacggtggtgcggcttgcaccgggagagcactgtgagttcgcatttctggttggaatgaaagaggaacctgaggtggcagagattttggcctcctatgcgctgccggagcaggtctgtggaaaggaattgcagcagctgaccgattactggcatggaaagcttgcacattttcagataaagacaccgagtgaagaattcaatgccatgataaatacatggaacgcctataactgctttatgacatttatctggtcgcgtgcagcgtcgtttgtctactgtggactgcgcaatggatacggttatcgtgatacggtacaggatatacagggagtcattcaccttgcaccggagatggcagttgaaaaaatcaggtttatgctttccgcacaggtggataatggaggcggactgccactggtaaagtttacacacaatccgggacatgaagatacgccggatgatgcatcttatgtaaaggagaccgggcatccggcatatcgtgcagacgatgcgctctggctgtttccgaccgtctacaagtatatagcggagaccggacatctggaatttatggatgaagtgattccgtatgcaaaccggggagaggcgactgtttacgagcatctgaagcgtgccatcgatttttccatgaaccatctgggaaaacacggtatgccggcggggctgtatgccgactggaatgactgcttaagactgggcaaagaaggggaatccacatttgttgccatgcagctttattatgcgatgaatatattgcgaaagtttgcagaatacaagcaggataaagaaacggctgcctatcttgatgaaaagcaggaggaactgggaaaattgctgcaggaactttgctggaatgaggaccgttttatccgtggatttacagaagcaggcgaagtgatcggaaagcgcacagatccggaggcaaatatgtggctgaacccgcagagctgggcggtgatcagcgggctggcaaaagcggatcaggcagatatggcacttgagagggtatatgagaaattaaacacgccgtatggtgcaatattgatggacccgccgtatcatgcgcacgcctttgacggagcactggctgtcatctataatccgggtgcaaaagaaaatgcaggtattttctcacagtcgcagggatggattatcctggcggaggcattgcggggacatggagacagagcatttacttattttatggaaaatgcaccggctgcacagaatgaccgtgcacagatccgcgtgattgaaccttattgctatggacagttcacggaaggaaaggcaagtccgaatttcggaaggtcacatgtgcactggctcacgggaactgcttccacggttatggtcggctgtgtggagggaattctgggtatgcgtccggatttctatggactgcatctttcgcctgcaattccgcatgaatgggaggagtttgaagtaaataaagttttcagaggctgccagttacatattgttgtgaaaaatccgggacatgtgcagtcgggatgcgacagactacttgtaaatggagtcaggatgcagggagattatattccgcaggaagtattgaaaaagcagacagaaatcgtattgtatatgtcataagatgggaggaaagattcgtgggaaagatagaatttttggatcagcagggaagcttccgggtgtatcagccggaagactacagtggattgtattttcctcttgcaggagacggtgggttaaaatcctgcattacaccgacactcggcggcgacagcaaaagggatcagaaccatttcctgatggagccggtcagtattgaaaatctccataacaataaaaatacaagaaatttctggtgccgtatcaaaaaccggggatactggtcagcctgcggttcgtcggcagaggcagaatttctgcggtttaccggagaacaggagaaaagcgtactggaagccggatttatgtggcagaaactgacgcggacatccgcagtccatggactaaaagcagagattacttcttttgttacggtagacggagcgatggaagtgatgatgacggaacttaccaatataacagaggaaccgcttgaaatgacaccgattgcagtgatgccggtctatggaagaagtgcggacaatatcagggatcaccgccatgtgacttccctgctgcaccggatctgtaccacggattatggggtggaggtgacgcctgcgatgtcgtttgatgagcgggggcatcagaagaatcatacaacgtattttgtatatggttccaccggagagggagaggcaccggcagctttttacccgaccgtcggggagtttatcggggagggaggttcctatctcataccggaggcagtccggacagaaaagccgggagctgtggcaggaagtaaggcagagggaaaagaagcagtgggagctcttaaatttgcggagattttattaaaaccacatgagacagtctgctatctgactctgggcggaatgaccgacgagagatcacagatcgaacctcttacagcatctctcagacaaagaagccaggtaaaggaagcttatgatgaagtaaaacggtactggacaaagaaagtaaacatcacatttaaaacgggtaatccggatgcagacaattatcttaagtggattacgttccagccaattctgcggagaatttacggctgttcgttcctgccgtatcatgattacggaaaaggaggacgtggctggcgggatctgtggcaggattgtctggcattgcttctcatggacccttccgcagtccggcagatgatcatcgacaattacggcggtgtccgggtggacggaaccaatgccacaattatcggaaatgcgcagggggagtttattgcggaccggaatcatattacccgtgtgtggatggatcatgcgttctggccgtttgtgacgacaaaattttatattgaccagacaggagatctcgagattctttttgagaaggttccgtattttaaggatctgcagtccaaaagaggcacagatcacgataccggatgggacgagacatatggaaaatgccagcgcacagagggtggcgtcgtctatttcggaagtgtactggaacatctgcttcttcagaatctctgtgcattctacgatgtcggtgcgcacaatgagatgcggctgcacggggcagactggaatgacgcgctggatatggcatgggaaaatggagaaagcgtggcatttacaagtgcttatgcgggaaatttaaaagagattgcgcactgtatccggctgttagagcaggagaccggctgtaagcgttttgagattgcagaagagatgggaatgctgtttgcaggtggcagggagctgtatgagaatgtggaaaagaaacgagggatactggacgcctatctggagaaatgtgcacataatctcagtggtcagaccatgatcgtaaaagcagagcagatttgcagcaatctggaggaaaaagcagactggctgatggagcatataagggtgcaggagtggattgctgaggatgaggcacacggatggtttaatggctattatgacgatcataagaatccggtggagggctgtaaagacggaaaggtacggatgatgctgacgagtcaggtttttgcgattatgagcggcacggcaacaccggatcagatccgcaaaatctgccagagtgccgataaatatctgtatgatgagaaagcgggcggctaccgtctgaatacggattttggtgaagaaaaaatggatctgggaagaatgtttggatttgcttacggggagaaggaaaacggagcagtattttcccatatggctgtcatgtacgccaatgcactgtaccggagaggatttgcgcgggagggaaataaagccctgcaggctcttcttaacgcggcaatgaattttgacaacagcaggatgtatccgggactgccggaatattatgatctgtcaggaagaggcatgtatgcatacctgacgggtgcggcaagctggtatctccttacgatggttacggaagtattcggcgtaaagggggtcatgggagatctggtaattgcgccggcattcatgccggaacagtttgatgcgcagggaaatgcagaagtaaagctgatttttgcgggaaagaaattcgacatccggttctcaaatccggaaaagtgcgagtgtaaaaaagagtggataaaaagtgtcctctgcgatgaaaagcaactggaaccggaagcgggggcagcatatgccgtgcggatcaaaaaggagtggatcaaacagctgaatgcagaaaaagagcatgtcataaaaatcctgtttggaagataggaagcagatagtggtcttcacaggaggcatacacggttcttcgggggtaaacaatattgcaggaagcacagcatgccagattcctggagaaaagcagctggagcattcgtcgggaaaaaatgcgcgtatttcttccagccagagctttgcagctgattccgtgtctcttccacgtttggacacactggcgggcacatgtccgacacaccggagacaatgggcggactttctggcagcactaactgtgctccctcatagacaatattaaaccgcgcgaaccgaaactcgctgctatcagctattgaaatcagggcagatagcagctcagacatcggcttcgcgcggttatgtttttttcgggagcacaggtaagtgctgcacaaaagtcctacaaattgtctcgcggagtgcggacatgccccgccggagtgctccaaacttggaaagacacggatcatcgcagctgcaaatcacggctggttagaaatgccgtattttttgtaccgaatgctccggctgtctttctccgggaatcgcaggacatatactctctgcaatattgcttaccgccaaaggggaaccgtgcctgtctcctccggcggcttcttcgtggggagttaccacatggatttgtaatatttattgcggtattttttgggagtcataccggtaaagttctcgaacgtctggataaagtggctctgcgaagaaaaggaaaggtaattggcaatgtctatgatggacttgtcagagtagcgcaggagatgcgttgccttttctatttttttctcgcggatatagtcactgatggaaatgccgaggttctgcttgaatacccgggagagatagctctcggataatccggtatattctgccagcatggcgacggtaatgcgttctttgatatgactgtaaatataatccacacactgtacgaccggcttggataagatggaactttttttctgaagaaccatcttgccggtaaagtctttagccatttcatggtgaagatccgcaatctgccggacggttgtgcaggtgtccattttcagaatgtaaaagtcgctcagacgataggcctgttccggctccaaaccgccgtcaatgcagtagcgtgtaagcatggcggcagtgactacaaaatgatattttatgttggtaagcgtattgcgcgagagcacaccggttccctccagatggataaatgcatcctctttgcagttggcgacaacagtttccatatcgcctgttttgactgccgtataaaaggaatattccacggttggcggccggtgaagggtctcaagttcactgctttttaattcggtctcgtaccattcttctgaaaaggccattggctgtttcctccgtaaaataagaatatggttattatgacatgaatctgatatttttacaattgatttagtatattccagtcataaaattcagtacaattctatctgtaatcaagaagacggcagacattatagggaaagggtctgacgttgaaaaactaaaatacagggaggaattgaagtatgaaacagcgggttatcagcttaatgctgacagtggctatgggggctactttacttgcaggatgtggaagcagtgccacagacagtgccaatgccggagcagacagcggcaaggagagtgcagcggctgcaggcacagagtcggacgagaaagatttcagtggtgagggaaaggtaattaacatctattcctggaacgatgagttccgtacacgtcttgaggcagtatatccggaggtggaatctacttcctcagacggaacggtaacaacgctgaaggatggaacagagattcactgggtgatcaatccgaatcaggatggtgtttatcagcagaagctggatgaagcgcttatgaatcaggcagatgctgcggcagatgacaaggtagatatcttcctgtccgagacggattatgtatttaaatataccgataaggatgcggatgttgccatgcctctgacagatcttggaattgatcctgagacggatctggcggatcagtatgattttacgagaactacggcttctgattctgacggtgtgcagagaggatctacctggcagtgctgtccgggacttttagtataccgccgcgatattgcaaaggatgtatttggaacagatgatcctgaggcagtcggcgagaaggtgaaggactgggcaaccatcaaggacaccgcggcagagttaaaggcaaaaggatattatacctttgcatcctatgcggatacgttccgtctgtacggcaacagtattgatgaatcctgggttcagccgggagataccaccgtcaaagtagatcagaaaatcattaactgggtgaatgattctaaggaatggctggatgccggttatctggacagcaacatcaagggtcagtggaatgatgactggaataagtccatgggctcccagtccaaggtttttgcattcctgcttccggcatggggcattgactttgtgctgaatccgaactgggatggagagtccggcaactgggcagttacgaacccgccacaggaatataactggggtggttcctacatccatgcggcaacaggaacagataatgtaaaatatgcgaaggatattattcttgcaatgacaagtaatcaggacaacctgttaaagatttcacaggattactctgatttcacgaatacgaagtccggaatggcagaggcagcaaaggatgatgcagacttctcgtcagaattccttggcggacagaatccgtttgtctactttgcaccggtagctgagaatatcaagattgctccgttatctgcatacgatcagggatgcgtggaactgattcagaattcgttcagcgattatctgcagggaaatgtagattttgataaggcaaaggcaaactttgagacagcaatcaaagagcgttatccggatatcacagaagttcagtggccggaataagaccatgactgcggagcaattttgctccgcagaactattatggcagagagggcaaaggaatgaaaaaaaagaaaaaaagtatcagctatggaaaatggggacagatatttattcttccgttttttattatctattttattttttcgctgattccgttggcagataccgtcagatacagtttttatgaatattaccgttccggaattaaggaggtcggacctaatttcgttggaatggcaaattatatcagtctgctgaaatccgatatgctggcatatggaaaaaacacgctgattctgtggctgatcggttttatcccgcagattgtgatcgcacttgttcttgcgagctggtttacggatgccagattaaagatacatcacaaacaattttttaaggttgtcatttatctgcccaatctgatcatggcatctgcatttgcacttttattttttacactgttttccacgagtggaccggtcaattccattctgatgtctctgggatggatcaatagcccgattgattttatgggatctgtttttggcacgcgttccttgattggacttatgaatttcctgatgtggtttggcaatacgacgattatgctgatggcagcaatcatgggaatcagtgtggaggtatttgaggcctgcgagatcgatgggtgcaacagtctgcagagatttttctatattacgcttccgatgatccggccgattcttgcatatacactgattacctcgattatcggcggattgcagatgtttgatgtgccacagatcttaacgaacggtcagggaaatccggaccggacatccatgacactgatcatgttcttaaataatcatttaaagagcaagaactatggtatggcaggagcgttatctgtttatctgttcatcatcagtgcgatcttatgttttatcgtgtataagatgacaaatgataatgatccggacggatcgaaggcagcggcgaaaaaagctgccagagaagaaagaagaaggaggagataaaacatgaaatcaaaatcaggaaacagtttgcggagtgttctggcgcatattgtgttgattgtactgtcatttatgtgtctgttcttcttctatattctgattatcaatgcaacccgttctcatgcggagctgcaaaaggggttttcggcattgccgggcacccatctgctggaaaatttaaagaatgtggcaaatgacggaagcttcccgatgttccgcggaattataaacagtatctgtatctcgactgcctgtgcgggtttgtgtacttacttttccgcgttgacggcatatggtctgtatgcttatgaatttaagaccagaaagatagcatttacctttatcatggcaattttggtcatgccgactcaggtaacggcaatgggatttttgcggctgatcacgaaaatggggttgtatgatacctggtatccgctcattattccaagcatcgcgtcgcctgcggtattctattttatgtacagctacctgcagtcatcactgcccctgtccttagtggaggcggcaagaatcgacggctcaggcgaattcaggacgtttaactgtattgtgctgccgattatgaagccggcgctcgcggtacaggcgattttcacttttgtcggttcctggaataactactttgttccggcactgattcttcagaccaagagcaaaatgacagtgccgatcttaattgcgacattgcgtggagcagactatatgaactttgacatgggaaaagtttacatgatgattacggtggcgattgtgccgatcattgtggtatatcttttattatcaaaatatattatcgccggtgtgacacttggtggagtgaaagagtaaacacgatctggacagagaatcatatggaagaaaattctgtatggttctttctgtcattttgaagggaaaagcagagaatatggaaaaaagagaatggagatatagtggaaccatagaggaaagaacgtccatccgggagcaggtgcatgatgttctggcaagaaaagtggcagaagaggcaatggttttattaaaaaatgaatcgcttctgccgctgcctttggatgttcctatggcgctgtttggaagcggggcaaaaaagacggtaaaaggtggaatcggctcaggggatgtcaacaaccggaagacaatttctgtctatcagggactgctggaagcgggcgcaatgatcacaagtgaagcgtggctgtgcgactatgaaaagcggtatgagcaggcgagagaggaatggaaaaaactggttctcgaagaaacaaaacgggttgagaatccgtttgacgcatattccaatcatccgttctgtttcccggagggaagagcggttacagaacaggacattgccggggcaggggtggcagtttatgtgctaagccgcatttcaggtgagggaagtgaccgcagaaaagagcgcggcgactatgaattaagccgcagggaacaggaagacctgttatttttgaatgagaaaaagattccggtagtgctcctgctgaacaccggtggtccggtagaactgacagacattttagagcaggcaaaaaatatacgggctgtgttaaatatttcccagccgggacaggcaggtggttatgcggtggcggacatcctgtttggaaaggcggttccaagcggaaaacttacggcgacatgggcgagacattacggggattatccgtcagcggacacttatggatacaggaacggagatctggaaaaggaagaataccgggagggaaatttcgttggataccgtcattttgaccgggaaaatctgccggtattatttccgttcgggtacggactttcctacacatcattccacatccgccagcggtctgtacgcgaggaaacgaattccctggaacttgcagtgtctgtgcagaatacgggtggaacctatgccgggaaggagacagtgcaggtctatgcgacattcccgcagaccggaatggaaaaagaaaaaaagcggctggtgggattcgccaaaacaaaatgtctgctgccgggggaaatacagcagctggagattaaaataccaaaaaacatgcttgcaagtttttcggaagaacagagtgcctggtatctggaagccggaacgtatggcatatggatcggtgccgattcacaaaagttagaacaggcatgggaatttgatgtgtacgaacggacgatcacagagcacacatgccggctggaggcagcagagagcgatgcaggaaagctttctgccgctgaagagcaaaaagtgcatctgaccggaaaaataccggcagaggaactgattccgctcttatatggccatgtggaacaaaacagcagtacactcggcgcggcgggaatccgtgtcccgggatcggcgggagagacaacacatgcgctggaacagccctatggaataagggcgttaatcatggcggacggaccggcaggaatccggctgcatcagtcgtatgaggtagacgcagattcggggaaagtctatggaaaaagtgtactgggagcactggaaaatggctatctggagccgatgcaaaagcatgagaatgccaagacctactatcagttctgtacggcgtttccggtcggaacggcaatggcgcagacctggaatgaggaactgctgcagtctttcggaagagcggtatcacatgaaatgaaagaattccatattgatctgtggctggcaccgggaatgaatatccagagaaatccgctgtgcgggcggaattttgaatactattcggaagatccatttctctcaggcaagatggctgctgcggttgtccgaggtgtacaggaggagggaacctgtggagctgtgatcaagcattttgcatgcaacaatcaggaagacaaccgtatgggggtcgatgtgcatatttcagagagagccctaagggagatctatcttaggggatttgagattgcagtcaaagaaagcgcaccggttgcaatcatgacatcctacaaccgggtcaatggagttcacgcggcaaacagcagagcgctatgcactgtaattgccagagaagagtggggatttgacggtgtactcatgtcggactggagtacaacagcgccggaagacggcagtattccatggaagtgtatcgaagccggaaatgatctgattatgccgggaagtgagaaagatgatgcggatatccggcaggcgtatgcagacggaaggctgtcggaaaaggaaatccgtctctgtgcgggaagaattatttcactgataaataaattagataaaaagacaaaaaagtgacattggaaagacaagaaacaggtagtctccatgactgtctcctgttatactctgctcataaggtacacttatggaaaggagcacaaacaggggggaatcatggagatttattcaattaaagacgaaaagttccgcaggtatgggaaagtctggagcggctttgactgcacgagactgatccgcgagatggaacacacgccgctgccggaggatgtcatttatgtgccatccatggaggaactggaggtgctgccggaggcgggagagtttgccagacggatctacggcggacttccgattcagatcggttattgtaacggcagcaatcacagattaaatgcgttggagtatcaccgcaattcggagatcaatattgcggtgaccaatatggtgctgctgttaggatggctgccggatgtgaccgatgcgtttacttatgacacatccagggtggaagcattttttgtcccggcgggaacggttgttgagatgtatggaacgacacttcactatgcgccgtgcaatgacggggaggaaggatttaaatgtattgtgattcttccgaaaggaacgaatacggagattgattttgccttgcccaaaagcggagaggatgcgcttatgactgcgaagaacaagtggctgatcgcacatgaggaagcaggaatccgtggtgcttttaacggacttttgggggtcaatattgaggtgtaagaaagatacaggaaaaacggaacaggaaggtttctatttttgaaacggaaaggagatttttatgaacaaagaaaatatgccggagattaagatcggagttgtggcagtcagcagagactgcttcccggagagcctgtcggtgaaccggagaaaggcgttaatggacgcttacacgaaaaagtacggaaaggatcacatctatgaatgtccgatctgtatcgtggagagtgaaatacatatggtgcaggcactggaggatgtgaaggcggccgggtgtgatgcacttgtcgtatacctcggcaattttggaccggagatcgccgagacactgctggcaaagcattttgacggaccgaaaatgtttattgctgcggcggaagaatccggggacagtctgctggatggcagaggggatgcttactgtggaatgttaaatgccagctataacttaaagcttcgcaatatcagggcatacattccggagtatccggttggaacggcagaggaatgtgcggacatgattcatgaatttgagccgatcgcccgcgcggtagttgcgctttccaatttaaagatcataagcttcggaccaagaccgttaaatttccttgcctgcaacgcaccgataaagcagctttacaatctgggtgtggagattgaggaaaattcagagcttgatttattcgaggcgttccataaacatgacggggatgagagaatcccggcggttgtggcagagatggaggcggagcttggagccgggaataaaaagccggaagtgcttgcaaagctggcgcagtatgaactgaccttaaaagactgggtgcgcgatcacaagggctaccgcaagtatgtggcgattgcgggcaagtgctggccggcattccagacacagttcggttttgtcccgtgttacgtcaacagccgtctgaccggacagggaattccggtgtcctgcgaggtggatatttacggctgtttaagcgagttcatcggcaccgtggtgagcgaagatgccgtgacactgcttgacatcaataactcggtgccggcagatatgtatgaggaagagatcgagggaaaatatccatatacgttaaaggacacctttatgggattccactgtggaaataccacttccggaaagcttgcgttctgtgagatgcgcaatcagaagatcatggcgagaagccttccggtcgaggtgacaaacggaacccttgagggggacatcatgccgggggacattacgtttttccgtctgcagagcaccgcagactgcgagctccgcgcttatatcgcacatggggaggtgcttccggtggcgacaagatcttttggatcgatcggtgttttcgccatccctgagatgggaagattttaccgccatgtgctgattgagaagaatttcccgcaccacggcgcggtggcattcggacattacggcaaggcgctgtacgaagtatttaagtatatcggtgtgccggtggaggagatcggttataaccagccggcaggcgtgcgctatccgacggaaaatccgtttgcatagaaaagtcttgcagtgcatagcgaagtcttgcaatgataagaaaaggggagagtatgttatatataggaattgatcttggcacatcagcagtaaaattgctgctgatggatgtcgatggtaaaataaaaaaaattgcatcgcgcacctacgatctttcatttccacatccgggctggtcggaacagaatccggcagactggtatgaacagtcgatcgacggcttaaaagaacttctggcggaatgtgataaaagccgggtggcggggatcagcttcggggggcagatgcatggtctggtgacattggatgagcgggatgaagtgattcgtccggcgatcctctggaacgacggtcgcacggcagaagagaccgattacttaaatcaggtgatcggaaaggaaacactgtcgggatataccgcgaatattgccttcgccggatttacggcgccaaagattctctggatgcaaaagcatgagccagatctgtggaaacgggtgaaaaagatcatgctgccgaaagattatctcgcataccgcctgtccggaacgttctgcaccgattattcggacgcctccggtatgctgctccttgatgtggaacaccgggcatggtcggagcagatgcttgagatctgccatgtggaaagagagcagcttccgaagctttatgagagctatgaggtggtgggaaccttaaagccagagatcgcggaagaactgggactttctcccgaggtaaagatcattgcgggagcaggcgataatgcggcggcagccgtcggcaccgggacggtcggtgaggggagatgcaacctgtcgcttggaacgagcggcacgctctttatctccagtgaaaagtttggtgtggacgcacacaatgccctgcattcctttgatcacgcggatggcggttatcatctgatggggtgtatgctctcggcggcatcctgcaacaagtggtggatggatgagattttaaagacgacggagtatgcgcgggagcaggaaaagattaaaaatctgggagaaaaccgggtatttttcctgccttatctgatgggggagcgctctccgcacaacgacccggatgcgagagccatgtttcttggaatgtcgatggacaccacacgggaagatatgacgcaggcggtgttagaaggcgtagcgttcggcttcagggattccctcgaggtggcgcgcagcctgggcatccggatcgaacgctccaagatctgcggcggcggtgcaaagagcccgctgtggaagaagatccttgcggctgttttaaaccttaagcttgatctcatagagagcgaggagggaccgggatatggcggagcgatccttgcggcagtgggctgcggggaatatgagagtgtacaggcggcatgtgagaagctggtgcatgttgttgacaccgttgagccggatccggtgctggtggagaagtatgaggcgcgctatcaggaattccggaagctgtatccggctgtgaaagagtttttctgatggtgcagatggcgaagcatccgttggcggatcatggaatggaaaagttttaggcggatgatggagcggtttttggagactgtagacagatacgggagagttatggaggcagaagcagaacagaagtatttaaacttgttggagcagcagattgcagaggggagttatcgaccggactgggcgtcgcttgcgggggcgcctgtgccggactggtttttgcgggaaaagcttggaatctttttacactggggactttacagtgtgcccgcctgcaccaatgaatggtattccagaaatatgtacatcaaaggaatgccggcgtatgaacatcacaggaaaacgtatggagaacagcgggagtttggttataaagactttatcccgctgttttgcgcggaaagatttgatcctgcgtcatggatgcagctttttaaggaggcgggtgccggctatgtgttcccggtggcggagcaccatgacgggttccagatgtatgagagcgaactttcgcattggaacgcgaaggagatgggaccaaagagagatcttctcggggaattaaagtcggcagcagagtcttgcgggctgcagttctgcacttcaagccacagggcggaacactggtttttcatgggacatggaagggaatttgacagcgatgtgagggagccgatgaaaaaaggggatttttactggccggcaatgccggaaccggacccgcaggatcttttcagcaaacccttcccgagcgaggaatttctggacgactggctggcgcgcacggtggagctgattgtgaagtatcgaccgaagcttttgtatttcgactggtggattcagcacgaggcgtttcatccttacttgaaaaagctggcagcgttctattataattgtggtaaaagctggggagaggatgtcatgatctgctacaagcatgatgccatgatgttcggaagcgggatcgtggaggtggaacgcggcggatttgcggaggcaaagccgtatgcgtggcagacggacacggcggtggcgcgcaattcctggtgttatacagacagcctcgattataagagcagcagggaaatcttatgtaccctcgtggatgtggtaagcaagaacggcaatctgcttttgaatatcggacccaaagcggatggtacaattcccgagggcgaccggcagatcctttcggatatggcgtcctggatgaaggtaaacggcgaagcggtccgtggggcaaaggtgtggagaaaaagcatggaaggaccgacgcgggcggtggacggacagtttgcggacgcggcagagatcatgtatacaccggaagactatcgctttaccgtgaacggcggctgtatctatgcgatctgcatgcgctgtccgagagacggcagatttctgatccgttcgtttgcaaagagtaccaatcagaatctaccggagtttcacggaattctgcgtgcggttacgctgctcggttatgtggggcaggctgcgtggcacgtagaccgggaagggcttcacatagcggcgccggggattgagagtgattttccggtggtattccggttggaagtggattagcagacaaaaaggagagggcaatgtacgagaaaatatggaatcagaataaaattgcgtttggcggcgactacaatccggagcagtgggatgaggcaacctgggaggaagatatgcacctgtttgggctggcgcacattgatacggtgacactcaatgtgttttcctgggcaatgctgcagccggacgagagcacctatgattttacaaaactggaccgcattatggaactggtgaagaaaaacgggctgaaggttgtgcttgcaacatcgaccggcgcgcatccggcttggatggcacaccggtacccggaaatcctgcgcacggagttcaacggaatgaagcgcaagttcggtggcagacacaattcctgcccgaacagtcccgtctaccgcatgtattcggcacggctggcggagaagctggcggaacattacaaagactatgacaatattgtggcatggcatatctccaatgaatacggcggagagtgttactgcgaaaattgcgagaaggcatttcgcgtgtggctgaaaaagaagtaccacacgattgaggaggtgaaccgcgtctgggatacggcattctggggacatacgttctatgactgggaagaaattgtcctgccgaatctgctgagcgaacatttcgcctatgagcgcacgatgtttcagggaatctccttagattaccggagatttaattcggacagtattttagagtgttatcgcctggaatatgaggcggtgaagcggcatacgccggacatcccggtcacaaccaacctgatgggattctataagccgctggattatcagaagtgggcaaaatacatggatatggtatcctgggacaattacccttccaaccaggacacaccggcgcagattgccctgtcccatgaactgatgcgcggtatcggcggcggaaagccgttccttctgatggagcagacgccgagtgtgacgaactggctgccgtacaatgccttaaaacgtccgggggtcatgcgcctttggagctatcaggcggtggcgcatggggcggattcggtgatgtttttccagatgcgccggagtatcggtgcctgtgagaaatatcacggagcgatcattgaccatgtgggaaatgaaaataccagagtgttccgggaagcagcagccctcggcgccgaactaaaggcgctgggagatgagactctgggcgcgcgggcaaggaaggagacagcgattctgtttgactgggataactggtgggcgatcgagtattccgcaggaccgagcgtgctgttaaagtaccgcgatgagatccagaactattacacggcgctctacgagcagaatatggcgaccgatatcatcggggtggaggatgatttctcggactatcgcgtgatcatcgccccggtcttatatatggtaaagccgggtgtggatgagaagatcaaagcgtttgtgcaggcgggcggtatttttgtaaccacttttttcagcggctatgtggatgagcatgatctggtggtgaccggagggtatccggggaaactgcgtgatctcttaggcatctgggtggaggagagcgatgccctgccggagggagagacgaatcattttacatggaagggcgcgcggcatgaggcggttctgctgtgtgatctgctgcatccggagggagccgaggtgcttgcaacctacgaggaggatttttatgcgggaatgccggtgctcacgaaaaaacgttacggagcgggagcggcatactatgtggcggtgcggtcggacgcgctattttatgaagcgctgatacgcgagatctgcgaaaaagccgggatcacgccggtggcacagactcccgggggcgtggaagcggtcttacgtgtgggacgcgatgaaaaaaaggagttcctttttctgttaaatcatgagaaaatagagcagagtgtgccggtggagcaggacgcaacggatcttgtgaccggtatggagtggaaaaaggggagcaagctgacactgccggcgtacggcgtggcaatactgaaacgaagcgtatgaagacaaagataaaacaactgataaaccggatactgggaatgaagctcgtctaccgcatgattttaatctatgtgataggcgggcttttgccgctttccgccattatcggctatctgattcacggaaccaatcaggtgctggtgagtcaggcggagaatgcggagattgcggaactgcagacgatcggaagacagatcctggaattggagaatacgatgaccacggtctcttcgtacttttatttcgatgacaagctcgaggagattgcggcaaaacagtatacggattatcaggagatgatcaatgactacagaggctataccgcttttaaggaatatcagagttactacaacacgatgatctccagaatcagtattttcctgcagaatcatacgctgcgcggcaattcggactttgtggttgtggatgcggacacggaggtcgaggcctggtatcagagagtgagtacagagggaagcggctgcgtgtggacgtgtctgccgatcagcctgcccaaatatgaccatgcacctgccattgcccgtatgattaagaccaaaaagagcgaaaatgtcggggtgcttgtgatctatctgcgcccgcagcagtttgagaaaatgatctgggagcgggagggaagtacctatattgtgctggatggcgagaccttgcttacgagccgtcatgagacgattccttttgaagaattaaagcagtatctgccggatgccgccgaggagaagtatcagacgcgcatcaaggcaggggaggaagaatatgtcctcacctgtgagaatgtaaagcaggaggataccagcgattattttcaggtggtcagtgtgcgtgcggtggatgagatcttaagggaagcgtatgcacagcagcgaaagagtatctggctgttccttgggagcgttgtgcttgccgggacgttgatttttgcattttcctggtcgtttgcaaggcgtgtcggcagattccgggaacagatgcagaaagcgtctgagggaaattttgaacttgaggaaaagcttggaggaaatgatgagatcagtcagctttatgattacttaagcgtcatgatctggagaattcagagacttctggcgcaggtgtatcaggagaagattcacgcggagcggcttaagaccagccagaaggatgcggagtttaagatgctcaccagccagatcaacccgcatttcctgtataatacactggaaaccatccgcatgaaggcgcgcatcaacaagcagtatgagatcgaggaactggtgaagatgctcggaaagatcctgcgcagcagcatccaggcaggttcaaaggatatgacgatccgtgaggaggtggaactggcagagtattatctgaagattcaacagtaccgcttcggcgaacggattcagtatcagatctatgtggaggaagggatcgagaggcagaagatccttccgcttctgatccagccgctggtggaaaattgtatcatacacggacttgagggaagagaggacgtcggtcacatcgatatctgtgtcaaacgcagcggacagaatgtggtcatcacggttaccgatgacggcgccggcatctgcggggaaaagattgcggagatccgcagagaacttgcaggcaaccgcacaaagggagaacatatcggcatctgcaatgtcaatcagagagtgcggctgcgctacggggaggagtacggcgtgacagtggaaagcatctgcggcgaatatacccgggtggagataacgcttcccggtgactgggaagaaacagaatcataaaatacaaaagcctgttctgagggagaaaaaacgatccgcagaacaggtcttttaatacatgcaaaagccgttataaaagatgcaaattttatggtaaaaataatgaaaatagtaaggtattaaaattttgctcccaatcctataatgaggatgaaaagaggaggaaaacgatatgaagacagaaaagaaacagaaagccaaagtggtcaaacagaaattcagctggcagcttatgtggaagcagcggtatctgctgttgatgtcggtaccttttgtcatctggctcatcatctttaaatatgttccgctgtgggggtggacaatggcgtttcaggaggtaaagccaaacagttttgcacttccggtatggcagagaaaatttgtgggggttgacaattttaagaaggcattcacagaccggctgttcggccagaccatgatcaatacgattggtctgagtgtgctggggattgcacttggaaccgtcatggcgatcctgtttgcactcatgctcaatgagatctgcttcaatcgttttaagaaggtcacacagaccatttcctatttgccgcacttcgtatcctgggttgtcattgcaagtattgcaaagatggtattaaatgacggcggcatgttagacacactggccggaaaaaatctaaagcttatgtctacgaactcggttctgttctggatcgtcgtctgcttcatcaatgtctggaaggaagtcggctgggatgcgatcgtatatctctccgcgatggcaggaatcgaccaggggctttatgaggcggcaaaggtggacggtgcgaaccgtctgcagagaatctggcacattacgctgccggggatcaagccgacggtggtagtgctcctcattatgggaatcggcggtgctttgaatgtcggtatggagcgtcagatgcttctctccaacggtatcgtgcaggatcatgcaatggtgctttcctggtttgcttatatccgcggtatcggtaacaacaactacggtctcggaactgcgatcggcatgttccagtcgttagtcggaatagcacttttgtttatcgccaacaagatagccggatggctcggcgagagcagattgatctaaggaggggaagcacatggcacgcagtcagacaaaaattaaaagtaaagataatattttggattacatattactggtgatcttcatcggcgttattattgtgactttatatccgtttttaaatgtacttgcaatctcattcaacgatccgatcgataccatgcgcaatatcaattttatcattccacgaaagttcacctggagcaattacacttatgtgtttcaggaaaacaatctgtttgagccgtttgccatgtcgattgtgcgaacgctgatcggtacgctgaccggcgtggctgtgacagcgatggtagcgtatgttttaagcagaagggatttctattttaacaagctgttcacggtgttgtttgtgattaccatgtatgtcagcggcggactggtaccggaatatcttctgattacaagaacgttaaaattaggaaatcattttctggtatatattcttccgggactgatctgggtgtacaatatcattctgatccgttcatttatagacggactgccgattgccctgcaggaggcagccagaattgacggggcaaacgatttcattattttcgcaaagatcgttctgccgctatgtaagccggtacttgcgacggtggcactttttgtggcagtcggacagtggaattcctttatggatacctatctgtatgcaagagatcttccgaccttacagtatgtattatatgagattatggagaaggcgacgatcaaggttgatccgcatgccgcagaacagttaaagagcgcggtatctccgatgtcgatccgaatggcaatcacgatcattgcaacggttccgatcctgattgtgtatccgttcctgcagcggtattttgtaggtggtatgacgatcggtgcagtcaaagactgattactgatagagcaagcaaagaagagaggagaagaaagattatgaggcaaaaaaggttatgtgcattgatgctggtggcatctatggcagcaggggttctgggcggctgtggaaatggagaagcagcagacacttcttccgtgagtgggggaacagagagtgcgggcagcggaacatccggtgatgtggtagaactgacgttctacaatgcggacggacaggaggatccatggaccgatccggtggcacaggcactgacggaggcaaccggtgtgaagttaaagaccgattatccggtgtcagccgatgatgagaaggtcgcactgatgatcgcggagcagaattacccggatatgatctatgccaagggggatgcaggagcactgatcgatgcaggagccttgattgatatgacggatctgattgaggagtatggtccgaatatcaagaagctttatggagatgagtttgacaaattaaaatattctgaggatgatccttcgatctatcagctttcggcttatgcagcgggaggagagacatttaagacatccggtacggcacagcttcagtgggatgttttaaaggagaatgactacgaggtaccgaggacgttagatgagtttgagacgatgttaaaggattatattgcggcacatccgaccacggacgacggtctggatacgatcggttttacgctgtcgacttcggactggcactggatgatcacgcttggcaatccggcagggtatatcgcggacggagcaccggacaacggacagtggctcgtggacgagaacaataatgcgatgtacaaattccgctctgacaaggagagagagtatttccgctggatgaataaaatgtacaacgagggaattcttgatccggaattcgcaacccagacacacgaggactacatcgcaaagatcgcatccggacgcgtgctggcgctgtttgatacagactgggattacggcgatggcgagaaggttttgaaagcggacggaaagtacggtaagacgtatgcaccgcttccccttgccatggatgcggataccaagtgcccgtctttgatgtatcagggacttacgactggctatggcgttggaatcactacttcctgtaaggacccggtggcggcaatcaaatatctggattatatctgctccgatgaaggacaggtgcttgtacagtggggaattgaaggtgtgaactacttcatggatgatgaaggacaccgttaccgcacggaagacgaagtaaagtatgcaacggaggacaaggattatcagaagaagaccggtgtcggtttccacaattatccgttcccgtactatggaaacggtgttgaagacccgaccggaagcacctacacaaccacgaacaaagagagtgtcatggcggattatgatgaggagcagaaggcggcatgtgaggcatggaatgtggagcttctgaccgatattttcccgcaggcggatgaatttaccacaccggactactctccgatctgggcttacgcaaagccgacggagtttgacgagattgcaaatcagctcgatgagatcgcatggtctgcgctcattagctgcgtgattggatcggaagaagaatttgacgcttcctatgacaagatgatctcggatttggagaatgcgggaatggcggatgccgagcagatgctgacggagattattcaggaaaaagtagctgctgtgcagtagaacagaggagtattttggcggaatggccacatagaacagagaattaggttttattgataaaaggagcaggaactcttgcggatgaaacggagagttcctgctccttttgttttactgccggtgtgtcctgcggaattcggcgggcgtcattccgacctgacgtttgaatttgatgtgaaaataatcgacattgcggtagccgactttttcagcaatctcgtacaccttcatatcattgccaaggagcagttccttggagtgttcgatacgcacatggtcgagataggagttgaaattttccccgacctttttgctgaaaatcttgccgagataagaactgttgtagccaaaaagcggcgcgattgcttccagtgtgagattgcgtgcgtaattgtgctcgatgtaatagagaatgtcgtcaatcacgccctccttcgacgtgcggccgatggaggataagatcagttcaaactgttctgtcagaaagcggatgatttcatacagataatatttttcggagatgatgcgtatgatttctccgtttcccggaaaaggaatatcgacgctggtgtaagagcggccgatgcgctccttgatctgaagatacagatctgcaaaaaacagcttgatggtatcaatggaatcggacgattgatacagctttgtctgcaattcgcccagaatctctgcagtgcggcttctactgaatgaggagagcccgtcaaaaaggcggtccgcatattcatccagaaaggcaccggtaatgagcggaagaccgctgcccagcgtcgggagattctcatagcctaaggtatgctgatcttcctcgcagaaaaagcgctggtcgatcagccgggaagcgtctgtataggagagcgcgatctcttccagatgtgatacagggcgaccgtaagcgagaaacagactgtccagaggggaatccttttgcggctgatactgccgttgaaagcgttccaaaaagctgccgaatttttcggtggcaaagctgcccttaagcaggatgatctcgcggctgtcatccgtgatatgatcaaaggaattgtgatcctggttggtcacgcgcaacaggtcggaaaagcggtaggacgcgtcctccgtgcggtggctgtatttttcgtagatgattacctgatatacatctgcattcagatgcagttccgcacgatccagacggtcataggcggcagtgccggcaagcagatcccggatgatggaatcgtatgctttctgccggtaatgcgcagaagaatcccgggcgctggcatcggaatccagctgattccgtatctgcgtgacgatctcgagaagctcatcttcgtcgatgggcttggtgagataggagagtacgccgtagcgtatggcggttctggcgtaattgaaatccgagtaaccgcttaagataacaacttttccgtcatagccgtgttccctggcaatgcggacaacatccagtccggacatacccggcatgcggatatcgagcagaaccagatccggcgtttcagacaaaagaaattgcagggcggcatcgccgtttgccgcttctcctgcaatggtaaatcccagtgtttcccaatcaagcagacagcggagcccctcgcgtatgatggcctcgtcatctgcaatgaacaacttatacatagtgcatccttcctgattttactgctggaaaataatcttctaaaattatagcgtttggggtggtgttttgtcaaatttgtaccgtgttttatgtgcaatttgtatggtatatttttccgtttgggtacggtaagatgaggatgctgggaaataaaaaatacaatacgaggagtaaggaggagaacgatgaaattcagtaacggatgctggttacagaaggaagattgcgcctgcttttcaccggcgcagatttattttacgaagatagagaaagaccgggtcacgctatgcgcaccgacgaataagattaaccacagaggagatacgttaggcggggtgaacctgacgattcagatcagcgcgccgtatccggaagtgctccgtatccagacgtatcaccatatgggacttaaggagcgcatgccacagtttgaacttgcggcgccacagaacggaaatcttgtggcggaagaaacagaaaaacagatcattgtaaagagcggggaacttcgcatcgagattgagaaagagagtggagcctttgtattctggcgcggagcggagaagatcaccggaagcggatggagagatctcgcctacatgaaaacgaactggaaaggcagcgcatacgataagggaccggaggatgcctacatgagagagcagctttccatctcggtcggtgagctggtgtacggactaggcgaacgcttttcggcatttgtaaaaaacggtcagagcgtggacatctggaacgaggatggggggacttccacagaacagtcttacaagaacattccgttttacctttccaataaaggatatggtgtatttgtcaatcatccggaaaaggtttcctttgaggtggcaacggagatggtgaccaaggtggagttttccgtacctggggagaatctcgattattttctgattaacggtccgacgatgaaggaggtgctgatgcgctacacggatattaccggaaaaccggcgcttccggcaccgtggacgttcggtctgtggctgtctacttcctttacgacgaattatgatgagaagacggtgaacagttttgtggacggcatgatcgagcgtggaattccgctctcggttttccactttgactgcttctggatgaaggattttcactggtgcgactttacctgggatgagcgtgtgttcccggatccggagggaatgttaaagcgactgaaagaaaaagggttaaagatctgcgtctggatcaacagctatgtgggacaggagtccccgctgtttgaggagggcgtaaagggaggttattttctgaaacgtgccaacggtgatgtatggcagtgggatatgtggcagccgggacttgccatcgtggactttaccaatccggcggcgtgcgaatggtatggaaagaagctggaggcgcttttagatatgggagtcgattgctttaagacggattttggtgagcggattccgacagactgtgtgtattatgacggatctgatccagtgaagatgcacaattattatacatacatgtacaataagacggtgcatgatgtgattgcaaagaaaaagggcgagaaggaagcgattctttttgcgcgctccgcaacggcgggcggtcagaaattcccggtgcactggggcggtgactgctggtcggattatgagtcaatggaggagagtctgcggggcggtctgtcgctgacaagttccggttttggcttttggagtcatgacatcggaggatttgagagcacttctacgccggacgtctacaagagatggtgtgcgttcggactgctttcgacacattccagactgcacggttccacttcttaccgcgtgccctgggcttatgatgaagaatcggtggatgtggtacgttattttgcaaaattaaaggcgcgtctgatgccgtatctgtatcgcaatgccatcgagacggcaaagaccggtgtgccaatgatgcggagcatggtgcttgagtttacggaggaccggaactgcgcatatctggcaagccagtatatgctgggcgactccctgttggtagctccgatttttaatgaggacgggatcgcggagtattatcttcccgagggacgctggacatcactgcttagcggcgatgtgaaggaaggcggcagatggtataaagagaagcatggttatctgagcatcccgctctacgtcagagagggcagcatcgttgcgatgggcgcaagggatgacaatgcggtgtatgattatgcagatggaacgacatttcgggtctatgcgcttgccgatggatgtgaggcacagacgacggtgtatgatacggaaaaccgggaagcggtgaaggcagcggtcacacattgtggcagcgggtacgagattcaggtatccggaggcacggatgtgaaagtggcactcatgcatgtaggaacgccgaagacggtaagctgtgcctatgagatggaaggggatcatgtcgtgatcgcggttccaaaggaaggaaccgtaacggtcgaattttaaatgcagccggaggtggcaatgaaaacagagacatatgaagtacagatcgggaaattattagaacagctgacactggaagaaaagatcggaatgatccacggcgcggggctgttccgcaccgagggggtggagcggctttccataccgccgctctttttctcggacggtccgatgggcgtgcgtgcggaatttgcggacaatgagtggagaaatacaggcacgacagatgattttgtcagctatctcccgtgcaacagtgcggtggcatcgacctggaaccgcgagcttgcgggtgaggagggcagagtgttgggcgaggaggcaagaggaagaggcaaagacatgattcttgccccgggaatcaatatcaagcggagcccgttctgtggaagaaattttgaatatatgagtgaggacccgtatctgatttcggaactggtcgtgccgatggtgaagggaatccagcagtcggatgttgcggcgtgcgtaaagcattttgcagccaactcgcaggagacagagcgtctctgggtcgacacgaaagtgtcgaaacagaccttagaggaaatttattttccgggatttcgcgcagcggtgcaaaagggcggtgtccatgcggtgatgggagcatacaatctgttaaacggggaacactgctgtaccagcaaaaaactgttaaacggcacactgcggcgcgactggggatttgacggtgtggtcgtctcagactggggcggtgtccatgacaccagagaagcggcggaagctgcgcttgatgtggagatggaagtgacgtacgatttcgaccagcagtatcttgcagagccgcttttaaagatggtgcgttccggagagatctccgaggcgttcattgatgaaaaagtgcggaatattctgcggctgatgttccgcctgcatatgatcggagaaaagcgagagaccagaaagaccggaacctacaacagcagagagcatcaggagacggtattaaagatcgccagggaatcggtagttctgctaaaaaatgaagaggaatgtcttccactcgaggcaaagaaggtgaagcgggttgccgtgattggccagaatgcggcggcaattcattccaacggaggcggcagtgcggagattaaggcgctgtacgagatctcaccgctgctcggcattaaaaagctgcttggcgggaatgtgaaggtagagtatgcaccgggatactatattccgggcaaggaggcacagggcagtgtgaactggcaggcggacagcaccaaaaaggactggggcaaatcttccgaagaaacggaagcatctgatgagacgaaggagtgtaggaagcgcttccgtgaggaggcggtggcgctggcaaaggaatgtgacacggtgatttttgtgggaggtctgaaccatgattttgactccgagggctatgaccggacgacgctcatgcttccctatgagcaggatgcgctgatcggggaactccttgccgtcagaccggacaccgtgattgtgctctatgccggatcaccggtggcgatgccgtggaatgcacaggccaaggcggtactctggagttattatgccgggatggagggaggaacggcgattgcggagattttgtttggaaaagggaatccatccggcagacttgcagagtcgttcccgaaggatgcaaacgattgcccggcacatacgatcggaacatttgcaaagaaggacgtggtggaatacaaggaaggcgtgatggtgggatatcgctattacgacactgcggatacaccgttatactatggctttgggcatgggctttcctacagccgttttgtctataaatatatgacggttcgtccggtcacggcgtccgcagagaccggagggacgatggatgccccgcgttatgaacttgcagtgaccgtgaagaatgacagccttcgtaccggaaaagaagtggtgcaggtgtatgtggcgccgaaagagcggcaggacgaccgcccggcacatgaactgcgtgcgtttgaaaaggtggagctgatgccgggggaggaaaagacggtaaagcttcttctgacagcggaggcattttccgtgtatgacgagaagcagcatgcatttgcagagaaaacgggtagctacgagattgaagtcggaagctcgtcaagagatatccggctgcgccgggaacgggagcacttcttatcacacccgggcaggtgatcgtcacgacaccgggggctgataataaaaaggttctggcataagacaaaattacaggtaaagaggtgccatggaaaacggctttttgtgatcggaaaatatctgatcgcagagagccgttttactgttcacattgctatgaaatttcatggttacttccatgatacacagaaattaagtgcaggatattgcatcgggcgaagaaggcgcttataatgtgttctgataagagaacggcgcagggaggaagagaagatgatcatcagacatgcgacattggacgatctggaggagattacaaagctggaagcaaagtgctttcctgcggcggaagcggcggggagagcggcattttgcgatcggctggcaagttttcctgatcatttctggctgctctacgaggatgaaaaactggtatccatgattaacggcatggcaaccgacgaggagcatctgaccgacgcgatgtatgaacatgccgatatgcacagcaaggatggtgcgtggcagatgatctttggtgtggcgacggaccccgcagagcagggaaagggatatgcggcagcgctgatgcgcagggtaattgcggatacaaagtcacaggggaaaaagggactggtgctgacctgtaaggagagactgctttcgttttacaggcagttcggctaccggaatgagggcgtgtccggatcggaacacggaggcgctgtgtggtatgaaatgcgtctgactttttagaataaggagaaaaacatggaagaatatctgatcaaaaatacaacaagagaacagcgggagcagatcgtaaaagattccctgggatacagtgagttaggatgcgatgatgccatggacgggtatgatatgtatctgccttatattgagggaatcaaggaacttcgtgagatcacgatggaatatcaggcgcagtatgtgcgtgatatggagcgcgaggagcgcgggcgctgcaatctgtactagaaacggtgccatttttccttcaagaaacggtcaaaatataaccttgatatatcataagaacctgggagaacatgtccgaattgcggaggttttttcccaggttcttttttcaaaatcctttaaaatgtgaaaagagaaaaaaacttatacactaagtgtatatagtcagcagaaacatatacactaaataagcgaagaaagaagcaacaggaagaaaagaagcgaattattggaaaaaacagacaaaaagagagttgaaaaagaaagcattttgtatgaaaatgagtatagatgaaggatgcaaaatttatacactatgtgaaattgacagtcagaaagaaaaaacatatagtaagcgtatcgaagagatcagcgatttcttatgaggaaccatatgaagggaaacagagagcagatatacgaatttgtaaaactccacagctccgtgaatgccaatcacgggatctctactaatgagatcgcagaggcactcggaatgcagcgcaccaacgtcagcactgcactgggcgaactcctccgggaaggcagggtaaaaaagagcagcagccggccggtcttatattcgctgacggaagcgtttgcggatgaggagggagcgttccgggaactggtgggatatgacggcagtttaaaatacgccgttcagcttgccagggcggcacttttgtatccgcaccgcggactgaatgtccttctgatcggaagagagggaagcggcagaaaatacatggcggaagtgatgcacaaagctgccgtacagcagggactggttgcggaacaggcgccgtttgtaatgtgtgactgcatggatttcggagcggacgatgcggcaacgatcgcagaactgttcggagacggcgtgcagggaggaatgctcgcggaggcagccacgggaatcctgtttttacataaggtacagttcctgtcggtgaacgtcagacgcaagctgctccgctgttttgtggaggcggaggatgcgcgggaactgccgatgatttttctctcctgcgacgacaaggcgctggatgtgatttccctgctggaagaccacgtgctggcggagataaggctcccgtcccttacggagcgtccgcttccagagcggcggaagctgctggaacattttctggtggcggaggcatgcagaacgaagcgcacgatcacgctggagtccgaggtgctcacctgcctgatgctgttcccttgtgaaaaggagatactgaccttaaagacacagatccggaaagcctgcatgaatgcttatctgcgggactacatggatcacgggggagaacttcacctctacatcagcgactttgatccgtctgtgcgcaagggattcttaaactaccgcgcggacaaggaggcggtggatgcgctggtaaaaccgcagatgcgctattcctatcaggaagagggcgtgacggtacttgcaccggaaatgccgcctgccgaggagacgcaggtcagcgagccacagatccggacggacgaaccgtcgccggtacttttatttgtcttttacggacagggagtcgcgcgggcactctcagataccatcgaggagcagcttcaccgcggaaacgtgtatgccgttgacattccttacgaacagaaggatgaacagacctacgagctgctgcggcaaaaactgctcgcgatcgatagaggggcgggagtccttgccgtgtatgaccagaaggtattgcagcagatgttgtatacaatttcctgcgagacaggaacacagctccgcgcggtagcgcttccggtcacaagattcggaatggagtggtcgaagggggcggcaatcgccgatggggtggaccgggtttaccggatggcggcagagtcgctcggggcgctgtggcattccccaaaaaaagtaatcgttacgctctgcaccacaagtgagggtgttgcgctgcagatgaagcagtatctcatccagcataaagcctgcacggacgcggaggtgattgccttatccttatcggaccggaaactgctgcgggaaaaactgctggaacttatgcagggagcagtgatcctgtgtattatcggaacgtatgatccggacattctggcgattccgtttctgtcagcggcggatgtgctggcggtgccggtggagcgtctaccggagcttttgcgcacacagcgcatggaaaaggcggaggttgattttgatgaaatgttccgctgtctgggcgatcatctggaatatgtggacatcggccgcttaaaggaggcgctcatggaactggcggagcagattgagggaaaatacccgatgtcgttagataccaagacagggcttgtgatgcacattgcctgcgcagtcaaccggattgcgggaaggggcgtttccatagagaatccgcaccgcgaggaaattgtgcagaactatcacggggtataccgggatctgcgaaaatatgtagcgccggtcgagcggaaattccacatgattttttccgacgacgagatggcgaacatcatttccatattgatgcagattcaggaataagacagaggcggtcacggaggtgggcagaatggatgaaatcgatgagacagaacggcaaagagaggcggcgatggagatcattgcgaaggcaggtgcggcgagaagctgcgcgtttgcagcgattcacagagcaaaggcatttgattttgcgggagccgcggagcagttggatgaggcggaacgctatgccacggaggcacataaggtgcacacggagcttctggtgagagaggcgggcggacagcagacagacggaggattgctggtggcgcacgcgcaggaccattttatgatggcgacgctggcgcaggagcttgcggaggagatcgtggatgtctaccgtgcgcttggggagacaaaaggaggcagtcaatgaagatattacttgtctgcagcgcgggaatgtcgaccgacattctgcgcggggaactgataaagtatgcaaaaaaggagcagcttccactggaagtgaaggctgtcggggtacatgcctacaaggaatactgcacggggtatgatgtgatccttctgggaccgcagatcacataccgcagggaaaagattgcggcggagtgcggaaatctgccggtgcttgccattgcgccgggggactatgccgcgggaaatgccgcacacatactggaacaggtagagaccacactgcgtggattagatgaataagcgaagaatgaaaggagaacgcatatgatttgcatcgagggaaaaaccgcttttagcggaatcgcaatcggcccgattcgggagtttgccaagaagagcagcgcggtgagaagatcacatgttgatgataccgcagctgagtgcacgcgttttgaggaggcgaaaaaagtcgccatggaggagctgggagcactctacgacaaagcggtaaaggaagtcggagaggacaatgcggcgatcttcgaggtacatcagatgatgctggacgatgaggattactgcgattccatccgcaacattatcacgacacaggaggtcaatgcagagtttgccgttgccacgacaggggacaacttcgcggcgatgttcgccggcatggatgatgagtacatgaaggcgcgttcggcggacgtcaaggatatttccgagcgtctgatcgccgttttgcatcacggcagcggcgcgcagtccatggagatggagcaggcgatcattctggcggatgatctggcaccgagcgagacgatccagcttgaccgttccaaggtgctggcatttgtgacgagagagggatcgacgaattcccacaccgcaatccttgcccgcacgatgaacattcctgcactggtatgtacgccggtagcggacggcatggacggcaaaatggcgattgtggacggcatggcaggcaaaatcattattgagccggaggagagcgttctggcggagtatcagaagaagaaagaagacgagagcaaacgcaaagaactgttatcggcattgaagggcaagccgaccgcaacaaaatccggcaaatccattaagctgtacgcgaatatcggcggcatcggcgacgttggcgcggcgttaatgaatgatgcggagggaatcggactgttccgcagtgaattcttatatctgcagaatgaccattatccgacggaggaggaacagttttccgcatacaagagcgtagcggagatgatgggcggcagaaaagttatcatccgtacgttggacatcggtgcggataagaagattgactactttaatctggacaaagaggataacccggcgctcggctaccgcgcagtgcgcatctgcctggaccgcccggagatttttaagacacagcttcgtgcgctgtaccgtgcgagcgcattcggcaacattgccattatggtgccgatgattatttccgtctgggaggtacagaaggtcaaggagatcatggcggagatccgtgcagaacttgatgcacagaagatcccttacggcaaggtggagttcggtattatgatcgagacaccggcggcagtcatcattgccgatgaactggcaaaggaagtggattttttcagtatcggaaccaacgatctgacacagtatacactggcaatcgacagacagaatgcaaagcttgatatgttctatgattcccaccatccggcagtgcttaagatgattcagatggtcatcgacagtgcgcataaggagggtatctgggcaggaatctgcggggaactcggcgcagatacaacattgacggaacagttcgttgcgatgggaatcgacgaattgtccgtatcacctgcgatggtacttccggtgcgtgagcgcgttgtcggaatggagtaaataaaagtcacataaattaagaaaagaaaggaaatggaaaacatgaaaacatttgattacaccgtaaaagacgaacttggaattcacgcaagacctgcaggtcttctggtaaaagaggcaaagaacttcaccagcaagatcaccatcaagaagggtgagaaggaagtggacgctaccagagtgatggcagtgatggcgcttggcgtaaagcagggcgagacagtgaccgtcaacgtggacggcgcggatgaggatgcggctgttgcagcaatgaaggcattctttgaaaaagaactgtaaaacctcaaagagagtaactccggcggattcgtaagagtctgccggagttttttatgggactgccgcaataagcatagaccccttttgggtgataagtaatattattagaaaaccacaccgtaggatttcggatgaaaatgcagatggaaattcggttcaaaaaatgtggcatttctaaccagccgtatgtttgcatctttgatgatccgtgtctttccaagtttggaacactccgcgggtcatgtccgcatcccggaagacaatttgtaggacttttgtgtgtgtcccttattggcacctctgaataaaacataaccgcgcgaagccgctgtctgagtcggcatctgccctattttcaatagcagatgccggcgagttcggttcgcgcggttttatattgtctgtgaagaggtgccattagggacaccagaaagtccgcccattgtctccggtgtgtcggacatgcacccgtcggattgtccaaacgtggaagagacacggaatccgatgcaaacattcagctggaagaaatgctcacatttttctcaaccgaatttccacttgcatttccacatgaaatccccaagtgtgtttttaataatattacttatcagagtaaagagcgatatgcttattgcggcagccccataaaatgctccgctgtacatgtgaagtgggatttggtagaataaaagatatgaaaatgatgcttgacaagaagaaaatagttaggataaactaattcggcggataaaaggagcggggagacaaatgaagctgtttcggggagcggtagatacgataaaaagagtgtaccggtatgagaagacaaccggcatggatgttggggcactgcagggggtcatgctgatctttgcggtggtgttgtttctgattgacattgagaatttccggctgggaaagtatgtcatcggaattgtgacactggtcgtgggaattgtgagcgtgacggcggtgtttgtaatccggcggttccagaaggtggttctcgtgtgtcggattgcggtctttttgttcctgctgctggcggctgccattctgtacgcgggtgcaaatgacggtttttccctgctgtggtatctgctgctgccggttatcacgctggttccgcttggaatgccatttggggcgccggtgtgcatcggatttggtctgatgattatgacttttttctggacgccgcttgcggatatattaaggtatgattatccgagggattatcgggtgttctatccgattttttactggggattctgcctgatggatgtggcgatggatattttttacaaaaattatcagatccggcagcgccagaatgaggaaaatctggagaatgaggtgcaggaggcggttgcgggcacgaagaatctgatgattcactcagtcacggcgatcagccagctgatcgatgccaaggaccgttacacgagagaacactcccagcgtgtggcggagtattccaggctgatcgcggattatatgcggggaggctgcgcatcaggggaggaactggaactgatctaccgcagcggtctgcttcatgacatcggcaagatcgctgtgccggacgccgttttaaataagccggaacggctgacggatgaagagtacgaggtgatgaaaaaacatacggtctggggcagagagatcttatccggtctggagtttttgccgcaggcggatctgggcgcgacataccatcacgagcggtacgacggaagcggctatccttatggcatgcacggggaggagcttccggagatggtccgcattatcagtgcggcggatgcgttagacgcgatgaattccaatcgctgttaccgaaagcactgtgacagggattacattatcggcgaattccgaaagggagccgggaaacagtttgacgccggagtggcgcaggcggttgttgcattgatcgaggaaggcaggattacggtataaaggatgaagaacgcagagacaaaagcaaagagaataagagagaacttctgggatacggtcaatgctccttatgaggacagggaattggcactctggatgaaaattgttttcggatttatctgggcaatcagtattttgaacggcatattttacggtgtcagggcatcctatctgattgcgttggggatcatggtggcgctgctttttggcaatattgcggtctgtcggaggcattaccgcagatggatcgatgtggtgacattcacgttgctcagcattccgattttttatgtgtattaccacgcgagcattgggtacttcagtgtattgttcccgatgctgttttcctgcggaattgtatttatcttaggaatccgcaacagttttgtcatcaatctgttctatcttgcggcgatgattttgtgcttccggttcgacctgaatgcttccgcggaagatatctacggggagaatgtggcactgcgttttccttatctgtatgtgtgctttgtgttcatggcatatctgttaatgtactgcatccagcattactgggtggagaagcgcagaagacaggaaaagctggagcagcgcgtacatgaggaaaagaaaaagcttcagggaatgtccatgcgtgtgatgaatgcgatgtgccgcgcgctgggcgcgaagattcccggtgaggaggaacactgcaggcaggtggcggaatacgcaaaagagattgcaaaaagactggatcttccggaggatatggtgtccggggcttatcaggcaggtcttctgcacgagattggaatgatcggcattccagacgaactgatccagagacggaacctgacggatgaggagtacggtgtgttccagacttatgtgaagatgggctatgatatgatcagcgaactgcaggtggcggatacaatcgcggaggccgtgtattatcatcgggagaactacgatggcagcggctatctggcgggaaagcgcggcagtgagataccggtgctcgcgcagatcctcgcggtggcggactatgcggaccgccatctgcgctggggcgagagtacggaaatggtgagaggcaagataaaggagcgggaaaatacaaggtttgaaccaaagtgcgccgggataatggaacagattttaaaggagagaagtgaggactagggaatggagaaaatgacggcgcaggagatagaacagaagcgtgcgggggagaaagagaccgtggattgcatgatcggcatctactgccgcggagtgcacgggacgaagcggggagaactctgcgaggcgtgctgccagctgcaggcgtacgccgatcttcgcacggaaaaatgcccgtttatggagacgaagacgttctgcagtgcctgtaaggtgcactgttattcgaaggagatgcaggagaaaatccgtgaagtgatgaagtatgcgggaccaaggatgttgtttgtgcatccgctgcttgccatccggcatgtgcatatcacacttcggaataagaaaaagcagaaagagatcagtacaagggaaaagggagagaaacatgtttcataaaagactgttaaaggaattttccgataaccggaaatacgtggcgggaatggttatcatgcagtgggcggcgcttcttgccaatgtggcgcttatgtatgtgctggcagcgtatgtcgggagaatatccggaattgtaaaaggggagagcctcacgacctccccgtccgacggagtgctgcttatcgtatttgaggcggcgctttttgtgcggatcgcggcgacgagtgcggcaaaccggatgtcctatcttgcgtccacgcaggtgaagcgcagactgcgcgaccggatctatgagaagatgatggagttcggggcggcttaccgggaggcggtggcgacctcggaggcggtgcagatcgcgacggagggagtggatcagcttgagatctacttcggaaaatatgtgccgcagtttttttacagcatgctggcgccgctgaccttgtttgtgattgttggcaccatgagtatcaaggtggcggcagtgctgctgctctgcgtaccgctcattccggtgtcgattgtggcggtacagaagtttgccaagaagctgctggcaaaatactggggaacctacacggaactcggcgattcctttctggaaaatctgcagggacttgtcacgttaaagatttatcaggcggacgggcgctatgcgaagaagatggatgaggaggcggaaaagttccgcaaagtgaccatgcgtgtactcatcatgcagttgaattcgatcagcgtgatggatctggttgcctacggcggagcggcgctcggcatcatcttaagcgtgcttgaataccgggcgggagcggtcacatttacagagtgcttttttatcattatgatctcggcggagtttttccttccgctgcgtctgctcggttccttcttccatattgcgatgaatggaaatgccgctgcggacaagattttccggtttttggacacgccggtaccagagcatggtactgtgcagaaaacgcagggcaatgagatctgcttttcccatgtgaattttgcgtacacaccggatgccccggtgctgcgcgatgtggatttctccgtgccggaaggacgttttgtcgcgctggtcggtgaatcgggttgtggaaaaagtacgattgcgtcgcttgtgatgggggaaaaccgtccaaaggagggcggcagtgttacgatcggcggagtgccggtcacagagcttacggcggaggcgctttaccggaaggtgacaagagtgcgccatgacagctatctctttgcgggaaccgtggaggacaaccttcggatgggaaaggcagatgccacgcaaaaagagatggaggatgcgcttttaagagtggacctgctaaagacgatccgggagaagggcggacttgccatgcagcttgaggagcgcgcggcaaacctttccggcgggcagaagcagcgtctggtgctggcgcgggcgctgctgcatgacagcgatatctatatttttgacgaggcgacatccaacattgacgtggagagtgagaaccggattatggaagtcgtccgcgggcttgcccgtgaaaagacggtgcttctgatctcacaccgccttgccaatgtcacagtggcggatgagatcttcgtgctgcaggcggggacggaagggatcgcagagcacggcacacatcaggagctgatgcagcggcagggatattactgcaggctgtatgaggcgcagcaggaactggaatcctatgcgggcacacagcagaaggaggtgacggtgtaatgaagcagaataaagacaatcaaaataaaaagcagagaagcggatttgccgtcatgtgcgggctgatcgggatgataaagccgctgcttggcatcatgtgtctggcgattctgatgggctgtgcgggcaatctgatggcgacgtttttaacaatcctcggaggctatgcactgcttaccgtgaccggtgtatacagtggaatgaagttttccgtgatctttacgctgctggtctgcttcgcggtggcgcgcggaatcctgcgttacgcagagcaggcgagcaatcattatatcgcgtttaagcttttagcgcgcatccggcatcaggtgtttgattctctgcgcagactggcaccggccaagctggacggcgcgaaaaagggcaacctgatctcgattatcaccagcgatatcgaacttctcgaggtgttttatgcacacacgatctcgccgatcgcaatcgcagtcatcacatcggtggttatgacgatcttcttaggaaagatacatcccgttttcggagtgctggcacttttcttctatgtgcttgtcggagccgtgattccggttgtcaacggacggatcggagctgccggcggcaaggaataccgggaggcattcggcgctttgaatacttgtgtgctggacaacctttacggccttgaggagacgctgcagtacggacagcaggaggcacgcatcgctaagatggcggagcagaccggacatctggagacggtcaacggcgcattaaagcggggggagaacttacagcgcgtgatcaccgacggtgtgattctctttgcgggtgtgcttgcggcgctcgtgggtggaacgcttgcagaaaacggcagcatcccgggaagcggggcggtgattgcggtgatcgcgctcgcaagctccttcggaccgacggcagcactctcggcgctgtcaaataatttaaaccacaccttggcgagcggaaaccgtgtgctggatatcctggaggaaaaaccgctcgtggaggaagtgaccggaaaagaggagacgtgcggtcagaatatacactgcgaccatgtgtcctttgcctacgcgaacacgcaggagagcggggaagaagatggacgcggcgtgctgcgggattttacggcggattttacggaaaagcggattcacggcattctcggaaagagcggctgcggaaaatcgaccttgttgaagcttctgatgcggttctacgagccggatgagggagtgattgcctacgacggaacaaagatcggagagatcaatacagcggcgctgcgcggcggtatctcctatgtgacgcaggagacgtttttgttccatgacacggtggcggagaaccttaaggtggcaaaagaggatgccacagaggaggagctggagcgggcggcgcgggcggcgtccatccatgatcttatcatgagtctgccggacggttatgagacgaagatcgcggagctggggagctccctgtcgggaggagagcggcagcgtctcggaattgcgcgcgcctttctgcacgatgcagacatcctgtttctcgatgaaccgaccagcaacattgacagtttaaacgagggtatgattctgcgcagcctgaaagaggaatgtgcggacaaaacaattctgatggtgtcacaccggaagtccacgatgggcattgcggacgacgtgctggaaatgtaggcggatttttctttgcggcagatatttgagggagagaaaggatgaggacggcctgcagcagctttttcttaagaatatatgaagaagatagaaaaagattgaaatggatgtgtaaaaaatatatactacatatagtatatatttttgcattatgtacaaaaagaaggaggaacatggatgaagaacagagatgtgatatctgcggctgtggggattgccgcggcttttgtactttgtatgggagccccgtctatgagtgtgaaagcggatacgccgctgaacggatggtatgaggagaatggtgcaaaatactggtatgaaaacggtgtgcgccagggaaccgagggacgtggcaaggaaatttatgatccaggttccgatgcgtggtactggctggatgctgcagacaacggcaagatggctgtgagcaaggatgtgtatcaggaatcgaacggcggaaaatgggtacgctatgatgagaacggtcacatgataaagggctggaataccaatgacaacggcacttattattttgatctaacgaccggagcaatgtataagggcaaggtaatcattgatggagtttcctgtgtatttgatgataatacaggtattggtgtagattgcaaatggctggagtttgacggtgtcaagtattggtatgaaggcggcagacgtcagggactggaaggtcgtggaaaagagatttttgatccggcgtcgaatgcatggtactggctggatgccatcgacggcggtaagatggcagttaataaggatgtgtatcaggaatcggacggtggcaaatgggttcgctacgatgccaacggtcatatggtaaaaggtgagaactgcaaggataatgcgtggtatcgttttgatgaggtaaccggcgcaatggtaaagggctggtatacgacaaatgacagaaacggaaaacagatctattactattatgatgagaataatggcaagatggtaaagggtgaggctaccatcggtggaaaagcctgtatgtttgatgtttccacaggggtggcttatgactgcgcgtggtacaccaagaacggcggtaaatactggtatgaaaaaggtgtgcgtcagggaacagaagggcgcggcaaggagattttcgattctgcatcaaatgcttggtactggctggatgcagttgatgccggtaagatggcagtcaataaggatgtgtatcaggaatccagcggcggcaagtgggtgcgctatgatgccaatggacgtatggtgaagggctggaatacaaaggatggtaagaggtactattttgatgaggtaaccggcgcgatggcaaagggaatcgtaagaattgatggtacggattactcgtttgatgaggtaacgggtgtatacaagggagtatacgacggtggagagatcagctatagctggatgaataccaaagagactcgctatgacacggatggcaattatgcaggccataccacctacgaatatacagataatggtcagcttgagagagagcgtacttataataaaaaccgtcggattctgaccgaggagaagtatgcttatgatacgagtggcaatgtagtaactcattcctacaaagattacacagataacagcaagacatatacggagacatacagttattccggaaatctcccgattcaggtgagaaaaacagacaaaaacggcacggttactgaggtgagaagaaatacatattcaggtgccagcattacgcgtacggatgtatataatgacaggaatgtattgcagtattactgtacatatgtggtggatggtaagggaaatgtaaccaaagagacccgctatgacaagaacaatgcactgattggttacacaaccaacagctattacgaatatggcggtcagagtttcctgcgtcagaccttagagtacaacagtgaagacaggatacagagcggtgcgtcttatgtcagaagcggctacgagttaagggaaaagactatttatacgacaaatcgtgtagtcacagaacatacaaagtatgtgttaaaggattttccggaggatgagagtgagagaacctgtcagaaggaaagtaagacttacgataagaatgattctttaatttacacttcaacctatgattatgagcgcatggaatttttgaattaggatatagaagaaatagaagaaatagaaaaaagaaatgtccggcagcgtctgctgccggacatttctgtaaaaaacataaaaaaaatggagatagggggactcgaacccctgacctacgcgttgcgaacgcgtcgctctcccagctgagctatatccccggattctgattcagacgatatcaaaaatctttcgcccgaacaatatgtattatgccacatttgtttttgaaatgcaacaggtaacgaaaccttttgcgggtaaagttattgacttttcctgtagcggaacatagaatatttataattgcagggaaccggcaaaagacagtgcatgtgaagtggctgcagggagtattcccgcggtcatttttgaattttaagagataaaaagggacacagatatgaatatcaggcaggcaaaaaatgagatcaaacataccgtggaggcatacttaaagaaggatgaggcgggggattatgagattccggagatccggcagagaccggtgcttctgatgggacctccgggcatcggcaagacacagatcatggagcagatcgccagagaactcggggtcgggctggtagcatacacgatcacgcaccacacaagacagagcgccgttggactgccgttcatccgggaggaggaattcgcggggaagacctactctgtgacggagtacacgatgagtgagatcatcgccagtgtataccgcaggattcgtgacagcgggcagcgggagggaatcctgtttatcgatgagatcaactgtgtgtctgagacgcttgcgccgacgatgctgcagtttttacagtgcaagaccttcggcaaccagaagataccagagggatgggtgattgtggcggcgggcaatccgccggagtacaacaaatccgtgcgcgattttgatatggtaaccctcgaccgtgtgcgctatatgaccgtggaggcggattacagggtctggaaggagtatgcgagggcacagcacatcagcggagcgatcttaagctacctggaacttcgccccggcaacttttaccgcgtggaggcggatgtggacggcatgcagtttgtgacggcgcgaggatgggaggatctctccaatctgatggcggtctatgagaagctcggttttctggtggacgagcaggtgatccgggaatatatccatcacgccgatgtggcggaggatgtggcggcgtatctggatctctaccgcaaatatcaggatgactacggcattccgcagattctggacggctgcgtcagaccggagatctacgcgcgcatctatgcggcggcgtttgatgagtggctctcggtggtacacctgctgctggacggtctggcggcgtttttcggcagggcagcgtcagagcgggcattgacggatgcgtggtatgcctttttaaaagagtaccgcagccaggtggagacggccggagatccggcggaatgttaccggacgcttgtcgcagagcgggagcaggagatgctgcggcagattgcaaatgacgcttacacccgcgaggaggcaaagcgggagaaacttttactggaaaaattaaaagcggcgcagcaggaagtgacaaaagattcggcacagagctgttttgaagcggcaaaagtgggatttgaccggcagcgggaggtactggtgcagaccgaggaagcggcgggcgcggcgttggagcacgcgtttgactttatggagcaggcgtttgagaacggtgaggagatggtggtgtttgtcacggagctcacgattacgccggagtccgcaaggtttctctccgagcatacctgcgagcgctatctgacatacaacaaacagcttttaatcggaacgagacgagcggagctgttgtcggagctgcgccgggacaactgatgatttcacaggaaagaatataaaaggaatataagaaggaataaaaagatgcagtcacagaatgaacttagaaatctgttacagagaattgatcataagagttatccggcttacaaagatacgagaggaagctacgattttggcaattatgtgttgtcgatcgaccatgtgcagggagatccgtttgccgcaccgtcgaaggtgagcgtccatgtcaggggaggggcagcgaagttcccggcagatctctaccggatgaaatgccgcaggctggcagtgtgcgactatctgctgcgtcagttcgggcgggaacttgagcgcgtgtctttcaaggcaaaaggctccggaaagagcggacttctggcggtgagccgcccgggacaggaagtgttggagcgcaccgcatgccagatggatgaggcaaagggcgatctggtgcttcgctttgaggtgggattccctgccaacgggagaaccgtcaatgcaagagaactggagaaaatcttctttacgtttcttccggaatgtgtatcacacagcctgttttataaggcgctggatgaaaaggcggtgtaccgtgcggcggatctcgcggaggatcagcagtatatcagggatcatttaaaggagcaggggctggtggcattcgtggcggatggttccatcctgccgcgtgaatccggcgtgtccggcagaccgatgaaggacgccgtgaagtttacagcgccggaatccatgaaggtaagctttgtgctgccgcatgcgggaaagatacagggcatgggaataaagaaaggaatcacactcatcgtcggcggcggataccacggcaaatccacactgcttaaggcgctggagcttggcgtgtacaaccatatcgccggggacggcagggagtatgtcattaccgatgatacggcgatgaagatccgcgcggaggacggaagaagcatcaaaaaggtggatatttccatgttcatcaacgatcttccgaacggaaaggatacgagtgcctttcgcacggaggatgcgagtggaagcacctcccaggctgccaatgtggtggaggccatggaggcgggagcagagacgttcctcatcgatgaggatacgagtgcaaccaattttatgatccgcgacgagctgatgcagagggtggtaaaccgcgaggatgagccgatcacgccgtttatcgaccgtatcagggagctgtatgagcagtacggtatctccacgattctggtggcgggaagttccggctcctattttcatgtggcggactgcattgtccagatgaaccgctacaaaccgcaggagatcaccgcttttgcgaaggaggaagcggacagattcccgctgccggaggtgaagccgccgaaacaggcggctccgacgtttgagcgtgcggtgcggccggatcgcgcattcaaggaagatgcccgcatgaagttaaagacaatgggacgcgacggcatctccatcaaccgcgatacgatcgatgtgcgctatgtggagcagctggcggatacggaacagctcgcggcgctcgcctactttttaaagtatgccgaactccatgtgttcaacggaaaacgcaccttaagggagagcgtttccctattgatgcagtatgtggaggagcacggacttgccgcggtgacggagagcagctatgtgccgtgcgggctggcaatgccgagggcacaggagatttttgcatgcatcaaccgttacagaagaatcagtttgtaggaaaaggaaccggagaacgtgagtgacaaagcgaatattgcagcagcagttctggcacatgtagatgccgggaagacaactttatcggaggcactgctctatgagagcggaatgatccgcagggcgggccgcgtggacaacaaggatgcgtttctggatacctttgcgcttgagaaggagagaggaatcaccattttttccaagcaggcggtattaaagctgccggaggagacggtcacgcttttagatacgccggggcatgtggatttttcggcggagatggagcggacgcttcaggtattggattacgcgattcttgtcatcagcggggcggacggtgtgcaggcgcatacgaggacgctgtttgggcttctggcgaagtatgaggtgcctgtgtttttgttcgtgaacaagatggaccagccgggaacggatcaggaggcgctgctcttggaattgaaaaaggagctgcatgagaactgcgtggatttttcggatcaggagagcgcggcttttgcggaaaatgtggcggtgtgcgatgagcaggtcttagagcagtatctggcaggggaagcggtcggaacggagcagatcaaaagactgatccgggaacggaagctgtttccgtgctatttcggctctgcgctcaagatgcagggggtgaaggcgtttctggcggactttatccggtatgccagtatccctgcctacggggagacattcggtgcacgggtatttaagattgcacgggatgcgcagggaaaccgcctgacctacttaaaagtgaccggtggaagcttaaaagtcagacaggtcatcggggaggagaagatcaaccagatccgcatttattccggcgaaaaatatgagacggcagaggaagttggcaccggaggcgtctgtgcggtcacgggtctgcttcgcacatttccgggggagggacttggcgcagagaaagcgtccaggcttccggtgttagagccggtactgacctatcagatcatactgccggaagaggtaagcccggcagtcatgcttcccagactgcgggaacttgaggaggaggaaccgcagcttcacattgtgtgggatgagaccttaagagagatccaggtgcaggtgatgggggaagtacagatcgaggttttgagcgaactgatccgtcagcgctacggtgtgcaggtcgcatttggcgccggaaggattgtatacaaggagaccattgcaggtacggtggagggcgtgggacattttgaaccgctccgccattacgccgaggtgcatcttttgcttgaaccgggagagccgggaagcgggctcgtatttgagacggactgcagcgaagatgtgctcgaccgcaactggcagcggctggtgctcacccatctaagagagaaggaacacgtcggtgtgctgacaggatcggcgcttgcggatatgaagatcacgctcgttgccggacgcgcgcacacaaagcacacggagggcggtgatttcaggcaggcaacctatcgtgcgctgcgtcagggactgatgcaggcggaaacggtgctgctggagccgtggtatgatttcagactctcgcttccggcaggagcggtcggacgcgccatgaatgatatcgaccgcatgaagggaacgattgcctacagtgcagacggctgcattgtgggaagtgcgcccgtgtccgccatgcagaattaccagcgtgaggtgacggcatacaccgcgggagaggggaagctttcggttgccttaaagggatatttcccctgtcacaacacggaggaagtggtggcgcagatcgggtatgatgcccagagtgatctggagaatacggcggattccgtattctgtgcgcacggagcaggattcattgtgccgtgggatcaggtgttttcctatatgcacctgccgccggtgctcgggcaggataagagcggggaggaatggtatcccggacagtggctgccggatgcggcgaatttccacgcaaagacgggggaggaagaagcctggatcggcacggaagagattgacagaatccttgaccggacatacaatgctaataagaaagacaaagatgccggcgcaacgaacggctataaaaagaagcgcgtcatagaaagcagtcccgcttctgcttccggaggcgggaagcagaaggatgccggcgtggaatatctgctggtggacggctataatgtgatttttgcgtggcaggagcttgcggaacttgccagagtgaatatggatagcgcgcgcgggaggcttttggatattctctgcaactatcagggaatccgcagatgtgagctgattgtggtcttcgatgcgtaccgtgtcgagggacatcagacggaagcgtgtgattatcacaatattcatgtggtgtacacgaaggaggcggagacggcggacgcgtatattgagcgtttcgcccatgaacacgcgtcgagataccgtgtgacggttgccacttccgacgggctggagcagattattatccgcggagccggatgcatcctgctctcggcgagagagtttgagcaggaagtaaaggagaagaaccggcagctgcaggcagagtacgacagcagaaaagaccatggaaaggtctatctgcgggatcagatgccaagccaggtgcttgacggatctttggaggaacagcagtaattttgttccggaatggagattggaatgagaagggaagaagaagtcagactgacacattcgggtatctttgcaaaagacggcagacgctgtgtgtctgtgcgttttgagcggggaagggatgtcgcggaagccatattaccggcatgccgcgtgacgaagaatgagggctttacggacgaagaagtccgcggactggagcagtatctggagagtaaaaatgatgagatttttgcaaaggcaaaggaaatcaatccgatcaggggaattctttaaatgccatctctgccttttgctcatagccgcgatgcttgtggcggcggcactgccaaacggagtgcgggagtccggacctttggacagtgtgaagcggatggggcagaccggcggacaggaattttgtccggaccgtaagcagaccggcaccatggtcgcggcaccgaacgaggagcgcccggaagtggaagccgcaggcagggaactgagtgaggcgcatgtcatagagacgctgaggcagaagagtgcctaccgctaccggaatgtccagcagcttcggctcctggtgtggcttctggaatgtggtctggcgggacttttgggcgcgctgtttcttttggcggggagagagcgcgggcagcagtgggaactgattccctcgggaagaaggattgtagcatacataaggagggccgacggaaaaaagaacggccttgtatcctccataaaatagcaattattattttatgagaggataaaaactatgaatattttaatatggattctgatgatcgttggtggagcagccggaatgttatcgactgcatatctggtgctggctatgccggtaatctttggatggaaagtataccgcaagcttaagtatcacatcggtctgtatgattagaaaaaatgggagttttggctcccggggcaaaagaggaagtcatccggcaggaacggatggctttttcttttgtgcatcaaactacaacgggaaaagtgtgcgaagaataaaaaggaggatgtatgggcatccttgaaagaaaaggcaggtgtgaaagatggagagcatacgcagattgcatgaggaaatattaaaaagagagtacaaagcggagaaacagaggaaagaagaaatgcgatatgatcagatggactgtctgcttttggcgggagaagaaaagacggagcgcacaattccggtctgtgagacggtctttccggaaaagttcgcggatttaaatgcggtgcgtgaagtgctgcttacaccggaaaaacaggtatatgcgctgattgcgccggcatttatgggacagtttggagagggggtctccccgggagcaatccgtgcggcattgaaacgcgcgggattttccgggatggtggaggtggcggtatttgccgacattttaaccttgaaggaagcgcttgaatttgaccgccatgtgaatcgggatacggattttttgcttacgagctgctgctgtccggtctgggtgtccatgatccgcaatatttacggggaactggtaccgcatatgccgggggcggtgtctccgatgatcgctgcgggcagggcggtgaaaaagatgcatccggatgctgtcaccgtgtttatcggtccgtgccttgccaagaaaaaggaggcgaaggagccggatatctgcgatgcgattgatgtggtgctgacctttcaggagacggcgatgctgtttgaggcaatggggattgcgccgcagcagatggaggaggatgcaagcgaacattcttcgggagcaggcagaatctatgcgcggaccggaggcgtcagcgaggcggtcgtgcggacggtagaacaactccacccgggacggaaaattgcggtccgccccatgcaggcggatggcggaaaggcgtgtaagcagatgatcgaggcgatccgggaggggaagacggaggctaatttttttgagggaatgggatgcgtcggaggctgtgtcggaggaccgcgggcgctgctgccgcgcgaggagggcagtgcctatgtggatcattacggaaaagaggcattgtatcagacacctctggagaatccctatgtgatcgaattgctggaaaagctgggattttccaccgtggaggattttctggaaaaaagtgatcttctcacacgccatttttaaatgcagcaagtattgttcgggggcatgcatttaaaatgcgttgccggggggaacggttcgtgctacaataggcggcagagaatcatgcagagacaaaggagagaaagatgctgccacaggaatttttgaaacggatggagaacatgctgggggaggagtatcctgcatttttaaaaagctacgacatcgcgcgctaccaggcgctgcgcttgaatccgcagaagggggacgacgtgtcatttttaaaccgcggggtcttctcgctggagcgtgtaccatgggcagagcatggctactattacacggcaaaggatacgcctggaaaacatccgtatcacgaagccggcgtatattatatccaggagccgagtgccatggctccggcagcgtatctgacgcggcagatggcagacggcgcgggcgagcggattcttgatttgtgcgcggcaccgggaggaaaaagcacacagattgcggcggcgatggcaggcaagggaaccctcatcagcaatgagatccatccggcgcgggcaaagattctctcggagaatatcgagcgcatgggaattgccaatgcggtggtgacgaatgagacgccgcagcgccttgcagaacatttcagcgagtattttaccagaatcatggtggatgcaccgtgttccggcgaggggatgttccggaagaacgaggaggcgtgtgagcagtggagcacgcagaatgtagaactgtgtgcccacagacaggatgagatattagactgcgcggcatccatgcttgcgggcggcgggagactggtctattcgacctgcacgtttgcaccggcggaggatgagggaagcatcgggcgattcctgaagcggcatccggaattctacgtggaggaggtgccgcttgcggagggaatgtcgcacggactgggagaactttccgcgacgatccgtctgtggccgcataagcttcgcggggaaggacattatgtggcggtgctgcgcaaggagggaacgcttgcggacggcggatcgggtctgttaaagaacgggtatgagaacggaattacggcaggagattctaagagcgctgcggcgggcatcccggaatatctggcatttgccggggagactttcgccggggacgcattggagaagtatgcagggcgggagtgccgctatctgaaattcggcgagcagctctaccggatcccggagggcatgccgtcggtaaaaggtcttaaggtgctgcgcccgggactgcatctgggaacggcgaagaaaggcagatttgagccttcacacgcacttgcgctcacacttcatgcggcggatgttttacatacgatggatcttccttcggacgggcgggagatccgcggatacctaaacggggagacgttcccggcgcagggagaaaagggctggtatttaatcacggtggacggatacagtaccggctggggaaagctcgcgggcggaatcatgaagaatcattacccgaagggactgcgaaaaaggctttactagcagaacaccgactctgtaatgcagtacaataagagcaggaaagggagcgcagtgtggaacgaagatacatagagagccggctctggacctgtctgacaagtgcgtttttagaacaggttaggagccggtatcattttgaggaaaaagataaggcgcttttgaagggtgtggcatccgatctggcgggctgcctgaaatggaaggaagcggcgtatctgatgtttgaggatgggacggatacggtacgccgggcgactgcggttgtgacgcttggaagcgatgtggacctgctgcaggaacgctaccagaacaccgggcgcatgctggaaagctatatgcttgagagtatcggcggagaacttctgatgttaggctatggcatgctggaggcatggatacgggagaataccgggtatcaggtggcggcgtatcattttttcggtgatgacgaagcacatccgctgtctgcgatgccggagatcttagcgcgggcaaaacagcacaaggtcgtctgtacggcagggtattgcctgaaaccgaagaaaagcgtggtgtttgagatggagcttgcgccggcggaggcgtgcggggagacggcacatggcgacagaatctgcgcacattgcagcaggagggacacatgcccgaaccgtaggtagaactgcactttcagggggaaaaatgaaaaattgcagtggaaagtttttcaaatcctgttataataaagcatagtttgtttttttgaaataaaggagtatgcagaatgggagacgcgaaatccatcaaagagcgcggaatactggagcaggtcatcaagtcggaactcgattttattacctatgtggatgtacataccggaacatttcatgtgatcgtgaccaatgacgatacggatgtgactccgccgccggagggagattatacacaggtaaatgcgcagatgataccgctgtatgttcatcccaaggaccgggaggcatgcgcggctgcgttagaactgccgcatattctctcggaactggaacagagggatgatctggttgtttcgtaccgcctgctgtgcggggaggtataccgcagaaaagaactgcatatttcttatcagcaggatgaccgtgacacggtggttttggtgcgccgggacgtgacggagagctatgaggaagaacagcggcagcaggagagactgatgtcggcgctgtctgacgcaagacatgccaatcaggagaagaatgagtttttggagcgcatgagtcacgagatccggacgccgatgaattccatcataggtcttacgtatctgaccagggaatatgtgaacaatgagaagcaggtgctcgagaatctggacaagatcagccagtcagcccgttttatgctgtcttttgtggatgatattttaaatctttcccagatcgagagcggcaacgtcgcattgaacagccagaaggtggtcttagatgcctttttggaggagacggtggaagaggcgatgcggcaggcggcggagcgtcgcgttcactttgcggtggacagacgcggaagctttgatgctacctattgctttgacgcggagaagctggagcgggcgctttccaatattctggagaatgccgtaaaatacacgatgccggacggaaaggttgactttattgtggagcataccggcgatgacggggaggatgccggcttccggtttgagatccgggatacgggagtcggaatggacgaagcgtttattccgcatatgtttgagccgtttgagcaggaggatgaaggaatcacgacgctaaacggcggtaccggtcttggccttcccattgcgcgcaacattattgaatttatgggcgggtacattgacgcatacagcgaaaagggcaagggctcgacgttcattgtgaatgtgaacttaaagcgtgtcagaaattccggagaaaagctgcggggtcagggcgatgtacaggcgcccgactacgattttaccggcaaaagagcgctgctggtcgaggacaatgaggtcaacattgagatcacgcgcaatatcctgctgcacaagaatctgcaggtggatgtggcggtcaacggagaggagggcgtgacgcattttctttcccatgagcccggatattacgacgtcatcctgatggatatccggatgccggtcatggacggactgacggcgaccagaaagatccgggaatccggacgtgaggatggcaaaacggttccgatcgtggcgatgacagccaatgtgtttgaggaggacgtgcgaaagtccctcgatgccgggatggatgcacacttaagcaagccgattgagattacacagatgtatgccgtcctcgacagtatgatttaccgttgagaagaaaaaggggctggtgcttcaagcaccagtccctttttgtgtcgaattttgtagaaggggaaggacaggggcgctggatgttaaaaaacggtacggattttgctgagaaataaaagatggtatgttatattttaaaagatatgttaccgatacgataaaagaatggagccgaatcaatgcaaaagaacagagtgatgctggtagcggatgatatcgacgtaaacagagcgtcgtttcgcgcaatgtttgaagaggaatatgaggtgctggaagccggggacggaaatgagacactaaaaattttagaagagcggaaagtggatattgtcatactggatatgtgtatgcccgtaaagagcgggaagcaggtattaaagcagatgaaggcagatccgaagcttctcgatattccggtcattgtgaagacggtcatcggcgaggagagagaacttgaaatgttagagatgggggcggacgattttatattttctccctgcgagccggaggtggtaaaaaagcgggtgtccaatatcatgacacgctatgagacactggcggagcggcttgagagccagcggcatttaagcacggtcagagaacatctgctgtttcaggtggcgcggacggtgcgcacggacgtcgcggtgatcgaggagtgttacagagaaatgacaggtcagagaacggaaaataagtctgtgggactggaggatatgtacaggcatctggagcacatccgggaactgacggacagtgttttggacgggcagattgtaggtgcgggcgagagtgtctgcgacacctttcagatttcggatgtggttgcggaactgacctcagagtgcaggacaatctgtacggaaatggggattgaggtgacggtgcaggagggtgagatcttctgcgaatatctggtgggcgatgtcaggaggctcaagcagatctgggcaagactgctaaagaaagcgtatatcaacgcgcgaccgggatgccggatttttacaggctatcgggaagtaagaacgggggaggatgagcttgaactggaacttgccgtgcagggcagcattgacggaggagaagactatccgctgatcaagagcctcgtagaacttttgcacggaacgatgtgtgtggaagtacaggaggatgcgcagattctctgcagggtgttcctgcctttcagaatcggaaaagcgatcggacagcccaaaagttttgcggggttaaagacgcttcttctggacgacaatgaactgtcgagagattatcatgcagcggttcttgcacgtctcgggcttccggttgacgtggtgcaaaacggggcggacgccgtggcgtatttaaggagagccgcgtctaagggcaccgcctatgatctgtgttttgtgaactggtatatgcagggcggtgagccgtttatccggtcggtgcgggaaaattttccgaagggaagccttacgatctgctgttcgaccaatgagaaggaactggtggagtgtcagatgcttgccgcaggagtggattgtgtggtggagcgcccgatttaccaggagggaatgtaccggtttttgacggaactgtgcagacaggagagtggaaaaaacggaaccggatcggagaaaatataattttttatacggcagcgaaacttttttggtgtccggacggtctaatagttaaaaggaggtgtgagatcgtatgtttttctccgggaaaaaccataaggaacaaaagatagaacagcttttgctggaaaattacaacaaatactatcgtcttgcctacagttacgtacatcatgaggcggatgccgcggatatcgtacagaacggagcgtacaaggcgatcaaaaacagcgatgcgctaaagcaggaggaatatgcgcagacatggatttaccgcattatgttaaacgagatcttcggatatgtaaaaaagaaccgggaagtttccctggatgagatgccggcggaagagggaagagaagaccgctatgagaacattgatctaagaagggcattggacgccatggaagaacgggataaagcggtcattgaactgcgctattttgaggacatgaagctggaggatattgcgcgagtgctgggggagaaccagaatacggtaaagagccggctgtaccgcggattaaagaagctacggctggaacttacggatacatggcagtgggaatagaggaaaggatggtgccgcatatgggaaataagaaacaggattgtaaaaagatcgaggaattaaagcgacagtatgccggatcggaaatgtccggcgagcaggtggagcagatgaaaaaacggatcgaggaagcaaagatggaaaaacgaaacgagagcagaaaaatgcataccgtgagaaatattgtggcagcggctgctgcagtggcggcagtcttcgtggtgctgccgaacacctcggggagcgtggcgtatgccatggggaatctaccggtggtcggaaaactcgtggaggctgtgacgttccgggattatcagtacgacaacggaggtcatgcggcggacattaagacgccggagctgacggtaaaggagagcgatacggaacagatgacggacactgaggtccaggtgcaggagaacttaaaaaagacaacggcagagatcaatgcggagattgaaaagattacggatcagatcgtatcggagttcgaggagagcaggaaggaagaagagggctatcaggaggtcgtggtcaagcacgaagttatcagcacgaccgacgattactttacgttaaagctgatgtgctatcaggcggcaggcagcggcgcggagtgggactattattatacgattgacttaaagacgggggagcgtctgacactttcggatttattccagagtggcgcggattatatcaccccgatcagcgagaatatcaaggagcagatgcagcagcagatggcggaggatgacggtaagatgtactgggtggataatgccgaggttccggaatggaattttgacaaaattacggatgagacttcattttatctggattcggacggccatcttgtgatatgctttaacgagggtgatgtggcaccgatgtatatgggatgcgtacagttcgtcattccggatgaggtggttgcagatatccgaaagtaacggaagcagattccggtgtcggaggatgagagacaatgaagcatgcaaaagcggtgcgcagaattatttttacggttttaatcgtggcagccgtgattgtgggatttaatacctatacggcagattattatcatgcgaaggactatgaacttcagacaacagaggtatcggagacggatgcctacatcgcttacggagacccgcagagtgagacgggactgatcttttatccgggagccaaggtggaagagacggcgtacgcaccggttatggatgggcttgcgcagcagggaatcttttgcgtgacggtaaagatgccggcgcaccttgccattttaaagccgaatgcggcggatgaggtacggcaggagtttggagaggtaaagcgctggtatctggcgggacattctctgggcggagccatggcgggcagctatgcggcaaagcatgagtcagagctcgcgggacttatttttctggcggcgtacccgaccaggaaacttcagacgcttccggtgctctcgctctacgggagcgaggacggcgttttgaatatggaaaaatatcaggaagcaatcggtcttgcggcggactgccgcgagtatgtcttagagggcggcaaccatgccgggttcggcaattacggatcgcagaagggagacggcgaggccgggattacggacagggagcagtggcaggaaacgatcgattacatcatggacatgatccggcagcaacagggggaaaagtagcggaacccggagaataatgaaacggaatctgagcggaaaacgaaggaaagcggtttacagtaccgccgcctttgtggtatgatagtaccagtgcaaactcaggataaaggagcgattggatcatgcaggacaatttgagagaggaattgattaagcagtttccggcggaagttgtggaactggtggagccgtccggtaagaagttttatgcctgtccgacctgcaagcgcgtggtgacattgaacgagagcaagtgtgccggctgcagtcaggtattgagctgggatcacatccggcaggaagagatggtgaagggtgtgaagacggcaaccttaaaatttgaggttggcggagattttaataaaggcgactgcagaaagtgtccgctttcttacattgcaaaagagaataatgagaacgtttatgaatgtccgttaaaaatgcgtgcgaactgtaagctggatatttcgtaacaagatttgtaacaagagaggacaagagcggcccgcttcggcgtgccgctcattgcttttttagaaaggagaaagaatgtcacggatgcattggtggataatggcagttggagccgtatttttcctgtggtttttcattccggcatttgtcgtggttaatatcggtaacattacgggaatggcggtgtcagcccttgtgctgctgtacggtattttttaccggcaggtacaggatgtggcagggagactttggcagacgcgcggtggcagagcgggattgtccgccctgggcatggtgctcctttttattctgcttatcgtgacagtggagacggcggggatgataagaagcgcggcaaaccgtgcgccggagaatacgacggcggtggtcttaggatgcagcgtcaagggggagcggccgagccgggtgttgagcgaacggctttgcgcggcgtatgagtatctgaaccggaatccaaaagctgtgtgcgtattatctggcggacagggagatggagaggagatcagcgaggcagagtgcatgtaccgttacctgaccgggcgggggatcgacggggcgagactgcttctggaggaccggtccacgacgacggcggaaaatctgcaatattccatggaattgttacaacagcacggaatcgacgggcccgtcacgattataaccagtgaattccatgagtaccgggcgaatcagacggcaaagagacttggcattacaagctacagcacaccgagccggacattttttctctaccttccgaccttttatgtgcgggaattatatggtatattgtattataaaatatcgaaataaaggatgacgagatggtagtaaaatattatgcggtagcggttggtaagaaaccgggaatatacacaaaatgggacgagtgtaaggcgatggtgcacgggttccccggagcggtttacaagagttttaagacgctggaagaagcggagacgtttctggaaagcgcaccggcgcgtgggggagaagctcatgcaaaaggagcggcgcagcagaatgcaacgcaaggagcagcacagcagaaatcaggaacagccggagacggcaaggcagagacgagaggtgcggaatctgccggagagacagaggatctgccggagaattacgcgttcgtggatggctcttttcacgccggcaccggcgtgtacggctatggaggttttttgattcatgccggcggaaaagaagtgctgcagggtgcggggaaggagcctgagatggcgtcgatgcgcaatgtggcgggcgaggttttcgggagcatggcagccatcgaaaaggcgcttgaactcggcttaaaggatcttacgatctattacgattatatgggtatcgagatgtgggcaaaagggctctggaagcgcaataaaaaggggacggtggcctactacgagtatgtgcgctcggtggaggataagatccggctttcttttgtgaaggtaaaaggacactcgggcgtcatgggcaatgaggaggcagaccgcctggcgaaggaggctgtcgggataacgggctgacggcgcgcgaagagagaaggcattcagggggatcggacggaatggataagagattaaaatattatgatctgatggagcagctccacggcaagatcatgtcgggggagatacgcccgggagagaagcttccctcggagaatgaactgtcggcggagtacggggtcagccggcagacggtgcgcaaggcactgcagattttgcagaatgagggatacatatatgcggaacatggccgcggaaccttctgctcggagatgttacggcacacgacgccgtccaaaaatatcgcggtcgtgacaacttatctttcggattatatttttccgcgcatcgtgcagggaattgaccaggtgctgacggagaacggttacagtattctgctgaaaaatacgcgcaactcaagaagccttgaggcaaagtgtctcgaggagcttctgcagaaggatatcgacgggctcatcatcgagccgagcaagagccagattttctgccggcatgtgaatctgtatgagatgctcgacagctatcatatcccctatgtatttatacagggagtacatgcccagcttctggaccggccgcagattcttctggacgactgcaggggagcctatcttgcgaccagatacctgattgaactgggacaccggcgcattgtgggcgtcttcaaatccgacgacacgcagggacagcagcgccacaaggggtatgtgcaggcactgcaggaagcgggaattgcgtatgatccggataaggtgatctggttctacacggaggaccgcaagacccatccgtttgagcggatcaggcagatggcgaaagatcgcggcaatcatccgtttgaggcggtggtggcgtacaacgatcaggttgccatcgaggtgatccgcgcgctgaatgaggaggggctctccgtgccccaggatgtctcggtgacggggtatgacaattcctatctggcgcagacatgccgcgtgccgctgacgacgatctcccatccgcaggaggaactgggagcggcagccgccgaactgctgcttcggattatccgggagggaaattccaatatcgaaggaaaatgcgtcctgatggagccggaactggtgatccgggaatcctgcagaagagaagatacggacatgacacaggacgaataaaaacaacttgtaagtacgaaagtacaagtcatacacttggaagcaggatgtatgacaacaaaaagtcgctgcatctgcagcggctttttgtgtactctgtgcacattttgattagggggaagagaaggagagacgcatgaaataccggatgaaacatgccccgatggggtggaacagctatgactattatgacaccacagtgacggagcgggaggtcagggcaaacgcggattatatggcggcgcacttaaaaccgtacggctgggaatatattgtggtggacatccagtggtatgcaaagaacaccggaagtcagagggagaagtaccagtatattccgtttggggaggtctcgatggatgagtacgggcggctgctcccctgtacggaccgcttcccgtcggcgaaggacggtgtgggctttcgggcgctggcggattatgtgcatgggctggggttaaagtttggaatccatatcatgcggggaattccgcgggaagcggcacaccggcatctgccgattttgggaagcgatgcactggcgagcgatatagcggatccgtcgtcgatctgtaagtggaatccggacatgtacggcattcgtatgggagagccgggcgcgcaggaatattacgattccatcgtggcactgtacgcacagtggggcgtggattttatcaaatgcgatgatatctgcaataccaatctgtacgtggaacatccgtattcggcggcgcacgagattgagatgctgcagcatgcgattgaaaagtgcggcagggacatcgtgctctccttgtcgccgggaccggcgctgatcgagaaagcatggcattatgaaacctatgccaacatgtggcgcatcacggatgatttctgggatacgtgggagctgctttacgatatgttccggcgctgcgaactgtggcagaaccacgtgggctgcggatcgttcccggactgtgacatgctgccggtcggctggctcggaaaaggattcgggcaggagcggcagacgaattttacaagggatgagcagaagacgatgatgacgctctggtgtatgttcggctcgcctttgatgatcggcggtgaactgacgaagctggatgactggacgcagttccttttaacgagacgggagctgctgcagatgctcgacgcagactatgtgggcagacaggtggcgcgcgatcaaaagcatgcggtctggagctgtgtcaatgagaaaaaggacgaacggtatcttgccctgtttaactttatggagcagccggcgcggtgtgaggttgcgctgccggagacggaagcgtttgcagacatgtgcggacagacgggaaccatccgggcgagggaactctgggatggaacagagcttattgtgcagaatgacagcctttcttctgaaattccggcgcacggtgtgcatgttttccggatagataaaaaatagagaaccacacaatgtaaaaataaataaaaaacaacttgttattacgagcatacaagttttatgcttaagataacatcaataagatgagtgcagggaaatcatgggtgcatgagagatgcggcatggtttcggaaaggggtttgttacacatgggaaatgcaaaggagaggattgagagtgggaaggcggtgctcggtatcgagttcggctcgaccagaatcaaggcagtgctggtggacgagacacatcagccgatcgcatccggtgcgcacgactgggagaatcagctggtcgacggaatctggacgtacagcctggatatgatctgggacggtcttagggactgctaccgcaagatgacagaggatgtacagaacaaatacggcgttgccgtcacaaagcttggtgccatcggattttccggaatgatgcacggctatatgccgttcgatgagaagggggagcttctggttccgttccgcacctggagaaataccatcacgggcgaggctgccgcagcactgacgaaggagttctcgttcaatattccgcagcgctggagcatcgcacatctgtatcaggcgatcttaaacggggaagagcatgtggataaaatcgcatattttaccacacttgcgggatacattcactggaaactcacaggggagaaggtactgggagtcggcgaggcatccggtatgttcccgatcgatgcgaagacaagagattacaaccggaagatgctggcgcagtttgatgcgcttcctgcggtagggaaatatacatggaagttagaggagatcctgccgaaggtgcttgtggccggggagaatgccgggaccctgactaaggagggcgcaaagcttctggatccgagcggcaggctggaagccgggatcccgctctgcccgccggagggtgatgccggtaccggtatggcggcaacgaattcggtggctgtgcgcaccggaaatgtgtctgccggaacgtccgtgttcgcaatggtggttttagaggaagacttaaaggcggtacatgaggaactggatatggtgaccacaccgtccggcgataccgtggcgatggtgcactgcaacaactgtacctcggatctgaacgcctgggtcggcctgttccgggagttcgcggagaacttcggaatcaatgtcgatatgaacgaacttttcggaaaactttacaacaaggcgctggagggcgacaaggactgcggcggacttctggcatacaactatttttcgggagagccggtgaccggagcaaacgaaggacggccgctgtttgtgcgcaagccggacgcacattttaatctcgccaatttcatgcggacacatctgtatgcagcgcttgcaaccttaaagatcggtctggatattttgctgaaggaagaaaaagtaaaagtggaccgcatctacggacatggcggactctttaagaccaaaggcgtcggacagggaattttagccgctgcgatggatgcaccggtggcagtgatggagacggccggcgagggtggtccgtggggcatggcgctgctggcatcctacatgctgcagaaggcggacggcgagagcctggagcagtacctctccgaaaaagtcttcggcggggaatctggaagcgtgatggagccggatccggcagatgttgcgggatttgacgcttacatcaaggcatacaaagcggcgcttgcagcagagaaggcggcagtcgaggcgatgccgttataagacaggcacgaaggcggcagcctggacgatgccgttatagacagatacgggggcagcggcagatgctgccgctgcttacagattgggatttacacagcagttactgctgaaacataaatatatttcatggagggaacattatgttagcaacaaaaaattacaagttctggttctgcaccggatcacaggatctttacggagacgagtgcctcgcacatgtggcagagcattccaaaatcatcgtggcaaagttaaacgagtccggcgtgcttccgtatgaagtggtatggaagccgacactgatcaccaatgaactgatccgtaagaccttcaacgaggcaaatgtagatgaggagtgcgcaggcgtcatcacatggatgcacacattttccccggcaaagtcctggattctcggattacaggagtacagaaagccgctgcttcatttacatacccagttcaatgaggagattccttacgacaccatcgacatggatttcatgaacgagaaccagtcggcacacggagaccgtgagtacggtcatatcgtgacacgtatgggaatcgagcgcaaggtagtcgtgggacactggagcgacgtcaatgtgcaggagcgcattgcatcctggatgcgcacagcagtcggcgtgatcgagagcagccatatccgcgtgatgcgtgtggcagacaacatgagaaacgtagctgttaccgagggggataaggtcgaagcacagctgaagttcggctgggaagtggatacctatccggtcaacgagattgcggaggcagttgcagctgtatccgagtccgataccaacgctttggtagatgagtattatgacaaatatgacattttattagagggacgtgatccgcaggagttcagacgccatgtagccgtacaggcacagatcgagatcggtttcgagcgtttcctggacgagaagaattatcaggcaatcgtaacacacttcggtgatctcggtgccttaaagcagcttccgggacttgcaatccagcgcctcgaggaaaaaggctacggctttggcgcagagggtgactggaaagtggcagcgatggtgcgcctgatgaagattatgacagcaggcaagaaggaggcaaagggtacttccatgctggaggattacacctacaatttcgtaaaaggcaaagagggaatcctcgaggcacatatgcttgagatctgcccgtccatcgcagacggcccgatttccatcaagtgccagccgctttccatgggtgacagagaagaccctgcgagactggtatttacctccaaggaaggaagcggtatcgcgacatccttgatcgatctcggcaaccgtttccgtctcatcatcaacgatgtggactgtaagaagacagagaagccgatgccgaagcttccggtagcaacgaattactggacaccgcagccggatctctacaccggtgcggaggcatggattttggcaggcggcgcacaccacaccgcatttacctacgacctcaccgcagagcagatgggcgactgggcaaatgccatgggcatcgaggcagtttatattgacaaggatacaaagatccgcgagttcaagaaggatctgatgcttggcaatctgttttaccgctaaaaaacaataagaagcatacggggatgtcaaaacggcatcccccggtaaatgagaatggtaccggggcagacccggatacacatatagggtgcgcgcacaagcgcagaaagggagaggaatatgaagttttttattgacacagcaaacgtagaggacatccgcaaggcaaatgatatgggagtgatctgcggcgttaccacaaacccgtctctgattgccaaagagggcagagatttcaacgaggtcatcaaggagattacgacgatcgttgacggtccgatcagcggcgaggtaaaagcaaccactgtggatgcagaaggcatgatcaaagaaggacgtgagatcgcagcgatccatccgaacatggtagtcaagatcccgatgaccgtagagggattaaaggcagtcaaagtgctgtccgcagagggaatcaagacgaatgtgacgcttattttcacagcaaaccaggcgcttcttgcagcgcgcgcaggcgcaacctatgtatctccgttccttggcagactcgacgacatcagcacggcaggtatcgatctgatccaggacatcgtgcagatcttcgacaactacggacttgagaccgagattatcgctgcatcgatccgcaacccgatccatgtgacagactgtgcattagcaggcgcacatatcgcaacggttccgtacaaagttattgagcagatgaccaagcatccgcttaccgatgcgggaattgagaaattccaggcggactacagagctgtatttggtgactaattaccgaagatgctctgcggtatttgatgacaaagttttgcagtagcaatgacaaagaatgcatgaagggggaactatggataagctggcacttcagaagatggctgttgaagtccgcaagggaattgtatcgtccgtgcacagcgcgaaggcgggacatccgggcggatcactctcagcagcagatatcttcacctatttatattttgaagagatgaatattgatccgaaggatccgaagaaggaggaccgcgaccgttttgtgctgtccaagggacacacggcgccgggactttactcggcactggcaaaccgcggttattttccggtggaggatcttttgaccctgcgccataccggatcgtatttacagggacatcctgatatgaagcacattccgggcgtggatatgtcttccggttctctgggacagggactttccgcagcgtgcggcatggctctggcagggaagatgaaacagcaggattaccgtgtgtatgcactttgcggcgacggcgagatcgaggagggacagatctgggaggctgccatgttcgcaggtttccgcaagctggataacctctgcgtgattgtggacaacaacaacctgcagatcgacggaccgatcgacgaggtctgctcgccgtacccgatcgacaagaagttcgagagctttcatttccacgtcatcaacatcgacggcaatgatttcgatgagatcaagcgggcgtttgatgaggcgagagccacgaagggaatgccgaccgcgattattgcgcacaccgtaaagggaaaaggtgtctcctacatggagaacagcgtcggctggcacggtaaagcgccgaacgacgaggaatatgcagtggcgatggaggatcttagaaaggcaggtgaagcattgtgtcagaagtaaagattgcaacgagagagagctacggcaatgctttggtcgagcttggaggagagcatgagaatctggttgtcctggatgcggatctcgcagcggcaaccaagaccggaatgttcaagaaggcattcccggaccgccacattgactgcggtatcgcagaggcgaatatgaccggcgtggcagccggaatgtccacatgtggatttgtaccgtttgtgagcaccttcgccatgtttgcggcaggacgttcttacgagcaggtgcgcaattccatcggatatccgcatctgaatgtgaagatcggtgcgacacatgccggaatttccgtcggggaagacggcgcgacccatcagtgcaacgaggatattgccctgatgcgtgcgatcccgggaatggttgtcatcaacccggcggacgacatcgaggcgcgcgcggcagtgaaggctgcctacgagtacgtgggaccggtgtatctgcgctttggcagactggcggttccggtcatcaacgacggcgcggattataagtttgagatcggcaagggcgtgacgctccgtgagggaagcgactgctccatcattgcaaccggactttgtgtctcggaagcactggcagcagcggatacgctggcagagcagggcattcatgcggaagtcatcaacattcacactatcaagccgcttgacgaggaacttgtggtaaagacggcaaaaaagacggggcgtgtattcacggtggaagagcattccatcatcggaggactcggcgctgcagtggcggagacgctcggtgaaaaatgcccgacaaagattaccagaatcggtgtcaacgatgtctttggcgaatccggtccggcaaaagaacttcttcacaaatacggactggatgcagagggaatcgcaaaccgcatcctgcgtgagatgaagtagaacggcgcagcacaggaggaaactaagagatgttagaagaattaaaaaaacaggtctatgaagccaacatggaacttccgcgcagagggctcatcacctacacctggggcaatgtcagcggaatcgaccgcgagagcggctatttcgtcatcaagccgagcggtgtggattatgatgccttaagcccggacgatatggtagtcatggatcttgacggaaataagatcgagggcagatataagccgtcctccgacacggcgacccatatcgaactctacaaaaagtacgaggagatcggtggtattgtacatacccattccccggaggctgtcgcgtgggcgcaggcgggcagagacattccgctttacggcacaacgcatgcagactatttcttcggaccgattccgtgcgccagaaatctgacgccggaggagatcgacgaggcatatgagaagaacaccggacttgtgattattgagacctttgagacaagaggcatcaagccgatgtacacaccggcggttctctgtgcgaatcacggaccgtttacctggggcaaggatgccgcagaggcagtccacaatgcggtcgtactggaggaagtggcgaagatggcacgcaacactgagcttatcaatccgaaggtgaagccggcgccggattgtatcaaggaaaagcatttctaccgcaagcatggggcaaatgcctactatggacagaattagtacgtcggaagaaacggcctgccgtttcgcaataaatatgcttagaaatgaggatcagtatgcaaaaacggagttttggcagaacaaaggaaggcagggaggtcacggagtacacgcttgtcaatgcgcagggaatgacgctttctgtcattgatctcggggcaacgatcgtatcgatcacaatgaagggctcagacggaaacgtatatgacgttgtgctgggatacgatacacccgttgattatcagaacaatacctgctattttggagcggtgatcgggcgcaatgcgaaccggatcgatcatgcacacatccatctggacggaaaagactattcgctggaagcgaatgacaatgagaacaatctgcacagcggatcgcacggttttcacgcagtgatctgggatgtggtgcaggagagcgcacagagtattacgttttcctatgtaagccgcgacggggaacaggatttcccgggcaatatgacggcgaaggttacgtacacgctggatgataacggggaggttgcgatcgcctatgaggcagtctgcgaccagacgacggtggcgaactttacgaaccatgcctactttaatctggacggacatgattccggcgtgatggaagggcagaagctcgaacttcacgcatcctactatacgccggtcattgattccaaggcgattccaaccggagaactcgcaaaagtagccgggacgccgtttgatttccgggagatgaaggagatcggacgggacatcgaagcggacgatacgcagcttcgttatgcgggtggttatgaccacaattatgcgctggacaaggcggacggtaccatgcagcttgctgcgcgtgccagaggtgcaaagtccggcatctgcatggatgtgtatacggactgtgtggggatccagctctataccggcaactttatcacgccgcagaccggcaagggtggtgtacagtacgacaggcgccatgcattctgtctcgagacgcagtatttcccgaatgcggtgaatgagaagaacttcaaatcaccggtattaaaagcgggcgatacgtactgctcaaagacaaagtattgtttcgggctggaaaaataagaacaacgaatcaggaatgagagaaagtggattttatcacagaaaacggtggtaagatccactttttttgttttgcagggaaaacagcgtccatacttgacaaaaaggaaatcctgtctataataattactattggtaattacctttaataactaaatggagcgacgagctgggaggataaatcatgacgaacgaaaaaatcaagcggatgtttgatgcctgctatcaggcgaagcggatcagagaaatgcttccgcctctgccgccgggcgtgatgccgtcttatattcaatatctggatgtgatccggaagctggaagggcagggcaccggggtaaaggtatcggacatcagcgatgcgctcaatcttccgcgccccggtgtgacccgaaccgtaaaagagatggaaaaaaagggatatatctgtaagatttcttccccggatgacggccgtgtgacctatatatccgccactgaggagggagaggagctctcgaaaaagtacgacgagtattattttaacgacctgcgggcggatctgtctgatattacagaggaagaagcggatggcatgattcggacgattgagaagttttataagattatgtgtgagaggagagaacattttgacaagtgataaagcagattttacacagggaagtatattaaaaaagctggttgcgttcatgctgcccgtgctgggagccttgatcttacaggcggcgtacggggcggtggatcttctggttgtgggaagattcggctccacagccgggctgtccgcagtgtctaccggaagccaggtgttaaacctggtcaccttcgtggtgattcagctggcgatgggtgtgaccgtcctgattgcgcgctacctgggagaaaaacgcccggagcagatcggcgcggtggtcggaggcgccgcgatcgtgttcgcactgatcgccgtcggactgtttgtcgtcatggtatgttttgcggaaccgatctctgtccttatgcaggcgccggcggaagcggtggatctgacggcttcctatgtgcgcatttgcggcggcggtattttctttattgtggcttataatgtgctgtcggcagttttcagaggactgggtgacagcaggtcgccgttactcttcgtactgatcgcgtgtattgtgaatgtggcgggggatctgatcctcgtggcaggatttcgcatggatgccacgggagcagcgattgcgaccgttctggcacaggcgctcagcgtggtatttgcagtgctccttctgttgaaaaaggatcttccgtttgccattgtaaaaagtgatttccgatggaatccgcagtgcaggaacttccttcggatcggactgccgctggctttgcaggagttcctcacgcagatttcatttctggcgctctgcgcgtttgtaaaccgtctggggctggaagcgtcctccggttatggtgtcgcctgcaagatcgttaattttgccatgctggtaccgagtgcgctgatgcagtctatggcgtcgttcgtctcccagaatataggagcagggaagaaaaagcgggcaaagaagtccatgcttaccggaatcggcgtgggtgttacaatcggctgcgtggtatttgcactgatcctgttaaagggagatctgctggcgggtattttctcgacagatccggcggtcatccggaacgcgtatgattatctgaaaggattttcaatggagacgatcgtgacagcggtccttttcagcatggtcggctatttcaatggaaacaacaagacactctgggttatgacgcaggggctgatccagacgttattgatacgtctcccgatggcttacgtgatgagtatccagcccaatgcgagcctcacaaagatcggtctggcggcgccggtgtccaccacggtgggaatcgtactgaatattggattttttgtatatcacagaagggcagcagagcggcgatgagagaagaacttcttaacgaactgatggtcatttcagaggaagaaaaaaagtacagagcgggacagggaatggtcgagcggcagctgtatgcgagagagtcgatcggggagattgaccgggaactgctgttaaagcggggacggctcatcaccgtgcgtccgcacagccgctttgtggatttcccggagcaccggcacaactatgtggagatcatgtatgtcgtgcaggggagcatcacgcacatcatcggggggaaggagctgacacttcacaagggtgatgtgctgatgttgaaccagcaggtgcgtcatgccatccgcagggcagagtatgaggatatcggcatcaattttatcgcgctgccggagttttttgaggtgccgctttccatgctgcatgagaaaaatgtgcttgcggaatttatcgccggcgctttcggacagaagaatccggtgtcgcactacctgctgttccgcttaaaggaacagccgcaggtggaaaatctcatggaaaatatgatcgaatccatgctgcatgaacattccgatgaggatgtcatgaaccagtatacgatggggctggtatttttatatctgctgaatcaccttgagaacttaagccacaattcctcgatggactaccgggaggcgatcgtgcaggcggtgctcggatatatcaaaagtgactgcaaaaatgcgaatctgacgaagatcgcaaaagatacccatcagtcggtctcggtgttaagcaagctgatccggcagaaaaccggcgatacattcaaggagcttttgcagcagcggagatttgagacggcggcacatctgctcatggagacggatctggcggtggaggagatcgcgcttgatgtcgggtatgagaatctgagctattttttccggcagtttaagagccggtatggcgtgacaccgcgtgcataccgcatgatgaattcacgtgacgccgggaacctttatgaaaaataatagagaatatttgagaatggaaaataaggacagttttttagccgaatcagagcctaaaaaacggtccttatttttgttatgctgacagcagtgatgagaaggaaagagaaaggagcaggtggatggagatgacgtattatctggcggtggatatcggagcgtcgagcggacgacatatgctgtcccatctggaagacgggaagctggtattggaagaaatctatcgcttcccgaacggaatgacggagaagaacgggcacaaggtatgggatgtcgagcggctgtttgcggagattttaaacggcatgaagcagtgcgccagactggggaaaatcccgcacagcatggggattgatacctgggcggtggactatgtccttttggatgggcagggaagacgtatcggagatgcggcagcctaccgcgacggcaggacacagggcatggatgaaaaagtgtatgctcatatcacggaggaagaactctaccacagaacaggaatccaaaaacagatctttaacacgatctatcagctggctgcggtaagggagcagcatccaaaatggctggagcaggcggactgtctgctgatgatgccggattattttcattttcttctgaccgggaaaaaggtgcaggagtacaccaatgcgacgacgacccagctggttagtccggtgacaaaggactgggatgagcagctgatccggcagctgggctatccgagacggttgtttcaggagatccggatgccggggtatgaactggggagcctgcggggggagatccagaaagaagtgggattttcctgcaaggtgatcctgccgcccacacacgataccgcctcggcggtggcggcggtgccaacgcaggaggaagagacgctctatatcagctccggcacatggtcgctcatgggaaccgaacggatgacggcggattgcagcagtgcggcgagagcgcacaacatgacaaacgagggcggttacgactgccggttccgctatctgaaaaatatcatgggactctggatgatccagtctgtccgaaaggagagtgcgccggaacttgggtttggagagatctgtgcgcgcgccgcaaaggagacgattgcatcgcgtatcgacgtcaacgatgcgcgatttctggcgccggagaacatgacggaggaagtaaggagggcatgtcgggaagcgggggagcaggttccgcagaccatcggggaactggcggcggtcatctaccacagtcttgcgcagtgctatgccgggacggcagaggagatcgaggcgttgacgggaaaacagtacccagagattcacattgtgggaggcggcgcgaatgcgcagtatttaaaccggcttaccgcagaatacaccggaaagacggtcgaggcgggaccgacggaggcgacggcgctcggcaaccttgccgtgcagatgattgcggcgggagaatttgaagacctcagtgcggcgagagcatgcattgcggattcgtttgcaatggagaagtttgaaggagagaagggagaaacgagatgacaggttatgaagcagcaaaggcaaagtatgaggcacttggcgtggacacagaccgcgcgatcgagcggttgaaaaaggttccggtatcgctgcactgctggcagctggacgatgtgatcggatttgacaatgacggcggactcacaggtggaatccagacgaccggaaactatccggggcgcgccagaacgccgcagcagctgatggaggacatggaggaggcaatgaagctgatgccgggaacggcaaaattaaatattcatgcgtcctatgcgatttttgagccgggagaatttgcggaccgcgacgccttagagccgaagcattttgcaaagtgggtggaatttgcgaagaagcaccatatgggaattgatttcaacccaacatttttctcccacgaaaaagtaaaagacggacttaccttatcaagccccgatgaggagaccagaaagttctggatcaaccacggaaaggcatgcatccgcatctcagaatattttgcaaaggagaccggtatgccgtgcgtcatgaatatctggacgggggatggatttaaggatgttccggcagaccgtatgggaccgcgtctgcgctgcaaggattcgatcgagcagattttatccgaaccgtatgacagaaatctcgtcaagccgtgcgtggaatccaaggtattcggtatcggtgtggagtcctacaccgtgggttcggcagaatttacattgagcttcgccgcacagcatgaaggctgtatgccgctcatggacaacggacattatcatccgacggagtatgtttcggacaagattcctgccatgctctgtttttacccggagtttgcgcttcacattaccagaggcgtgcgatgggattcggatcatgtgctgctcttagatgacgagacaaaagagatggcaaaagagatcgtaagaaacgatgcgcttgaccgtgtatacatggcgttagattactttgatgcgagcatcaaccgtgtcctggcgcttgcaacaggctttcggagctggcagaaagccctgttaacggcactgtgcacgccgaatgaaatgttaaaggagctgcaggatacgaatcagctgggaaaactcatggttatgcatgaggcggtaaaaatgcttccgatcggcgagatctgggaggaatactgccgcagggaaggcgtgtgcgacgaccttcatttctacgacgagatcgagcgttacgagcgtgaggtactgaccaaaagaggataagcagatagaagctgaatcagagagaagagaggaagagaatcatgaaatttttggatgcagaatttgtacagggatttatccgcatggcaaacgacggatgggagcagggctggcatgagagaaacggcggaaacttatcttaccgcgtgaaaccggaggaagtggaagcggtgcgggagaactttcaggaaaaggagtggcagccgatcggcaccacggtgcccaatctggcaggagagtatttccttgtgaccggaagcggaaaatatttccgcaacgtcatcttaaagccggaagattcgatctgcatgattgagctggatgaaaagggcgagaactaccggatcgtgtggggactggtaaacggcggaagaccgacctcggagctgccgagccatctgatgaacctggaggtaaagaaactgcagaatccgaagtaccgcgtggtctatcacgcgcataccaccaatatcattgcgctgacgttcgtgcttccactggaggaccgtattttcacgagagaactctgggagatggcaacggaatgtccggtggtattcccggcgggtgtcggcgtggtgccgtggatggttccgggcggcagggagattgcggttgcgaccagcgagctgatgaaaaaatatgatcttgcgatctgggcgcatcacggcatgtttgctgccggcgaggactttgacttaacgttcggtctgatgcacaccgcagaaaaatccgcggagattctggtgaagacgctctccatgcgtccggataagctccagacgatacagccggatgacttcagacatctggcagaggattttcatgtgaccctgccggaagaattcctgtatgaaaaataaaagagaagcctgcctgcaggcataagaaaacccccgggcgcaatggaaaggtacgaaacctaggattgtcaaccgggggccttcttatggaattcttctgtctgattcatagaacctttctctaggcagtggcatcgaacgaatgaacatcatcctcctctgtcaccgtcattgcctgatgcagcagtgtggcgaacgaagaagaaggctgctgtttggaacgttgctgctttctgctctctggtgcaagccggtcgatccggtttactgggtgaacgggtaacacgaaaacactatcatagtagattgcgacaatcatcctccttgacaaataaatcacaactgataggggttaatgagttccttctctactatatatatcggctgacatcagaaataattaagagaaaatagagagaatattatttggaagaagcgtacacctgtgttaaaatattgctgtgaacagggggcacgttttttatgtcattacagtttgttttcggcaattccggaagcggaaagtccgattatttatatcagtccatactggaagaagcggagagggagccggagaagaattttcttttgcttgttccggaacaatttacgatgcagacgcagcgcgaacttgtgtggcgccagcccaatcatgccatcatgaacgtggatgtgctcagttttgtgcgtctggcgtaccgtgtgttcgacgatctcggaatgcaggatctggtcattttagaggagacgggcaagaatctggtgctgcgcaaggtggcggagcttaagaaaaaagaactctcggtgctcggtggcaatctcaacaaaatgggatacatcggtgagatcaagtccctgatctcggagatggcgcagtacaatatcacgccggaggatcttggtgcttttctcggcgggcaggatgtcggggataccctgcgctgtaagatgcaggatattcttacgatgtatgagggattccgggagtatattgatgggaaatacatcacggcggaggagattctgacactcttgtgtgaggtggcggaggaatccgagctcatcagggacagtgtgattgtctttgacgagtttacgggattcaccccgatccagaaccggctgcttcgggtgatgctgccgcttgccgatcgcgtcatcgtgtcgctctccatggatatccgggaggatttttaccacagcagaggtgtgcacgagcttttttccatgagcaaggagaccgtgcagacactgcttaagattgcggcggatgcgggatgcgaggtactctctccggtgatcatggagccgggagagcacaggcgctatgaaaatgcaccggagctgtttttcatggaacagaatctgttccgtccgatgtaccggaagtggccaaagccggttaatgacatcagcatcaccagcttaaaggatccgcgccaggagctttcttttgtcgcaagggagattgtgcgcctggtacggacaaagggctaccgttaccgggattttgcggtggtgaccggagacgtgccacagtatgccaactacgttccggagacgtttgcacagtacgggatcccgttttttatcgaccagacgagaaacattctgtttcacccgttcatcgagtttatccgcgcggcgcttgaggtcgtggagtttgatttctcctaccagagtgtgttccgcttccttcggagcggactggcgggacggtttctgacggagaataagacggagcagacggcagacgaggacggcgccaaagccaaagccggagccggggtgaatgatgaggacggcgctggagccggagtggtagacgaggacagtgttgaagtcaaagcaggatcggatgaggacggcgccaaagcctgggcggatgcagaggatgtgattgaccgcctggagaattatgtgcttgcaaagggaatccgcggcagaaagcgctggggcgagaaatggacgtccgtgatgaagcgggatgcccgccagccggaggcggcacaggaggagctggctcttttgaaccggttgcgggagaggatcgttctggcatttgagccgctgtgcggacttttttccgggaaaaaacacacggttgcggagcagacctacggactgtatgagtttatcacggcgctggatattgaagcgcagcttaaggagaagcagtttctcttagagcaggcggaggagacggagtacaacggcgtccgcaggaatcagaccagagcgcaggagtatggtcagatttataagatcgtgatggatcttttggacaaggtcacatcgctgctcggggaggagcagatgacgatccgggagtacggagatattctggacgcaggattttctgcggcaaaggtcggtatgattccgccgggaaatgaccgcgtgacggtcggagacattgaacgcaccagattaaatcatatccggattctgttctttgtgggagtcaatgacggtatcgtgccgaaagccggcagcaccggaagcatcatctcacagttcgagcgcgagaagatggcggagcatcatctgatgttagcgccgggggcgcgggaaagagtctttatccagaagttttatctttatctgaacttaaccaagccgtcggacggattgtatgtcacttactcaagggtcagcccggagggaaaggcgctgcgccggtcttatctgatcggaacgctctgcaatatgttcccggaactaaagatccgtgagccggaggaggagacggaggcgtccgcgattttaacgccggagagtgggatcgattatctgctggagggactctggacagaacaaaagtcgcatacttgggaggcacttgcgaagtggtatctctcggatgagacttatcatgcgaaggcgctgcgcctgcttgcggcatctttttaccgttacagcggagagccgatcggaaaagaggttgcgcgcgccttatacggcacggaactggagaacagtgtcacaaggctggagcagtttgcggagtgcgcgtttgcacattacatgacctacggactgggactgtcacagcgggaattacaggagtttgccggtgtggatatgggaaatatctatcatgacgcgctgtggcattttgcggagcgcatccgcaggtcttcgtatacctggtacgatctgcccgaacagacgcgtgaggcgtggattgaggagagcatgaatgacgcgattgcgggctgtgcgaatgtgggcgcattcgacgaggcgaagaaccgctatctgctgtcgcgcatgaaagacacgatccggcgcacggtgtgggcgctcacgatccaggtgcagaaggggcgttttacgccgagtgattttgaggtgtcgttttcgcaggccgatcatctggaggcaatccgctttcagctgacagaggaggaaaagatgcgtctgcggggcaggattgaccgtgtggatacctgtgagacggacgataaggtgtatgtaaagatcattgattacaaatcgggcaacactacattttccctgctgaatctgtatcacgggctgcagctgcagctggtggtttatatgaatgcggcgctcgaactggaggcaaaaaagcatccgggaaaacgggcggtgcctgcgggaatgttttactatcacattgaggatcccatggtcgacggcagcggtacggagtcggaggaggagatccggcaggccgtgctggaggaattaaagccgaacgggctggtcaatgacgatcccgagatatacggagcgatggacacagaactttccggaagctccgcagtcattcctgtggcgcttaaagcggacggttccttaaaagcgacgtccaagacggcgagtacggaagaatttgagacaatgtcggactacgtgaaggagaccgtgacgaaggcgggcagaagaatcctaggcggagatgtggcggcggcaccgtatgaactcgacgggagaagcggctgcgactattgtccgtatcacgtggtgtgcggatttgacgcgcggataccgggcttttcttaccggaagttagaaaagccggacggtgccgaggcgattcttgcgaaaatgagagagacgcgaagcgaggagaagagacagtagatgggtgtttcatggaccagagaacaacaacaggtaatcgatttaagaaagcgcaacattctggtatcggcagctgccggttcgggtaaaacggcggttttagtcgagcgcattatcaagatgatcacggagggagaacatccggtggacatcgaccggcttttggtggtgacgtttacgaatgcggctgcggcggaaatgcgggagcgcatcggggcggcgatcgagaaagcgctggaggagcatccggattcggagcatctgcaacgccagctgacgttaatccacaatgcgcagatcacgactatcgacagtttttgtctgtatgtgatccgcaatcatttccacgagattgacctggagccggattttcggatcggggacgagggagagttaaagctgttaaaagaagacgtgctgcgcggcgtgctggagagcaattacgaacagatgtcaccggagtttgcggcatttgcaaaagggtatgtgtcggggaagagcgatgcgaaggtggcggagatgatcctctcgctctacgagttctccatgagctatccgtggccgatggagtggcttacttccggcatccgtggctatgagatcccggatgtgcaaaagatggcggaggcgccgtggatgcagccgctcgtgctgcatctgcggtcggtgctggcggatctggtaaaaaagcttcgcatcgcgcatgtgcttacgctggaggaaaacggaccggatgtctatgagaaggtgatcgcgtcggatctcgcaaagtttgaggagctggcagcgtgtaaaaattttctggagctgtacgaaaagcttaccgccgtcacttatgacaggctgccgtcgagccgcggcttttcgggagatgcagggaagctttcgcgtgtgaaggaactccgcgaccaggtgaaggatacggtaaaaaagatcaacaaacagtatttcttcgcttcgccggaagtcatgtacgagcaggtgcgccgggcggagccgatggcgaaggagctggtgcgtcttgccatcgcattctccgaggcgtttgcagcggaaaagcgccgcaagaatctggtggattttcacgatctggagcatttcgcactggagattctcgtggatgcaaagacaaagcaggcgcgcgctgcggcggaggagttccgcgacatgtacgaggagatcatgatcgacgagtaccaggacagcaatcatgtgcaggagacgcttcttagggcgatctcaagagaggagcgcggagcgtacaacctgttcatggtgggggacgtcaagcagagtatctaccgcttccgtctggcgagaccggagctttttatggaaaaatacgatacctacacgctggaggaaagcagtacgcagcgcatcgatctgcacaggaatttccggagccggtcagaggtgcttgatctgacaaacgatgtgtgttaccggatcatggcgcgcgatctcggcaatgtggcatacgatgaggatgcggcgctctacgcgggcgcagattattgtgcgccggatgaggcagggatgtttgcaccggagattcttgtggcggacagtgccgaagaactcttagagggcagcgggtacgaagaccggaagctgtatgaggcgaagcttgtggcagagcgcatccggaagctgatgacagagcagaaggtgacggacaaggcgacgggggaactgcgcgccgtgcgttacagcgatattgtgattctgctccgcagcctaagcgggtatgccgattcgtttgccgccgtgttgaacgaggcgggaataccggcgcatacggtgtcagcaaccggctatttctcggcggtggaggtgcagacggtgcttgcgatgcttcggattcttgacaatccgagacaggatattccgcttgcggcagtgcttaagtctccgatcgccgggcttacggacgaggagctgggacggcttagggcgcacgaccgcagcgtgcctttctgtgagtgtgtgctcgcacgctgcagggaacttgcgcagagtgaagaacctttggtggaaggttatgagaaaaaactgtgggagttctggaagctgtatgagaggctgcgggcgcttgtgccggacaccccgattcacgagctgatcgagatcgtgttgaaggaaagcggctacggaaattatgcggcggcgatgccggcaggagccagacgcagagcgaatctgcgcatgctggtggagaaggcgatcgcctatgagaatacgagctacaagggattgtttcattttgtgcgctacatcgatgaactccagaaatacgatgtcgattttggcgaggcggacatggttggggagaatgaggacgtcgtgcgcattatgagtatccacaagagcaagggactggaattcccggtggtctttgtgtgcggtctgggaagaaattttaacaagcaggataccagaagccgcatggtgctgcacccggaactgggaatcggaattgactggatcgacggcgagcgcaggatcaagacgccgaccatattaaagcgcgccatcgcaaagcagatcgaactggagaatctgggtgaggagctccgcgtgctctatgtggcgctcacacgcgcgaaggagaagctgattttaacggggtgcagaaaagaggcagaaaatgatctggcggcgctaagggaagcggcacaggaggaacttttcccggaaacggagcatgttcctctgccgtatctgctccgggagagcgcggcaggctatttcgactggctgcttccggcggtgttttcctatcacggacgctatcaggtgcgcgttgtgccggcggaggaactgctcgacgcagagagccgtcacatggaggaggagacggagaatctggaacagtgtctgtcacgcattgcagcggcggatgcggcagacgtggcggaatttgacgggaagttttcattcacctatccgtacgaacgcgatctggagcgcaaaaacaaatattccgtgtcggaattaaagcatcgggcgatgcgggaaaagcttctggaggaggagacggatgttgtcccggcgtttttagagacggagggaaaatcctatgttccgccgtttgtccaaaaaaaaatggagcaggaagaaaccggcggacagaaccagggtgcactgcgcggaactgcggttcacagggtgatggagtgctaccagttttcggcggcggcaggagtcacggaacagattgaggcgatgcttgccggaggacagatcacggaggagatgaagcgcctggtaaaaccggctctcatcgagacgtttctcacatcggcggcgggagagcggatgaagcgtgcggagactgccggaacgctgtaccgggagaaaccgtttgtgatgggatttacgggcgaagagctcgctgcgtttggattcggagacggggaagacagtgcggatgacaaagagctgacgctgatccagggaattattgatgtgttctggattgaggaggacggcattgtggtgctggactataagacggaccgtgtgaaaaccggcaaggaactggcggaccgttatgcttcgcagttaaagctctacggcgaggcgctggagcggatctacaaccacggaagtgagaggacgcttcgcgtgaaggagcggcttctctactcgttccggctgggcgcagtgataccggtgtaacgtaaatggaacataagaaacgatagatttcagagataagaacatcagaaaggaagaaaaagagatgggacagatcatactggcatccgcctcaccgcggagaaaggaattgttagagcagatcgggatttcgtttgaaatctgcccggccaaaggtgaggagcggatcacgaagagcgtaccgcacgaagtcgtggaggaactggcgtcgcagaaggccatcgaggtggcatccatggtaagaacctacgaggagacgcatcaggaactggtgacaccctcggatcttatggtgatcggcgccgacacgattgtctcctgcgggggacagatcttagggaagcccaaagacgagcgtgatgcctgccgcatgcttaagcttctctccggcggcacacaccaggtatacaccggagtgtcgatcgtgcttttggatgcgtccggaaaggccggtcaggtgacgtttcatgagaaaaccgatgtcacgatgcgcgcgatgagcgaggaggagatccggcgctatgtcgccaccggcgagccgatggacaaggcgggcgcatacggaattcaggggaaatgtgcgatttttgttgacaaaatcgatggcgactataataatgttgtagggcttccggtagcagccatttaccgggaattaaagaagcttggaattgatatctatttatggtaaaataaaacgttggcggaggaaaagatatgtacgatgaaatgtgcctggatacatttttggcgcagcaggagaagctgtttcgggaacctgtggcagaaagcagggaagaggcggaggaatttctttcggactgtttcgcaacggtctgtgagaatctgaaggaagtgcgggcgtactttaaggaagagggtgcggatatcgccggaatgagcagcgaggatctggcggagcaggcagaagtgttcgcactgccggacggaagatacctgatcgtggaagcttaagccgtctgctttggagaacgcaggaagatacataacagaatggtagaatacatagaaagaacgagggaatgtaatgaagaattatgatgtgatcattataggagccggtccttccggaattttttgtgcgtatgagctgattcatgcgaaaaaggatctgaaagtattaatgattgaaaaaggaagacggattgagaaccgtgaatgtccgaagcgtaagaccaaggtgtgcgtgggatgcaagccgtgttccatcacgaccggattcgccggtgcgggagctttttccgatggcaagctgtccttatctccggatgtcggcggcaacctgccggagattttaggctatgacaagacggtggaactcttaaaggaatcggatgacatctatctgaaattcggtgcggattccaaggtgtacggtgtggataaagagaaggaaatccgcgagatccgtagaaaagcgatcatggcgaacttaaagctgatcgaatgcccgatccgtcatctcggcacggaggaaggctacaagatctactccagactgcaggagcacctgttagaggaaggggtcgagatggagtttggcaccatggtcaaggacatcatcatcgaggacaaccaggtcaagggtgtcatcaccgacaaggatgagacatacacggcagcagaggtcatctccgccgtgggacgtgagggcgcagactggttctcccatatctgcaatcagcatgatattgagacgaaggtcggcactgtggacatcggtgtgcgtgtcgaggtgcgtgatgaggtgatggaatttttaaatgagaacctctacgaggcgaagttagtgtaccatacgccgacgttcgatgataaggtgcgtaccttctgtaccaatccgtccggtgaggttgcaaccgaatactacgacaacggactggcggtggtcaacggacacgcctacaagtccaaggatttaaagaccaacaataccaactttgccattctggtatcgaagaatttcacgaagccttttaagacgccgatcgaatacggcaagcagatcgcacagctctccaatatgctctgtgacggcaagatactggtgcagacattcggagactttaaacgcggcagaagaacgacggaggaacgcctgtgccgcaacaacctcatcccgaccttaaaggatgcggtaccgggagatctttccctggtattcccgcaccggatcatggtggatatcgaggagatgctgatggctctcgataaggtaacgccgggtattgcaagtgatgagacgctgctctacggtgtggaggtcaagttctactccaataaggtagtggtgaattctgactttgagacgagtgtcaagggactccgtgcgatcggggacggcgcgtccgtgaccagaggactgcagcaggcatccgcgaacggaatttccgtggcgagaagtatcttgaaaaatatcatgtagacgttgagataaagggtgtttcacgatgagaaaaagatgggcgatgggaatgacagcgtgcgcatgcgcgctgtcaatggctcttacgggatgccagattggcaataaagatattgtggtctcgggaacgttaagcagcaggcaggtgtttacactggacaagtctgcatgcagcttaaaggaggcaaaggtatatctggcaaattatcagaatatctatggaacagcatatacgattgacctctggcagcacgatttcggagacgcatccctgcttgaatatgtgaaggacatcacgctggaggagctcacccgtgtatacacgatggatctgctggcacagtcgcaggaagtgacgctctctgaggatgagactgcgaaggtggcggaagcagcgaaggaatattatgcatccctctcggaggatgagaccgcctatatggacgtcgccgaggcggatattgcggagtattatacgcactatgcgctggcgcagaagctgtatcattcgctgacgaacggtgtcaacgaggaggtcagcgacgatgaggcgcgcgtgatggaaatcatgcagatttatgtcacggacgaagaccgggcgcacgaggtggagcagaagctggcgcagggggatgattttgcctccgtcgccaacaattataacgaattgtcggcgattcaggtgacggtatcgagggatgatctgcccgacgaggtggaggaggtggcatttcagctggacgacaatgccgtctccggaatgatcgctgccggaaatggatactattttatcaagtgcctgaataaatataatgaagagctgacggaagcgaataagtccaacattgtggaaaagcgcgaaaaagaagcatttgacgatgtctacaatgaatttgttgcatccctgtcctcgaggctgaacacggatctgtgggatggaattgagcttatcacggatggcagtattcagacaaacagcttttttgcagtatttgagaagtattgtggtgagatctgagatacagtatgaaatgaggtagattctatgacgaaagatatgacaagcggttcaccgatgaaactcattttaggattttcggtgcctctgttgtttggatttttgtttcagcagttttataatcttgtggatactctgatcgtcggaagatttctgggcgtggatgcacttgcggcagtgggatcgaccggttcgctgaactttctgattattggattctgcatgggagtgtgcaatggttttgccattcctctggcgcaccggtttggagccggtgattataaggcaatgcgtgcgtttatgatgaatgctgtctatctggcggtgatctttgcggcggtcatgacggtgtttacggtggcattctgccggccgatcttacagctgatgcagacgccggagaatattattgatgatgcctacacctacattgtcattatttttgcgggaattccggcaacctatctgtacaatctggtgtccggcgtgataaggtcgatgggcgacagcaagacgcctctgattttcctggcgctggctgcatttgtgaatatcggactggatctgcttttaatcattgtatttccgatgggagttgccggagcagcgcttgcaactgtgatctcgcaggcattttccggtatcgcgtgcgtcatctacagcaagagaaagtttgagatcctgcacaccgatgaggaagagcggaaagtgaataagggctacatgaaaaccctctgcggcatgggtgtgccgatgggattacagtattcgatcactgcgatcggcagcgtaatcctacagagcgcagtcaacacgctcggatcgaatgccgtggcatccatgacggcgggaagcaagatcggtatgttcttctgctgcccgtatgatgcgctcggttctacaatggcaacctacggcggacagaacgtgggagcgaagaagttagaccgcttgagcggcggattaaaagcggcgggaattctgggaatcggatattcgattctggcgtttgtggtgttgtggctttgcggcaatcatcttgccatgtttttcgtggagagtgcgcaggcggaggtcattgcaaatgtaaggctgtttctggtatgcaacagtgccttctacattccgttggcttttgtgaatattgtgcggtttttgattcagggtatgggatacagcaagtttgcaattctggcaggcgtctttgagatggcggcgcgtactttggtcggatttgtatttgttccgatgttcggctatccggcagcgtgctttgcaagcccggtcgcatggatttttgctgactgtttcctgttcccggcatatttccatgtgttgaagaagacgaagaaaatgttgagcgagcctgtccgcacgagcgtggcatagcatgtatgtatggtaccggctgagggtggcatgacatgtctgcatggtaccggctgagcgtggcatggcagcggctgatgcatagcagttatgagaagaatggagtatttatgacagagattttaaaggcaattatatttggtattgtagaaggaattacggagtggctgccgatcagcagcaccggacatatgatcctcttaaacgagtttctgacactggatgtaagcgcacagttctgggatatgtttctggtagtgatccagctgggagcgattttggcggtcgtggtgctgttctggaatctgatctggccgtttgcacgcagttcctcagaagcggtcgtggccgcagaacagaatgagaagagcggttcccttgtaaaaagggaatactgggtgttaggtcccgtcacggtgcgcatgccggtcattatcaactggtgcaagatcgtggtgtcctgcctgccggcaatcgtatttgttgtgctggggctggatgagacctgcgacagactgttttacaatccggtgtgtgtggcggtggcactgattgtgttcggtgttgcctttattctggtggagaatcacaatgcagcaaagcaggcgcgtgtggagcagatgcgggacattacgtttcagatggcgattctgatcggtttgttccagctgctcgcggctgcgtttccgggaacgtcgcgctccggtgcaacgattatcggtgcgctcttaatcggtgtgtcaaggaaggctgcgagtgagtttacgttcattctggcgattccggtgatgctcggtgcaagcctgctaaaattgatggatttcggacttcatctgaccgggacggagtgggcggttctgctttccggtatggtcagcgcgtttctggtgtcggttgtcgtcatcaagttcctgctcggatatatcagaaagcatgactttaaagtgtttggctggtaccgcattgtgctcggcgtggtggtgcttttgtacttttttctgctgaaatagaggtgacggatgagtattttaaatgtagaacacttgacgcatggattcggtgaccgtgcgattctggacgatgtgtccttccgtctgttaaagggggagcatatcggtcttgtcggagcgaacggcgagggaaagtcgacgtttctaaatatcgttacgggaaagctgatgccggacgagggaaaagtggagtgggcgaaaaatgtgcgggtcggttacctcgaccagcactcgacactcaccgcgggaatgacgattgagagtgtcttaaagtcagcattttcgtggctgtttgcgttggaagagaagatgaatcagatctgtgatgcgctcggcgaggcagacgagtcgcagatggatgccatgatggaagaactcggcgtgatacaggacaccctgacgatgcatgatttttacacgatcgacgcaaaggtggaggaggttgccagagcgctcggactcttagaactcgggctgcaccatgatgtgaccgatctaagcggcgggcagcgcatgaaggtgctgctggcaaagcttcttctggagaagccggacattcttctgctggacgagccgacgaactatctggacgcggagcatatcgcgtggctgacacgctatctgcaggagtacgagaatgcgtttatcctgatctcgcacgacattccgtttttgaacgatgttgtcaatatcatctaccacatggagaaccagcacctcgaccgctatgtcggcaactacgacaagtttgaggaagtctacgcggtaaaaaaggcacagcttgaggcggcataccgcaaacagcagcaggagatcagtgaattaaaggatttcgtggcgcgcaataaggcgcgcgtatccacccgcaacatggcgatgtcgcggcagaaaaagctggacaagatggacgtcatcgagcttgcggcggagcgcccgaagccagagttttccttcccggtgggacgcacgcccggcagatatatttttgagacgaaggagctggtgatcggctatgaggagccgctctcgaagccgctttcgatcgcactggaacgcggacataaggtggcgctgatcggtgcaaacggaatcggcaagacaacacttttaaagagtctactaggtctgattcccgcgcttggcggcggtgtcgagcagggcgagaacctcatgatcggctactttgagcaggagatcaagggggagaacaagcgcacctgcattgaggagatctgggaggagttcccggcattttcccagtatgaggtgcgtgcggcgcttgcaagatgcggtctgaccacaaagcatatcgagagccaggtgagagtcttaagcggcggcgagcaggcgaaggtgcggttgtgtaaactgatgaaccgagagaccaacgttctgcttttagacgagccgaccaaccatctggatgtggacgcgaaggaagaattaaagcgtgcgctgaaggagtaccgcggaacggttctgttaatctgccatgagccggagttttaccaggatatcgtgggagaggtctgggactgctcgaagtggacgacgaagattctctgataagaggccggcagaatgacatgagggggaacgaaatgaagcccgattattatgatgagtttcaatgcatcgcggatgcgtgcagtctgacatgctgtcaggaatggaagattgcggtggaccgtaagacggctgccgcatggaaaaaaacagaaacgccggaaggggtccgtccgaaaagacggaccttatctgattatacaaaaaaatgcggggatggacgaatcattacgctcgatgaaaaaatgcgctgtccgtttctggatgagagaaagctctgccggctggttttaacctacggggatgcggttttgtcggagacctgtacggtgtttccgcgcgagaaacatgaggtggcggcggggatcacggaatattctctgatgccctgctgtccggcggtcgtggatctgctttgggggcgggagtgcatccggttttcggatgaggcagacagtgcctcctacggcgcatatgaagcggtgtatggggtgagaaaacattttctcacaattatggcagaccgtgtgtaccggccggcacagagtcttggcatgatcttttacatggcgcttgatctgtgcgacgcgggaacttcctggaaggcggaagtccccaaatacggggatgcgccttttagaaaagaacttgccggggcggtggagcatgccggagcggattgccgggcggcatttgtggagcgcaatgagctgtttttggatctggcggagaactaccggaaggaagggctgtatcgtgccttcttaacaccggcggcagaggaagcggaacagatcgcggaagattacgggaagatccgtaaggaagatctcgatgcatttgcgcaggcattttctccatatgaggcactgatgcggtgctatctgcagtcagagattttttcggagtgtctgggggagccggacgacgtcgagtatgtgacggtaaagctgcagtggattgcattagagtatgcagccatccggcatgccgcttttctgtgctggcacagggaaggcgcactttcctatgagaccatgcgcagctgtatggtaattctgtcgcgcatgctgggatatgaagacgaggatatctgggaatacctggagaacagttttgaacggctgatctgggactggggatattttgcccttgttgtctcgtaaaatgagatgccctgcgtgtttgcttatgtgtgataaagaagcaatagaagtgtaaaaaattttgccgttcctatccgatacttgcctttggtatcggatagggcgggcggtcattcgggcaagtccaccttgccaacgaaagaatagtaaatctcaatgtcctgtctgcgtgtgccgtttgcgtcatagctgcactcatgcacaacgattttctctacaaactcacgcaagagggtatgggtcagttcttcaaagttcatgtgcttgcggacaatgttcataaacttttctgcgtttacggtggcttcctgcgctttagaaagctccgcctgtattctggcaacacgctctttcaattcctgctgttcggcttcgtagtctgccgaaagctctgtgaaacgctcgtcagaaatgcgtccgcttacgctgtcctcatacagccgcttgaaaatggcggaaagctcaccgatacacttttcagcggcttccaactcctttttcttggcggcgttccggcgtttgtcgccgtcctcgttctgctcgatcagcagcttcataaaccgggcttcatgctttgccgcatagctcgtcacttttcgcagattggagagaacgcccgcagtcaaaaggtcggtgcggataaaatgagcggtgcagtcatgggtacgcttcttgtaattcccacagatatagcagtcctgtttccgcttatcagtctggtaacgctgctgatacatgacgctgccgcagtctgcgcaaaagagcataccagagaacaagcccacttcatcataacggttaggacgcttgcgctgtttgcgtaattcctgcacacgctcccatgtctgggtgtcaatgataggctcatggtggttctcgaaaatcgcctgtttctcaatgggattttctacgctgtgcttagtcttataggacggtttctccgtcttgaagttcaccagacagcccatgtactcccggttttcaaggatatgcaccacggtatttgtcgcccatttgcactcatagccggggtgatagcggcgtgtgctgcccgtcctgcggtattccagcgttcccggcgttgggatttcctgctcggtcagcatacgggctatcttggtcggaccgttcccggcaaggcacagacggtatatctgcttgaccacgggtgcggcttcctcgtcaatgatgaaattttcgtcctcgtccatgaggtagccatacacgggtttgctcgtaacaggcttgccgctcataccttttgaccgttttacagctttgattttcttgctcgtatctctcaccagccattcgttgaaaatgttccgcagaggggcaaaatcgttatcgccctgtgcgctgtccactccatcgttgatggcgataaagcggacgcctttttgtgggaaaatcatctcggtatacattcccacctgcaagtagtttcgccctaaccgtgacatatcctttacgataacggtagccacttttccggcttcaatgtctgcaagcatggattgaaagcccggtctttggaagttcgcaccagaatagccatcgtccgtgtaccagcgcagattggaaaaaccgttctgctttgcgtaggtttcaagaatacgcttctggttggaaatggaattgctttcgccttgcaactcgtcctcatgggatagtcttggataaagggcagtgattttctgggtggtctgtcttaacataaaatcctccgtttccgacagccagccccactattccgtatttcgattataccacattgggcggctgtctgtatagcggcttctgcttctttaccgcccggtaaaatgacgattttttctgtgcggcttgtagcgttagggcgaaagctgggctttgtgtcctgcggcggcttccgcctccagcactttcatcatcttatcggctgcggtgtcggtggtatctttcttgaaaaagccggaaacgacaaggacggtgttgcccatgcggatctctgtcacgcagtccgggcggcgttccggggtggtgttctgcttgttctctgccataggcaactcctttcatttcatcaattctttcagcctgttcagcttggcttgcgccgtttcacggcggaagttctcccctgtaaaaaggataggggcgcacatttccaaaaggcggtcataaatccgggcatgggcggtgtccagcggattttgcaggctgtccaatgtcagattggtagtgacgatcaggggcttgcggctgcggtagcggctgtcaatcacattgtagacctgttctaaaccgtactctgtgccgcgttccattccaaaatcatcaatgataagcagaggaaaacggcaaagacgctcgatatactcgttgcgcccctcaaagctggcggtcaggtcattcaaaatcgcagagaagttcgtcatgcggacagcgacttcttgctccatgagggcattagcgatacacccggcaaaatagcttttccctgtgccgactttgccccatagcagatagccgatattttcctctcgcatggtttcccaatgctccacatagaagtgtgcaatctccatttgtgtgcatttcccgttatcattagcgaaagtccattcctgcatggtgggattggtaaatccccggcgtttcaagtcctccacggtatcaaggtgttttctgcgttgctcggcggcttcacgctccaaacgctgggctttctggcagtcacattctgccgggtggcggtcacgcccaaacagggcggcttgcttttccgggaagtaggcttctttcggggtgtggcacttgccacagtaaagcagcccgtcctcgcccgtgtagtcctccgggtgcggggtatcagccgccatattcaaaactcgttccgtaaacagattgctcataagctctcgccctccttgcaggtatattcgggtatgccctgtttcggggcagcctttgcggtatcgtctgccgcccatctgtggatagtggcggcgtggtttttgtatttcttgcctgtggacgcaatatagccggaaagccgctcaatgtagtacgcccatttttcgggcagctccgcttgcagttcggaaagctccgtatcggtcagaaatacattctcatatctgccgtagctgtgggcgggggcttgtccctttaactctccctctttttctaactctatatctatctctttctttatctctatctctggtggacgaatgtcggacaaatgtccgccatttgtccgcggcggcaaaagtgccttgttttcaagccttgcggcgcgtttccgttccgctttggtagaggattgaccgatcatcagctcgatgtcggtcatataaagcatcccgcagtcaagctgctccacaagccccaactgctggaagatggataatgcccgttccaccgtcccgatttggtgacgggtcagcgtggctatcatctgggcggtataggggatatgctcgtcaagctgcaatctgccgccatttttcagcgattttaagtacagctttaagagaatattggaatacaaaattccgtctttcatgtcctccaacagcacaatggagtcgctgtcaaagaagttttctttcagtttaaggtagtaatatttgcggttatctgccattggcggtgtcctccctgtgtttccatctcttagagaaataccgggggcagaggacgataatcgcccggaagctctgcttgcagccgtgtgtgcagccccggcaaaggtcattgtaggtgatacggtttcggtggttgaggaaaaagctccattccaaccgccgctttttgctcatgcgcggcatttctcgctcctttctgccgtttccgctggtataagcggatagggcggtaaaaatgtagtttcttggtgtcattttcggggatttcctgcgctgtgcgccccgtttcaaaggtgggtagtatgcggatagggtgcagggcatatccccgttttggtatcgtttgggggcggtttttaacgctcctgttcgtgccgtttctgtcggctcggctctccgtgctgcatttgggagagattgcttttcatggtttgtagctctcggacacgcgctttatttgcccgatactcgttataaagggcgtttttctcggcggtaagctgctcgatttccgcttgcagcgccttgtaggtaggcagcttggtaacgcctttttgcttgaaataccgggtggctgcgtccgctatgataaagtcgctctcatgcttttcccgataggcgcggcgtgccttatcggatttctgctttttcagcccgtcccgcacatcacgggtcttagcataggcaagcacctgtttctgcaactcctttttctcgcagattgccgtttcaatgggcttcagcttggcgctgctgcgctgcaagtccgcattggcagatacaagggctgcgtccagttcctccggggtaaagccgtactgctccatagcggcaacggtagccgccatctgtttgaggttgtggacagccgctcaacggtcatagccgatgccttttccctcggctcgttttgcggaacggtcaaccattttctgaatggtacttgtcggggtgattttctgcgttttccctcgccctgtgcggtttgtttctgtggtgtggtattcgggtatggggacagtctgttcggcggctctgtaggcgttctgctccaaaaaggcgagaacggcagcacggtcaaaatcatctcccagctttcgggcggtaacgggcttcgtcctgtccggggtgaggtaggaaagccgtccccggctttctttcacggtcacaccctgccggagaagtaaagcggaaaactcgtcaaaggtggcggcttcacgcatggcatcccgtatggcctgccgcagcttcgccttgtcggtttcaaatttggtctgctttacgggctgtccggcggcaagcgcagcagcgttttctttgtcaagggcaagctgccctttcttctgcgcccaatactcacgctcggtcacgcggtttttgctgccatggagcaggtcgatttgatagagattttccctgtggcacatctccatgatttcggctttgaagtattccatcgcagcgtccgtacagcggtgcttacacccggcgcgggtatctgccggtctgtccatgtagggcagcaaggggacttcctcgatccgcagggaattgataacgatgtggacatgaatattgccgctgtggttgtgtccgtccggatgggtgcagacaatggcttgatgaccggaaaaatgctcggcacaaaattcctctcccaatgcctgcgcccaatctacggtcaaaccgttgtccgggccgtcccgtgggtcaaaggaaatgatatagtggtggcttttcacatcttcccgcttttgatttttgccgtagcggagattggagcgcatacaggcaacggcaaaatcttcttcgccgcagttcagcgtggcgattcggtaattctccctcggcacaagacgacccgcttcatcaagggtgggcttcatggtaaactcgtcatgctcaaaggtcagatattgctcggctgcaccgtaatcagcatttttagagctgatatgcttgaatgttgccaacagcgtcacctacctttcgcaggacttcaaacttcaaggcggcaaggtcggaaatggcggcgcggacttcaacggacagcgcgttataaggtgttccgtattcgttgagaaagcgggcgatctgattgaggttgccgccgatcctgccgtattcggcggtcagcctgccgacagcggacagcagctcatcattgaccggggacacggtaacaatggggcgaatggttgcccgtgtaatggcttgccggataaactcggcttggctcatgtcatagtgtttcagccgctcggtgaagtcggcatattcttcctcggtcatgcgggttttgaccacatggctgcggtggggcgtgttgtattttttcttcaagcgttgacctcctttctcgcccgacagggcgcatgagcagggtttggggaaggcactcccaaacaagatttaccaaagggggcaaaaccgcagatatgcagattttggcaccgtggtagaatcttgctctaaaaaactgccgctttcctcggcggctctggtttgcggatatactggcttgttccaccaatatagcgattgcagcggcgtgttctgcccgctgttcaccactacaacggtgaaaagggtgcgttttggcaaatgcagcggaaatttttttgttttccctgtctgctccctacaacaatccggtggtgtggtttgccaaagatttttgaaaatgggcgcaaaaaagcagcaaacctttttcaagatttactgcttatatgccgctgtgatgggcggcggtattgcggtattaaattatcagcggtcaaagcggaacttcaacagactttctatcagtcgcccgacgatatgctcctgcatatccgtgttgatctgtccgtccattttcgcacaagagcggatatatccggcataatgggatagaacggcggcaacagcttccgggtcgccctcgcttgccttaacgattgtttcatagggaagtagctggctcataggacaagccctccaactttgcccgtagctgccgcaaaatcatctgaatacgccgcccggttgtgttgcctgaccgtccatatctctgcccaatctctctatgcgtccatcgttggaagtagtataggaaaatgatttcctgttccatctgtgatagtgcggacagagctgtggcaagctctggactttccaaaagcaccatctgaccgcagacgaaaaaaggatagctgttcatggcagcttgctccgcaaaatacttatctatggtactgaatggatagtgcttttcttctatcagatattcaagtgagatttcccgcttgcggcggctgcgtatgcttcgggctgcgtctatggcagcatgccgaatgacggtcttgcaaaaaacatcgtgtgtatgccggatatgctcttgatacttttcgtgttcggtcatggaaaatccccctttctaaataatggcagagagcgtcagcattttgtgctgtcgccctcttgattaccgaacagcaaagacgggcggggctgtcaacggcggcgcttttgcgccgttcatcttgaccgttgacaggctcggctgggtttgctacaaattctatctctttatgatttgtcggaaaaactccttacccaaacaaaaactacaatcgcggttgcaatgagtaattccgcaagaattacagaagcattccatatttcaaaatagaaatgcccaatgaaatagaccgcaaaaaaaatcaaataaattccaatcgaatacataatatttttggaaatttgagtgcgtttctgttccctaactaacatctgtttctgttgttgttccagaatttctgttttaaccgataattcatctatctctgatggttttaacagataatccacggtaacgtcgaatactttgcttagttcaacaatcttttctacttcgggtatgacctgcccactttcccattttgaaatagattgtcttgaaacattaagctgctcagccagttgttcctgtgttaattctctacttttgcgtagtgttataagtttttctgcgaactccatatgtgttcctccttttgattttgtgtataaatcttatcaaaatactcatttgcactctagcaagtaagctatacaattacatgacaaacggtagagtttaagtgctttcttgtatatcttgattgtcattctactttatatgcctattttagcatagaaaaaacgttttctctattactccattattttacggaatagtgggctgtctttctttattttagttgtgttactttatcacacatgagcatcagggcatctcatcaaacggatggagatgatgctccttcaggtaggagacagatgctgcaagatcctcatagctgcgcacctcaattaacagtgtgaaaattgtgtgaaagagaaggaatttccagatagaaaaagcaggacggggcgtgaaattcacctgcataaagtgaatttcgcgccccatcctgccgtctgtgagaagacgaattgatttatttggcaagaagcatcatgatcttgttgctgcgctccacgaacttgctcatggcatcgacggacaacggttggttggacagcattgccaggtcatagagctgctcgcagaacatcggaacgttctcggaatccttgtgctcgaaaatgtatttgaccagtgcatggttcgcgtttaaggttaaggtctggtctgcggcgaacatattcgggtccataccgcccatgccgcccatagcgtacatcttcatcatatcctgcatacgtctgccttcctcggagagagtgatgatggaagcaagattctcattctttaacttctccaccttgacggtcagcttgtcgttgccaagtgcctttttaaacaggtcggtcagcgtgtcggtctcttcctttaaatcagcggcatcgtctgcatcctttaaggagtctgtgacatccgcatcgattcgcatgaatttataatgctcgttgcgttgctctaactgggagatgaaggaggtatcgatgttgtggtctaagatcacagcgtccattccctgctccttgaagagcttgatgtactgtccctgctgtaccttgtcggtcacgtagtagatgaccttgcgctcgtccttttcctcttcggaatcgtcctttgcatcagcatcctctgtgacggaattgccgttcttgtcaacaacatcggaagcagcatcggcgtcttcctttttctcctcttcttttacgagaagctccggaagggtaaggtacttgtcatccagatttttaaagaggatatagtcgttcatcttgtcgcagaacttggtgtcttttaagcagccgtatttgatgaacggactgatgtcatcccagtatttctcgtaggattccttgtctgtcttgcacatgccgatcagcttgtcagccactttcttcgtgatatattcctcaatcttcttgacgaatccgtcattctgcagagcggagcgggagacattgagcggaagatccggacaatcgatcacaccctttaagagcatcagaaattccggaatgacttccttgatattatcggcgataaatacctgattgttgtataatttgatggttccctcgatggaatcgtactctgtattgatcttcgggaagtaaaggataccctttaagttgaacggataatccatattcaagtgaatccagaacagcggctccttgtaatctaagaataccttgcggtagaacgccttgtattcctcgtcggtgcagtcgttcgggttcttaagccacagcgggttagtgtcgttgagcggaaccgggcgttttaaaatctttaacttatccttggcaggggagatctcgacagtctccttctcaccgttctcgttctctttttcctcggtctttgcctcctcgtgaatctcctccacgaccgtatcggtatcgcgcttgtcagcagcgtcgatggtctcgtattccggctcggcatttgccttgctaaggtagatctcggtcggcatgaaagagcagtatttctcgatcacttcgcgtgcacggtactcgtttgcaaattcgagacagtcctcgttcagatgaagcgtgatctgtgtaccgatcgttgtcttggtgccgtcggtcagttcgtaatcggtaccgccgtcgcaggtccagtgtaccggtgtggcgccttccttataagataaggtatcgatctcaacctcgtccgctaccatgaaagcggagtagaagcccagtccgaaatgtccgatgatctgatcgtccgtggacttgtccttgtacttctgaatgaaatcggtcgcaccggaaaatgcgatctggcagatgtattcctcgacttcgtctgccgtcataccaagaccgttatcggtaaatgtcagggtcttagcctcagggtctacggtgacgctgatctttgccttgaaatcagctgggagcgtgtactcgcccatcatgtctaacttttttaatttggtaatggcatcacagccgttgctgatcaactcacgatagaaaatgtcgtggtcggaatacagccatttcttgataatcggaaacaggttatcgctgtcaattgaaagacttccatgtttgtttgccataataaaacactcctttatctaaaaataaaatatgtacggtagaacggaagacgacagtaacatcgtcattcccttttaaataagagtttatatccgtcattccaaaaagtcaatacaaaatcagcactcttttcacatgagtgctaacaacattcccggaaggctgaaaaacagggaaacagcggaattattaaaagtttataaagtgaggggatggtttcttgaaaaaaaatattttttgcatgcgagatttgaaaaacgcctcatatatgagtatactgttggtagaaagcgatggatgagaagtgaggttgcgtctatgatactgttgagagcaaatacggaattgcaccagacatttgaacgcctgattgaggcgatgaaagttccggtcaaatggaacggcatatttgtagtgattgacaattacatgattttacagggggaggtgcgttccctgtttttccattttgacacgcgcaatgtggcgacgaacatcatcgacataccggtaaaagaggacgagatcggtgaggtcggcacgaacatgcgggtgcagaatgccatcaacctgattttatatgcattcggaaaatgggggacgatcaagggcgtccgcgtagacaaaagttttgaacagttaaatacgctgtttacggacattatgaaggagatgcaggtcgaaccggagtacacgccgtcctatctgcgtttctaccggagcggaatgcggatcacctatgaggatgttatccagacggcgcaggaagaggagcaggcacagccggaggatgaggaaacgaacgagggcggactctggcacaaggtcgtctggaaacgcgctcaggcggagttcgcccgggcggacatcacggtgagcgagcggagaaagagccggatcgggaataatttttacctcgtggggtatctctgcccggcatgctgcggcaagctgcatatggcggtctatccggctggaaaggaatttaagatcgagacggaggagggcggcgtgctgctggcgagagccgcgacctgcaatgcctgcaggcggttttacacgccgcgtcccggcagattgttctcggagggcgatatttacacgctggattttgcgacggacgacgcggcgtatgacgattatctggagcttttggggagaaatgccgaccgggtgtccaactatcacacgaatgtctatgccgacggaagacggccggatacggaggaggacggggaggaatccctggaggatctctgcaacgcactgccggaattgtcggatcttgaggtgaaaaagctgtccgcgcggatggaggagggcttttatccggaagaatccgtggaaaaatacgaggcaaaagtgcacagccgggagagagagcggcacgacgagggacgctctttgccgcagcgggaacaggcagcggaagaaccggataagcagtctggaacgcggacaccgaaagagacggcgaagcagtcagcggggcggaaggagacagacagcgtagggagtggacgaccggcagaccgcggacgcggtatggctgcagagacggaaacgcgcagagcagaccacagagcggcggaggcagaaatgcatggagcagatcgcagagcggcggaggcaggaagcagcctgcgtccggacgcggatggagcgggcagacccgccgctaaggagcggacaggcggaaaagacatccatgcggcaacgcagacgccggagggaggaatgaccgtggacggcgtcattgtcacaccggaagaacggaaaagcgtgcaggagcactatgaggcgcgtctggcggtcatggaccgctattccgaccggcagctgcaggagttaaagcggcagctggaaggagagcgcaagctgacggaggacgagaagaagccatatataaagaagatacaggaccggatttatgaggggcgtgtccgggaacttcaggaaaaagcggatgcctgtgaggggaagaactacacgctgaccaaacgggtattggaggaagtggaagctgcggatcttccggaagaacagaagcatccgctgcgggagaagctgcagcagctcaaacagagccaggcggagcgcgaagtggcggcgatggtggcaaagatgccggcgaatctcgaccggaagcagtaccggctctatgtcgaccggctgcacgattacgacggagtggatctgacaccatacgaacagaagattgtggcggggagagaggcagcggagaagcaggaactttccaacatgatccggcgcgcgagaaaagtgagcagggaggactacgtggatcttgcagagcggcttagggagggagattttcttccggggcttgtggcaccctatctggagaaggtcaacgaccggatcagggagctggatgcggatgccatcgcagcaatctgtccggcaccgatgcagatgaattttgaggagggcatagaggcataccagaagatcaaggagggagattttctcccggagcttaagacggatgcgcttaagacgctcgaaaagcggctctccaaaatcaaggcggacgagtgtgagcttctggtgggaaagctgaaaaaagaactggaggagaacggtgtcggggagaatccgagacatcatttttatccggcgaggaaagtgctgcttgggcaggcgacgccggaggagacggatgtgatcgaatatgccatggcgtcctatgcggccggcagaggtctgtttgagtacccgattctggtggtggatgtggcgcgcgatgcgtctggaaaagaggggatgattttaacgccggagcatctttactacagcacggcatttacctcctacggaatcccggtcgcctcgattgcgtctgtcacggcgtctacgggactgctcaataagggactttacgtgcaccagaagaacggaaccaaattaaagatcccttatgcggttggcacgaaggagctgccggactatgccggggaactcgatgattttattcattatctgcaggagaagccggagtccagaaagcttacctatctggcgagcgagaagcacgatacaatctgctgcttccgctgcggctaccagtataagggcggcggcgtctgcccgaagtgcggctatcagaataacggctgattctgtcatgggacagggcggtttccgatatacatagataacaagagaacagacaggatcttgttatgcagcagaattgtaaaaagggcctgtgccttgcgtttttattttccgcgatgtttttaaccgggtgggagatcgccgggatgcggagcagacagacaaaagagacggcggcggtcgcgtacgaggcgggcaactgggggctcggctttggcgcggagggaacccagcccaccggcaatgcaacctctgcggagttggcgcagtacgatgcacactatgtcggggatccgtccgggaaggtgctctatctgaccttcgactgcggatacgagaacgggaatacagagccgattctcgatgcattaaaaaagcaccaggcgcctgccactttctttgtggtgggacattttctggagagcgcgccggagattgccaagcggatggtggcggagggacatacggtggggaaccatacctatcatcatcccgatatgtcgtcgatcgcggatcttaccgcgttccagaaagagatggacgacaacgccgcgcttttttccgaggtgaccgggcagaagatggcgaactattacagaccgccgcagggaaaatacagcacgaagaatctcgagatggcaaaacagctcggctatcacacttttttctggagtcttgcctatgtggactggaatgtcgatgcacagccgacgaaggaggaggcgtttgaaaagctgctgggaagaattcatccgggggcgattgtgctgctgcacagcacctcgaagacgaacggggagattctggatgaactgctgaccaaatgggaggaaatgggatacacgtttcatcccctgtcggagctctgcgaaaaataaaagcgaaaagaattgttttgttggaaaaacaacagaaaaatctccggagatttcatacaatgcgtaggtaatcaatcaggaaatcaaaggagagatcaatatggaacataaaatgttttgttttcagtgtgagcagacagcgggatgcagcggctgcaccgggaatgcaggcgtctgtggaaaaagcagtgcgacggcagcgctgcaggatgaactgaccggcgcgttgatcgggcttgcaaaggcgtgcggcaacaatccacacaccgaggacaccacacatattttaatagaaggattattcacaacgatcacgaatgtcaactttaatgatgagacactgcgtgagatgatcgcaaaggttcatgcggagaaggaacgcgtggttccgaactgtgccacctgcgcatcgccgtgcggcaatacctcggattacgacatgaaggagatctgggaggcggatgaggatatccgttccctgaagtctttgattttatttggcatccggggcatggctgcctacgcttatcatgcggcggtgctcggctatgaggatgagacggtcaatgcatttttctataaggcgctttcgttcctgggctttgatctggagatgggagacctgcttccggtggttctggaagtcggcgaggtgaatttaaagtgtatggagcttttagaccgcgccaacacagagacattcggcaatccgaagccgacaaaggtgccgcttaccgtggagaagggaccgtttatcatcatcaccggtcacgatctctacgatttaaaactgcttttggagcagacgaaggataagggaatcaatgtctatacgcacggtgagatgcttccggcacatgcgtatccgctgttaaagcagtatccgcatttaaagggaaactttggaacggcatggcagaatcagcagaaggagttcgacggggttccggcgccgattctgtatacaacgaactgcttgatgccggtgaaggagagctaccgtgaccgtgtattcacaacagaggtggtttcttatccgcagatggtgcatatcggtgcggacaaggactttacgccggtgatcgagaaagcgttagagctcggcggttacaaggaagatacggagttcaccggcatcaacggcggcagagaggtgatgaccggatttgcacacggcacggtgctctccgttgcggatcaggtggtggatgcggtaaagagcggcgcaatccgtcatttcttcctggtgggcggctgtgacggtgccagaccgggacgcaattactataccgaatttgtaaaacagaccccgaaggacagtgtgatcttaacgcttgcatgcggaaaataccgctttaacgatctggatctcggggagatcagtggtctgccgcgcctgatggatatgggacagtgcaatgatgcgtacagcgcgatcaaggttgcggtggcgcttgccgaggcgtttggctgctcggtcaatgaactgccgttatccatggtattgtcctggtatgagcagaaggcggtctgtatccttttgacgctgctgcatctgggcatccagaacatcaagctgggaccgacacttccggcgtttatctccccgaatgtgttagcatatctggtggagcattaccatattgcaccgatcacgacaccagaggcagacttaaaggagattctcggagcgtaagggaacgggaaaatttcattctaatcgaagaaggcaggtacaaaaaagcagtttgtacttgtcttttttgttacggtatctaaaaaacacggacgggcgctagacgcctagcacccgcatggtattttccttgatcttttccgtcactttcgcatagcagatgagctcttcctcgctaaatccggcaaagcgcgccgcatcaaaatcgttttgtgcggtggcgagctccgggaggagcgcggtcgctgccggaagcagatccacgtgcaggtattttctggtactgatgacgcggatataatctttggcggaaagcttttgcaaggtgcgcgagagcgagcttttggataatccggcaaaatcggcaagttccgtgcggctgcaaaatgtatgcatctggcttaaggacagcaggagggacagctcgccaagcgtcagatcattgcgcagggcgatcgcctccagacagcggtccaaaagcttgcggctccggtagaactccgataggataccctctccggagatcgcggaaggacagaccgggatgcgctctgtgccgagcttttttgcacccggcagaagcgtcggcggcacagtgccgtcactggcggcatccaggaaaaagcggtagacggacagccgctttttttcgtatgctttttcgtcgtagacattcttataaaattcattgtaatattcaaagaccatgaatttcatcttgacggtctttgtgatgcttaatccctgacttgcaagggaaccttttgtcttgacataatagtagaccggcgcctgcagggcgtagaagacgttggcatgtaaaatatattccagattaaacaaaaagtcctcacaccagttcaccgagacatccatgcgcagatgatatttttccacaagatcacgccggtacagcttgttccagagaacgccataataaaaatcagcgggattctccatcatatgcgcagcaaactcttcgcgtgtgaggacaccgtcatcctcaatatcgcccttgtgcgagacacgctctccgacgacgcggtagaaatcggcgatcaccagatcgcagtcatgctctgtggcggcgcgcacgaacagctttgtcgcatccggtgtgatccagtcatcgctgtcgagaaactgcaggtaagtgccgcgagcctggctgatggcgagattacggctgtccgatacgccggtattttctttgtggatgactgtaatgcgggcatctgcggcggcgtaagcatcgcagatgtcaccggagccgtctgtgcttccgtcgtcgactaagaacagttcgtagtcggtatattcctgatgcagaatgctgtcaatgcagcgctgcagataattttttgcattgtagacaggtacgataatgcttactgtagggttcatgaaaagagacctcccgaaaagatactccttttatcttacctttgattttttaaatttgcaatggcaagatggacatatctgaccgatatataaagtaaagagagcagacctgccgaaacggatttcggcaggcggaaacggcgaaaggggagatttgtatgagtttgataccggattatgcaaatgcagtgggaagtgccatgtcctataaccgtaaggcggcagacacaaaaggaaaagaaaagacggatggaaacgcatcgtcagagaagactgggaaagccaataaggcggacaagacagacaggacaggaaaaaccggaacggtgactggaagaacgatcggcaatccgaaactcagcgaaaaagcggcaaagtattatgaagaactgaaaagaaaatattccaatatggactttattctggtcagcgaggatcagaaggagaaggcaaggacgcaggcgggaagctatgccaatgcatcgaagatggtagttctcatcgacgaggacaagattgagcgcatggcggaggatgaaaattaccgcagacagtacgaggcgatcattgcgaatgcgggaagcggcattgcacagatgaaaagttcgctggaggcttccggcacaaaagtaaaaggctacggcatgcaggtgaatgacggcggcaccgccacctattttgccgtgctgcagaagtcttccgacgcgcagaaggagcggattgagaaaaagcgcgagaaggcggcggaagaaaagaaggcggaggcgagacgggcgcagaaagacgcgcaggagaagcggatcagggacggaaaaaatcaaagagatgaacatgcggcagagcgtgtgaataagacagatgaggcgtctgaggcagactgggaaaatacggtgacgatcacggcgtcaagtatcggggagctgttaaaaaagatcagcgattaccagcagaatgagcggatgaatacggtgcagacgacagaggaacgcttggtcggcggacacatcgattataaaggctgaccggatgctggaagagaatgaaaacaaagagaaagagatacgacaatgaaagacggacagaagcaatatcggattcttaggattgacgagccggattttggctgtgaaggacgtgatgacggggaagcggtgtatgatgagatcacgctggtaaacgaacagggagaaacctgcctggtgcgcatggaggagcagcaggtgtggaacatgggactggatgagggaatgcttgcctgggtcggaaaagacggacagatccggggacgctgtaagcggatggacatcagccgctggtcggaaaaatatcaggtgcgcgcactgacagagcaggatgtgggagccatttatgaactctcccggaagaacaatctgtattatgaatattgtcccccgtatgtgacaagagacagtatcctgtcagatcttgtggcgcttccgctcggaaaactccccgatgataagtattacgtgggatttttccggggagagacactgcttgcacagatggatctcattgccgattacccggagcgggcgatggcgtatatcggactttttatgatggaggcttctgttcagcaggcggggatcggcaccagaattgtggaggatctgtgtcgtcatctggcagaggaaggaatccgcaccgtgcggctctgctgggtgaagggcaacccgcaggcagagcatttctggagaaaaaatcagtttgtgccgatcagagaaacacagagcatgtcgggacaaacggtggttctggcagaacggaggttgaaataaacgtctttatgtgataaaatgtagctgcgtaaccggttgcgcagctacattttttgcgggagaagaagagatgaaaacgtgtgggaacaggaattacagaaaatggctggcacttatggtcagcggcggtcttgccgtaacggcgcttgcaggctgcggcgggagcgatggaggaacagagcagagcgcgcagacagaggtctcggaggggattaagacggcggcagaagataataaggtgacgacgtttgcgctgccggatggaccggaggagtcggagatctatgtggagccgatcgccgatctgccggatgattttatccggggaatggatgcgtccgcggtactttcactggagaacagcggcgtgacgtattacaattatgagggaaaagagcaggatgtctttgagacgctggcacagtccggcgtaaattatatccgcctccgcgtgtggaatgatccgtatgacgcggatggaaacgggtacggcggcggcaacaatgacgttgcgacggcggtcgcccttggaaaacgggcgacggcgtacggcatgaaggtgtgcgtggatttccattactcggatttctgggcggacccgaagagacagcatgcaccgaaagcctgggagggcatgagtgcgtcggaaaagagcgaggcactctatgattttacgaaggaaagccttgccgagcttttagacgcgggtgtcgacgtcggaatggtgcaggtcggcaacgagatcaacaacggcatggcaggcgaggaggatgtcgatacggtcatggatctgattgcatcgggaagccgcgcggtgcgtgagattgcggacgaatacggaaaagacatcaaggttgccgttcattacacgaacattgatgacagtgaggaagtggataccatggcagccaatctgcagaatgccggcgtggattacgatctgttcggtctgtcctattatccttactgggacggcaccatggaaaatatgcaggcagttgcggaaaatattgagaacacctacggaaaagatgtctatatcgcagagacgtcctactgctatacgacagaggacggcgacggctttgcgaacagctttgccggcacggaggatctggtggacggatatgcggcgacggtgcagagccaggcgacgatgatccgcgacatctgtgcagcggcggacgaggcgggagcgctcggtgtcttttactgggaaggcacctggattccggtcggagatgccgatgcggataacacggccctctggaaaaaatacggaagcggctgggcgagcagctattcggcggactatgatccggaggatgccggactgtattacggaggctgttcctgggacaatcaggcgatgtttgattttacgggacatccgcttgcctcattaaatgtattcaaatatttgaaatatggtgcgacggcgccgcttgccgtcgattttattccggaggttgcggtaacctgcgatgtgggcggtgaggtgacgctgccggatgcggttgaggtggtatataatgaccgcgcggcaaacacacaggagaacgtgacctgggatgcagagcagcttgctgcgatcgatacgagcaaagcgggaagctatgaggtggcgggaacgcttgcggacggtacggcagtgacggcacaggttgaagtggagatggtgaattacgtcttaaatccgagctttgaggatgaggacacttcgatgtggaaggtttcctacgagggagagaataatccgaccgatttccagaacaaggcggatgatgcctacaccggagatatcgcgttccatttctggtcgggagattccgatatgaacttttccatcgagcaggaatttacggatcttgcgcctggaacctatcagctttcggcgtacgcacagggcggagatatgtcagcggacgcttcgatggaattgtatgcagtggcagacggtacggaatggacagatccgtttatgatgacgacctacgcagactggcagaatccgaccgttacaggaatcaaggttacggacggtacgctcacgatcggcgtgcgttttaagtgcaatgtgaaaagctggggaacagtggacgatgtgaccctgaaccggatttcagattagaaatataaaagtaaacttacataagagaagagtaagaagggactgccgcgtgaaacgtgcggtccctttttaatgcgatagataatacgataagaaagatcatgacctttgctttcagctggaaatgcttgatttctttgcatattatttattacgtcaaaaggaacggtttgttttacgcggcagtccctttttgcacggatacggtgcaaataattatttgaaggagcccccggttcgatagtattcttgattcaagataaaacgaagcgcgcgaaggcgcagagacgtaaggaggaaacgaagatgttgaacgttttgttagtatgtggatcaggtgccagcagtggttttatggcagccaatatgagaaaggaagccgcaaagagaggtcttgatatgaagatcacagcaagaagtgaatccgagatcgagaactatattgacgagatcgatgcgttgatgatcggaccgcatttacagtatcttgaggatgagatggaagagcggtgcgagggaaccgatgtaaaggtgatcctgatgaaaccggaatactattccgtattaaacggtgagaaggcaatcgatcacttgctgtctgttgtgggcgaatagagaagagggggcaactacaatgaacaaatttatgaagtggctgaacgagagttttgcgccgaagatgcagaaaataaataataatccgtggattcttacgattaaggaatcgatcatgcaggtaatgccgctgatctttttgggatcgatcttttgtattctgacgattccgggagattatatcagctggtggccgaacttctggaccatctataactggacattcggtatggtatccatttttgtggcatttttgattccgtttaacctgatggagaaaaagcgcagaagaaagagccgtatcgttgccggtgttgccggactgatcctgtttttccagtccatcaatccgcagttcatcgcagatcagcaggcaaacttagagagcggtgatatcgcattttccggttttaccagcattggcggtatcggagcaggcggtatgttccttgcgattattgcaggtctgatagcggcagcaatcgtaaacctgcttggaaatttcagctttttcaaagaggattccgtaattccggatttcgtccgcgcatggtttgattccatgctcccgatcggtcttgttgcggttctcggatggatcttaactgatgcatcgttcctgaacttaaacctgtaccagattgtggtggatatcttcatgccgctgcagaattttgcacagaatccgttcggttttgtatttatcatgttcttatattgcttcctgtattccatgggtatttccacctgggtactgacaccggtggtaagcccgatcatgattgcagcagcatctgcaaatgcggagcttgccgcagcaggaatggcaaccaatgcgaacttatctatttttacagatgcgaccgtatattccgcatatctgtggatcggaggtatcggctgtacgatgccgctcgtgattatgatgctcacgatggcaaaatcacagagaatgaaagcacttggaaaagcggtattagtaccggctgttttcaatatcaatgagccgaccgtgttcggctgtatcgcatggaacccgattctgatggttccgatgtggctgcagggaattatccttccgatcatcatttatgtattgacgaaagtgattccgctgttcccgatcccggacatactctttaacatgtggtattgtccgttcccgatctgtacatggcttacgacacgttccctgtttggtatcgtactgatgctgatcgtatttgcagcatcctggatgatctggatgccgttctttaagatctatgacaagcaggtgtgcgaggaggaagcggcagagcagaaataaacagaagcagaagtaagagtaataaggagaaaaaccatggcagtagaaaataatatggatgacgaattagatcaggtaagtgcagaggcaatgcagattattatgagcgcgggcgatgcccgcgtgagctgcaacgacgccttaaaggcaatcgcagagggcaatgtggaaagcgcaagagagctcataaaaaaagcggaagggcagattgcagaggcacatcatgtgcagacagatgccattcagggctcgatcggtggagagacacaggcgtacagtctgctgtttgcccatgcgcaggacacgctgatgaccgtgtacagtgagatccacatgacaaagcagctgttgttgatttttgagggatatgagcagcgcatccgcacactggaagaaaagattgcaaaataacggagtgacaggtttggagggaaaaaatgagcagagtaccggaaggatttccaaaggatttcctctggggtggcgcgtttgcagccaaccagatggaaggggcatatgatgtaggcggaaaggggctgtgcatcgcagatatcaatgagtttgtcgacgatatcccgctggagaagaaatataacggcgaggtgacgacacagtacatcaaggacgccgttgcaagcaaagaccgtgtattcccgaagcgttggggaattgatttttaccatacctacaaggaagatttaaagttattgaaggagctggggttaaagacctaccgcacttcgatcaactgggcgagaatttttccgcacggcgatgagacagagccgaatgaagagggactgaagttttatgacgatctgatcaacgagatcattgccaacggaatggagccgatgatcacaatctcacattacgagatgccgctgtatctgacgacacattacaaaggctggtattccagagaggtgatcgatttcttctaccgctattgcaaggtattgtttgaccgtttcggcgacagggtaaaaatgtggatcatcgtaaaccagatcaatctgattgcagtagaatcttttaaccatctcggggtagcggaggatctcgttgagaatattgcagaggcaaaataccaggccgtccacaatgagatggtcgcctgcgcaaaggcaaccgcctacgcgcacagtctggacaaaggcatcaggatcggcatgatgctctgcggcggaccggcatatccggcaacctgcaaaccggaggatgtcctggcatgtatgcggcataaccagatggaatatttctgcgccgatgtattgctccggggacgctatccgggctatgcattccgtttcttcgaggagcggggctacaacatcgtattcggcgaggaagatgaggagattttaaagaataccgcagactttatgtctttctcctattactatacacgcgtgtgcgacaaggaaagctatgagaaggacaactcggcataccgcaacaaggagcttccggcaaacccgtggggctggacgatcgacccgaccggtctgcgctatatgctgaatgtgttctatgaccgctatcagtgtccgatctacatcacggagaacggtgtgggatattttgacaagttagaggcagacggaacgatccacgatccataccgggtagaatattttaaggcacatattgagcagatgaaagaggcaatcagagatggcgtggatctgcgcggttactatgcatggggaccgatcgacatcatcagctgttcttcttccgagatgagcaagcgttacggcttcgtctacgtggatcaggacgactacggaaaaggaagcggcagaagaatcaaaaaggacagttttgcatggtatcagcatgtgattgagaccaacggggcagaactgtaaaaaataaaaaaagaggacaaaaggagcgcagcggacagaaaatctgtccatgagcttcttttgtcgtattctgtgttacagaaaataccggatggaaaagaaaagtcagatatgatacaatagacggcgcaatagggaaaggcaggagcggagaggatgaaaaagcagcacaatgagctgattaagatactggcagaagacaaggaatggcagacagccaaaacactggcgatgaagctgaacgtatctgagcggagtgtgaaaaactatatagcggagatcaatcagctgctgcatgatcccatcgaatcctccaaacgcggctaccgcatgcagatggaagatatcaaggcatttgtgcggcaggatgaggcagccatcccgcagagtccgggggagagacaggtctatctcatggaatggatcattacctgtgcgatccgtgaggaggaaatcgatctttttgatgtcagtgaaaagctgtgtgtcagcatagagaccacaaaaaaagatcttgccgtggtgaaaaaatcgtttgaaacatacggactggagctgcagacacacggaaacgcagtcggcatctatggaacagagcggaaaaaacgtaaggcattccgggaactgatctatcagctgttccgggagaatgaactggagatgtcgtctatccagaagatgataccgcagatcgatattgtccatctgcgcgggattctgatggaggaaagcgagaaaaacagctgctatctgaatgaatatgcactgatggatattctgctggacatcgcgatcagtatggcgagaatccagaatcactgtgtattggaagaaaaaaatgaggtgacggcggaatacagggaggatcggtatcgcttatttacatcgattctggaacgaatcgagaacgactatgcaattcatctggacgaggtcgaggaaaacgaattaaaactgatgattatgagcctgatttgcaggcgcagacccgcggagcagacggaaaatccaaaggaatttttagatgagcgtacctatcttttatttgttcggattctggaatacctgaaggatgaatttgacctggacgatctgatggaggatgagaccttctgttacaaatttgcgggtcatcttaaaaatctgctgatgcgtctgcgcagcggatattctgcaaaaaacatgctgacggagagcatccgggaatcctgcccgctgacgtttgagtgtgcgatcggaattgcggacatcatcgagcaggaatatggattgcagatggatatgagtgagaccgcctatctggcgctgcatatcggcgaccgcctggagagcaggctggaggaaaaggaaaagatttcgtgccttgtcattttcccgcagtattaccatgtggcaaaccgcctgttggagaagatcgagaaagagtttaaggacgaactgctgatatcatttgcctatgagacgctgccggaggaaaaaccggaggcggaacttatcatcagcaccgttccgatccgtggagcggacaaggagcagtttgtgttaatcagcccgttctgcaaccagaaggatattcttgcgatcaaagaacgtgttcaaaaaatcaagggtctgcgcagcaacagaaaactgcagggaagattaaagcatgtactgaatcagaaatactttgtgaaaaatccaacgtttggctccgccgaggaagcaatcacttacatgacaaaacggctgattgaggacggcatggcagctgaggattttacggaaaaggtgcttgaccgtgaaaaacaggcgtcaacggcgttcggcaagattgcgcttccgcattccctaaaaatgatgggcaaatcaaccggtatttttgtgattatcagtgagaaaccgatcccctggcatacgcagtatgtcaatgttgtgctgctgctttgtatcagcgagagagaccggatgcttttttatgatatttttgataatctgatttcgctgtttgtggaggaaaagtacgtgcaggagattgcaaagtgcaaagattatacggaatttgagaatctgatgctggaatatgtaggaggaaaatagtgtgaaaaattacattgatatgtgatttttcacacggctatttgtttctgagcgaaagcaaatagctttgatggcagaagagaaatcgcttttgcgaatttctcttcgcctcttcgcgacaagtcgctcagaaatggagattagcatgataaaatgtctgtgtgtgggacttggaggagccgccggtgcgatgcttcggtacctgatcggactggtgccggtgggcgcgtccaacgggtttccggtcaaaacgcttctcatcaatatactcggtgcgtttgtcatcggcgtgctggcggttctgggagaaaagcattcccttccaccgcttctggtactgacgttaaagaccggcgtctgcggcggctttacaacattttccacctttgcactcgagaccagccagctgttccagaacggaagctatggactggggatcgggtatgtgtgtgccagtgttattttgagcattgcggcagtgcagcttgcgtgcctgtggctgtcctaagcagggctgacgcaatgcagcggaaggggcgcgcatgaagtgtgttgtgtcctttttatgataagtaatattaaatattataagaaacacagctacagatttcatgtggaaatgcagaggaaaattcgttggagaaaaatgtgagcatttcttccggccgaatgtttgcatcggattccgtgtctcttccacgtttggacaatccgacgggtgcatgtccgacacaccggagacaatgggcggactttcaggtgccgcaagggacacacacaaaagtcctacaaattgtcttccgggatgcggacatgacccgcggagtgctccaaacttggaaagacacggatcatcgaagatgcaaacatccggctggttagaaatgccacattttttgaaccaaatttccctctgtatctccatctgaaatcccacggtgtgatcttctgataatattacttatcacgaaaaggggctgcacatttgatgcgcagcccctttctctgtatctgtcagcctgcagcctgatccttctgctccggtgcgttctgctttgccagatttttgttcgcggtggagagcatcagcttgatacggttgagctggtttacctcgctggcacccggatcgtaatcgatggccacgatattggaacccggatagcggtgacgcagttccttgatgacacccttgccgaccacatggttcggcaggcaggcgaacggctgcgtgcagacgatgttcggtgttccggtgtggatcagctctaacatctcaccggttaagaaccagccctcgccggtctggttgccctcggatacaatgtctcttgcatatctggcaagatcatcgatgtgcgcaggtgcagtaaagtgcctgctctttgtgaattcatctcttgcagcgctgcgcagccactcaaagaaattgatgcccagacggccgatcttcttggacttctggctcatgccgagattgtctgctttaaagcccgtattgtagaagcagtagagcaggaaatcggtcagatccggtacaacggcctctgcaccctcggattcgagaagctccaccagatgattgttggcagccggatggaacttgacaagaatctcgccgacaacgccgacgcgcggtttcttgatgtctttgcgcggaaggttgtcaaaatcgcggatgatctcgcggcacattttcttgaacttgccgtgggagagcatctttttctgggtaataaaggcgataacctcttttttccatttctcatgcaactcgtccgttgatccggcaaccgcctcgtaagggcgcgttgcgtagacgcagcgcatgaagatatcgccaaactccagcgcgtagagtccgtgctggatcagtggcagtgtcagcttaaagcccgggttcttctccagaccgctcagattgatcgagatgaccggaacgtccggatagccggctttttccagtgcacgccggatgaagccgatgtaattgctggcgcggcagccgcctccggtctgggagattaagatcgcggtgcgcgacatatcataatcgccggacatcacggcagccatcagctggccgaccacgatcagggacgggtagcaggcgtcgttgttgacgtactttaagccgacatccacgcaggtgtggctgtccacatccggaacaacaaggttgtatccggccgtctggaacgccggctccaacagctcaaaatggatcggtgacatctgtgggcagaggatggtgtaattcttgcgcatttcctccgtgaagacgacgcggttgtaattcgccggaacgatggtgcgcttcgtctgcttcttctcacggacacggatcgccgagatcagggaacggatacggatgcgcgccgcaccgaggttgttgacctcatcgatctttaagcaggtgtagatcttgccggactttgtcagaatatcattgacagcgtctgtcgtgacggcgtccagaccacagccgaaggaattcagctggatgaggtcgagatcgtctcttgtcttgacatagttcgccgctgcgtacagtctggagtgatacatccactgatccatgacgatgagcgggcgctccaccggctgtaagtgggagatggaatcctccgtgagcacggcgatgccgtaggaggtaatcagctccggaataccgtggttgatctcagggtctacatggtacggacgacctgcgaggacgataccgcgtcttccggtctcctttaaatactgtaagacttcctcgccttttttctgcatctccatccggcagacggcaagctccttccagccttcggcaaccgcgtcgcggatctcagattccggaatcccgaactccgactggccaaaggtcttaatcagctgggaggaaagcgtctcctcgctggcgaaagacataaacggatttaagaacttcacctgaccggaagtgatctcgtccacgttatttttgatattttccgcgtaggaggtaacgatcggacagttgtagtgattgttggaatccgggaattcgttgcgctcataaggaatacacgggtagaaaataaaatcgacgttctggtggatcagccatgtcacatgaccgtgtgccagctttgccgggtagcactcggactcgctcgggatggaatcaattccaagctcgtagatcttgcgcgtcgactgcggggagagtaccacggaaaaaccgagcttcttaaagaaagttgcccagaacgggtagttctcgtacatatttaaaacgcgcggaataccgactgtgccgcgtgctgcttcctcggcggaaagcggggtgtagtcaaacaggcgtttgttcttgtattcgtagaggtttggaatgttgtctttatttttctccttgccgaggccgcgctcacagcggttgccggtgatatactggcggttgccggaaaagcggttgattgtgaggagacagtggttggtacatccctgacatcttgccagctttgtgtcgaaggtcagcgcattgatctgttcgatggaaagcatggaggtctggtagtctgcctcgtgacgctctctggcgatcagtgcggcaccgaaagcacccatgatgccggcaatatccggacggacacattcgacacccgcgattttctcaaaactgcgcagtacggcatcgttgtaaaacgtaccgccctgtacgacgatatttttcccgagctggcttgcatcggaaagcttgattaccttaaataaagcattcttgatgacagagtacgcaagacccgcagaaatatctgcaacggatgcgccctctttctgcgcctgctttaccttggaattcataaatacggtgcaacgggttccaagatcgatcggatttttggcaaaaagagcctcctttgcaaaatcctgtacagagtagttgagggattttgcaaacgtctcgatgaaagaaccgcagccggaggaacaagcctcattgagctgtacggaatccaccgtctgattcttgatcttgatacatttcatatcctgaccgccgatgtctaagatacagtcgacttccgggtcgaagaacgcggccgcatagaaatgagccaccgtctcaacctcgccgtcatcgagcatcaaagcggcttttaacagcgcttcaccgtatccggtggagcaggagtggacgatctttgccttcggtggaaggagcgtatagatctccttgatggaacggattgccgttgcaagcggacttccattgttgttgctgtagaaagaatacaaaagggaaccgtcctcgccgactaaggcaatcttggtcgtggtggaacctgcatcgatgcccagatagcagttgccctcataagtggagagatctgcggacctgacattgtgtccgtcgtggcgcgcacggaaagcgtcgtactcttcctggctggcaaacagaggatccatacgggcaacctcaaattccatcttgatgccgtttgagagccggtcgcggagagagacgagcgtggtcgtctcacccggcttgtaatttaaagcggaaccgatcgcagcaaacagatgggaattctccggtgtgatggcgtgttcgtcgtccagattcaaggtgcggataaaagcagccttgagctcggaaaggaagtgaagcggacctccgagaaaggcaacatgaccgcggatcggcttaccacaggcaagaccgctgatcgtctgattgaccactgcctggaaaatggaggcagagagatcctctctggtagcaccctcgttgattaacggctggatatcggtcttggcaaagacaccgcaacgcgcagcgatcgggtagatggccttgtaattcttggcgtattcattcagaccggtcgcatccgtctggatgagggatgccatctggtcgataaaagaaccggtaccgccggcacagatgccgttcatacgctgctcgacattgccgccctcaaaatagatgatcttggcatcctcaccaccgagctcgatggcaacatcggtctgcggtgcataatgctgcagggcagtggacacggcgatcacttcctggacaaacggaacaccgagatgcttggcgagtgtcaggccgccggaaccggtaatcatcggagcgacagcaaaatcgccaagggcatcgtaggctttctgaagaagggaggataaggtctcctggatattggcaaaatggcgctcataatcggagaagagcagacggtcctcctggtctaaaatagcaaccttgacggttgtggaaccgatgtcgattcccaatttatgaagtgtattgttttccataattccctccatggttgtttctcgtaaagtaaatactttagcagagtaaaatatgtaaaagatttcttcttattataaatagtgccaatctggcgctaaacactctacattatacgacaggatatgtcaaaagacaatgtgcattttgccggaaaagtataaactttttgtaaagaaaaacccctctgattgacaaagatttccctgaccgatatactgaacaacgtaatgtcatttttggaaaggtcaggaacagagtgtatgaactggttaaataaattagaacgtaaattcggcaactgggcgattcccaatctgatcgtgtggctgatcggagcttacacgatcgggtttgtgctctaccaggtgaatccgtcgatcataggacttttgatgttgagtccgtatcacatcctgcacggacagatctggcgtctgattacctgggtgtttatgcccacagacacgaatctggtgtatcttctcattatggcgcttttctattatcagcttggaacgacactggagcgcacatggggaaccttccggtttaacgtctatattttcggaggtatgctgtttaccgtcatcggagcgtttctgctgtacggtatcatgtatctgatgaacggcggtgtgacgacggagatgcttctcatcggaacgagtttcagcacaagttacatcaacatgtccatcttccttgcgtttgcatgtatgtatccggatatgcaggttcttctgatgttcattatcccgattaagatgaagtggatggcggctgtgtacggcgttctgattgctttaagcttttttgagaccggatgggcgggaagaatggcgatttttatgtcgctcctcaactttattattttcttcttctccaccagaaacctcaagcgctatacgccgcacgaggtgcacagacgccagaagtttaaggcagacatgcgaagaccgcagggatatgcgggcggtgcgaagcacaagtgtgctgtctgcggcaggacggaacttgacgatccgacgctggaattccgtttctgctccaagtgcgagggcaattacgaatactgccaggatcatctgtttacacatcagcatattcggatgagctagaaagtatgaaaaagaaaaaggtgatacttcgattccgccagccggcgtagaagaagtatcacctttttgtttcttttaggagtagaaatcttttagcgcatccatccgtgcgctcatattggaaaagagtgagtcgacgatcgtgatggccgccatggattccaccacgacaacggcgcgcggaacgatgatcggatcgtggcgtcccttgatgttgaccgagatctcctcaccggactgattgacggtgcgctgtgtggcggcgatggaaggggtcggcttgatggcagcccggaggatgatgtcgcttccgtcgctcatgccgcctaagataccgccggcatggttggttgctttggcaatcctgccgtcctcaccgaggacaaaggcatcgttgttgttcttgccggtcgcttttgccacgtcaaatccgtccccgatctcaaaacctttgacggcgccgatggacatgaccgccttggcaaggtttgcattcagcttctcaaagaccggatctccgataccggcaggcattccttttatgatacactccacgatgccgccggaggaatttaactccgtcatgcaggcatccagataattttcagcgttctcggccgcttcggcgtccggcatatagagtggattctttgtgacctcggaaaaatcaaagtgcccggaagatacggcgatcgggccgatggactttgtgtaggtcataaaggtaatgccgagctcgtttagaatcttgacggcgacggcgcctgcggcgacgcgtccgatggtttcccgcccggaggagcgcccgcccccgcggtagtcgcggaagccgtatttctggtcgaacgtgtaatcggcgtgaccgggacggtaataggaggcaatctcgctgtagtctttggactgctggttgcggttgaagacgacaagcgagatcggggtgccggtcgtctttccttcaaacacgccagagagaatctctacggcgtcgtcctctttgcgcggcgttgcatatctggactgaccgggcttgcgccggtcgagaaacttctggatatccgcctcacagagagaaagtcccgccggacagccgtcgatgacgacgccgacgccctttccgtgagattccccccaggttgtgattttaaaaagagttcccaaagtagaccctgccatgtgattccctcctgcttacataatgatctttctcgattataaaagatttgactttgcgccgcaacagaaatatgttatgatttgacggagcagaagtaccagcaggcgaggagaagaatatttcatgatagagaaataccttgtgaaaaagataacagagccggtggactggaaggtaaccgtgccgggatcaaagagcatgacgaaccgcgcgcttcttatggcagtgctgtccgcaggaacggtgcgcgtggaaggagtcctgttttccgatgattccagacactttctggcgtgtcttgtggcgctcggctttacagtggagatagaggaagaaaaaaagtgcgtgaccgtgacgggctgcggcggcaggattccccgcggggaggcggtaatcgacgtcggaagcgccgggacagcggcgcgttttcttgcggcgatgctcggattttcggacgggtgctatgagatccgctgctcagcgcagatgaagcggcggccgatggcggagctgttcgatctgctttccggtgcgggagcgaagattacattcctcgaggaggaagggcatcttccggtgcgcatcacaggatgcagatacgcccgggcggataagacagcaggggagacgccgcgggagctctctcttgacattacgaagagcacacagtttttaagcgcgctgctgttgattgcgccgatggttccggaagggatgaagatccacatcaccagcgagaagacggacggatcgtacatccgtatcacacggaaaatgatgcaggaattcggagtgagtgtcacttttgacggaagagactacgaggtgcccgcggaggcttcctaccggaaggagacttatatggtggaaccggatatgtcggctgcctgctatttttatgcggctgcggctgtgaccggcggacgggcgcttgtgcggcatgtgcatatggacaacacacagggagatctgcgtttcctggaagtgttggagcacatgggatgtaccgcggacgatacgccggagggcgtcctggtaacggggccggcggacggtgcgctacggggcatcacagtcaatatgaacgatttttccgatcaggcgctgactctggcggcgatcgcgccgtttgccgacgcgccggtgcgcatagagggaatcggacatatccgtgggcaggaatgcgaccggattcacgcgatacagacgaacctgacagcgcttggcatccggtgtgaggaggaagagacggctgccacgatctatcccggcagcccccacggcggaagcgtggagacatacgacgatcaccgcgtggcgatggcattttccctggtcggacttagaaccgacgggattgtcattgagaacccggcgtgctgccgcaagacgtttgaaaattattttaccgtgttaagcgaactgaccgggaagaagacggaggcgtgaagcagcgccggctttgcatgagtaataaaaaggagacgaaaaacagatgtatgaattattaaaacaggaaggacgcgcgaagagaggcgttttccatacggtgcacggagatatccagacgccggtatttatgaatgtgggtacggtggctgccatcaagggagctgtctccacggaagatctggaacagatcaagtgtcaggtggagttgtcaaacacctaccatctgcatgtgcgcacaggggataaactgatcagggaagtgggaggactgcacaagtttatgtcgtggaatcgtccgattcttacggattccggcggatttcaggtgttctctctggcaggcctgcgcaagatcaaggaggagggcgtctatttccactcgcatattgacggggcaaagattttcatgggaccggaggagagcatgcagatccagtccaatctcggctccacgatcgccatggcgttcgatgaatgtccgccggcgcttgccgagcggaaatatgtggaggattccgtggcgcggacgacgcgctggctggagcgctgcaagaacgagatgcagcgcctcaacggtctggaggataccgtgaaccgtcaccagatgctgttcggcatcaaccagggagccatctacacggacatccggatcgaccatgcaaagcggatttccgagctggatctggacggctatgcggtcggcggacttgcggtcggcgagacacacgaggagatgtaccatgtgctggatgagaccgtgccttatcttccggtgaacaagccgacctatctcatgggagtcggaacgccggccaatattctggagggagtggagcgcggcattgacttcttcgactgtgtttatccgtcccgcaacggccgacatggtcatgtatacacgaaccagggcaagatcaacctgttcaaccagaagtacgagaaggatatgcgcccgatcgaagagggctgcggctgcccgacctgccgccgctacagcagagcctatatccgccatctgctcaaggcaaaagagatgcttggcatgcgcttatgtgttctgcacaatctgtacttctacaacacgatgatggaagagatccgggatgcgctggatgccggaaattttgcctcctacaaggaagaaaagttatacggcatgggacagatcaaccgggaaaaggaaatggaaaagtaagagggaaaaggcttgccaaacagagaggttttgtgtacaatactctttaatgaagtcggatgacttcggacaagtttatgattttaggaggatatcagatgttttcaatcttagcaacagagagtgcgtcatccgctggctggatcagcatggtggtatggctggttattttatttgcatttatgtatttcttcatggtgcgtccgcagaagaaagagcagcagaagaagaactccatgcttgcagagctggcagttggagatacaatcttaacgacgagcggtttctacggaaccgtgatcgacattgcagacgatacggtgatcgtggagttcggtagcaacaagaactgccgcatcccgatgcagaaggcagcgatctccgcagtggagaagccggaagaagcagctgaataagcaggatattgaatggaaatctaagagaatctgccttgtagcaatacagggcagatttttttgatcataggggaattattatgaaagtgatgagaaaaaaatatacggcgatggaaatggaggaagatatatgaaaaagcagcatgaaaaaatgattctttggatcattattgtaatatcggttttatcggtggtgccacttttgcacttatccatgtacaaccatccgtctggagacgattactggtatgcatcagaaacctatcatgcgtggagagatacacattccctgtgggaggtgtgcagggcggcatttgcaacttcagccgagttttaccagacctggcagggactttacgcctccgcggtgatacaggcactggagcccggtatttttggcgaagcgtggtatcggatagctgcgtgtctgattcttacggctctgtatggtgcaaatctgatttttgcatggcaggtgctgtacagaaagcttggaatgggcaggctggaggcggcagcctttggttttatgatgtcggctctgatgctgcagtggattccatcggcagtgcagggaatctactggtacaatggtgcggtcaattacacgtttttcttctgcgtattattgctgcttgtttcggcggcattgtggttgggaggaaagggaaagagacgcatcctgcagatggttcttacgggactgcttggactgcttctggcaggcggtaatcacgtgacggcatttggcggaatcctttttctggcaggctgtgtgatttatggaggagtggtacatcgaaagccgttttttgtagacagtctggtggtactggcagtgacagttggaggttttctgatcaatgtgctctctcccggcacgagggtacgccagtcggcatttgaaaataccccgggcttttttgaaaccatctggcttgcaacgaaatggggaattagtgcgatcaaccagtggatggggctgaaaatactcatcggcatggtagcgttccttccgtttatcctgcgtgcggcgcagcggctgtaccgagagaagggattccgtttttcatatccgctggtggtggtagttctggcggtggggtatatctgtgcattgtattgtccgccatattatggaatgggagcagcaggtgatggaagactggcaaatgtggtgtattttacgtatgtgctgctactgtttgtcgtagagttctatttgtgcggatggctggtgcgtgtccttgctggggacactgcttcggagaatgtcataaaccagctctcccatggccatctggctgtgacgggggtgctgctgcttggggtgctcatcggctgcggggagagctcgactgcttatcaggcacatttgcagatcaaaacaggaactgcgcagagatactcgcaggaagcgtatgaaagacacgatacattagaggcggcgaagggaacggatgcactcgtggatgcttatacagagcagccctatatgatttgtatggatgatattacagaggatgcagaggactggcgcaaccagaatctgctcgcctattttgaactgaaaagtgttgcgttaaaaaagcagtaaataagaccaggttatggaatacatgaaaaagaaaaatagattcagaggttgcattgtttcccgagatacattattatagaatttatatactgtctgttagtaatgtgctaaagtcaatacaagacggattcctgcatggcaggaagaaaagagggattagagagatggaatataaggtaggcgtgatttccggcgacgggatcggaccggagatcgtaacagaggcaaagaaagttctggatcagattggaaagatctacggacatgtgttccgctatgaagagattctgatgggaggctgctccattgacgcgacgggtgagccgctcacggatgcggcgatcgcttccgcgaaggcttccgatgcggtgctgatgggttcgatcggcggcaacacatcgacttcgccgtggtatcagctgccgccggagaagagaccggaggcgggacttttaaagctccgcaaggcgctgaacctgtttgccaacttaagaccggcatatttatatgaagaattaaaagccgcatgcccgcttcgggacgacatcatcggggacggatttgacatgatgattatgcgggaactgaccggcggactgtatttcggagcgcgcaagaccgaggaagtggacggcgtgctgacagcgacggatacgctgacctacgatgagaacgagatcagacggatcgctaagcgcggttttgacattgccatgaagcggcgcaaaaaggtgacgagtgtagataaggcaaacgtgctggattcctcgagactctggagaaagatcgtcgaggaggtggcgcaggattacccggaagtgacctatgagcatatgctcgtggacaactgtgcgatgcagctggtaaaagacccgaagcagttcgacgtgattctgacggagaacatgttcggcgatattttgtcggatgaggcgagcatggtaaccggttcgatcggtatgctctcaagcgccagcctaaacgatacaaagttcggactctacgagccgagcggcggttcggcaccggacattgccggaaagggaattgcgaatccgatcgcaacgatcttaagtgcagccatgatgctgcgttatagctttgatctggaccgggaggcggatgcagtggagcaggcggtgaagcaggtcttaaaggatggctaccggacgatcgacatcatgccgcaggagaagcagcaggaaaaggtaacccaggtcggcacggcacagatgggagatctgatctgcgagcggatcagatagaatgacagaaacggagttaagatagatgaagagtgataatgtaaaaaaagggatgcagcaggcacctcatagaagtttgtttaacgcgctgggatttaccgaggaggagatgaacaagccgatggtcggtattgtgagctcctacaacgagattgttcccggtcacatgaatttggataagattgtcaacgcggtaaagcttggcgttgcggaggctggcggcgtgccggtggtatttccggcaatcgcggtctgcgacggaatcgcgatgggacatatcggtatgaaatattcgctggtgacgcgtgatctgattgccgattccacggaatgtatggcgcttgcacatcagtttgatgcgctcgtcatggttccgaactgcgataagaatgtcccgggacttttgatggctgcagcgcgcatcaatgtacccacagtgttcgtgtcaggcggaccgatgcttgccggacatgtacagggcaaaaagcgtagcctctcttccatgtttgaggcggtaggttcctatgcagccggcacgatgacggaggaggaagttagggaatacgaggagaaggtttgtccgacctgcggctcctgttctggaatgtacacggcgaactccatgaactgtctcaccgaggcgctgggaatgggacttcgcggaaacggcacgatcccggcagtctattcggagcgcatcaagctcgccaagcatgcgggtatggcggtgatggaaatgtaccgcaaaaatatccgcccgcgtgatattatgacgaaggaagccatcttaaatgcgctgaccgtggatatggcgctcggctgttcgacgaacagcatgctccatcttccggcaatcgcccatgaagtgggatttgattttgatattgcatttgccaatccgatcagcgagaagacaccgaacctgtgccacctggcaccggcaggaccgacttatatggaagatctcaacgaggcgggcggcgtctatgcggtaatgaaagaactggcggacatcggactgctgcacacggagtgcatgaccgtgacaggaaagaccgtcggggagaatattgcggatgcagtgaataagaatccggaagtgatccgtccggtggatcacccgtacagcaagaccggcggacttgccgtattgaagggcaatcttgcgccggacggcagcgtggtcaagcgctcggcagtctgcgatgagatgatggtgcacgagggaccggcgagagtcttcgactgtgaggaggatgcgatcgcagcgatcaagggaggcaggattgttgccggggatgtcgttgtgatccgctatgaaggcccgaagggcggaccaggtatgcgtgagatgttaaacccgacttccgcgattgcgggaatggggcttggatcttcggtggcactgattacagacggacgtttttccggtgcaagccgcggcgcgtcgatcggccatgtatcgccggaggcagcggtcggcggaccgattgcactggtggaagagggagatcttattaagatcaatatcccggagttaaagctggaactcgccgtaccggacgaggaactttccgccagaaaggcgaaatggcagccgagagagccgaaggtgacgaccggatacttaaagcggtacgcatcgctcgtgacttcgggcaaccgtggagcgatactggcgctcccggaagaacagtaggatagaaaaggaaggtatatgacatggagctgacaggagcacagattgtcatcgaatgtctgaaagaacagggtgtggacaccgtattcggatacccgggcggagccatactgaatgtatacgatgaattatataagcatcaggagattcggcatattttaacctcacatgagcagggagcttcccatgcggcggacggttatgcgagaagtaccggaaaagtaggagtctgtttcgcaacgtccggaccgggagcgacgaatcttgtgacgggaattgccacggcatacatggattccgtgccgatcgtagcgatcacatgcaacgtcaatgtgccgcttctcggcaaagacagttttcaggagatcgatattgcaggcatcacgacgccgatcacaaagcacaattttatcgtaaaggatgtcacaaagcttgcggacacgatccgcagagcattccggatcgcgcagaaggggcggccaggtccggtgctcgttgatatccccaaggatattacggcggcaaagacggagtatgaattctgcaaggcagagccgatcgcgcgcgtgacggacacgatacgggaagaggatcttgcgcaggcgcttgcgatgataaaagcggcggaaaaaccgtacatttttgtgggcggtggcgctgtgatctccggagcgagcgcggaattaaaagaatttgtacataaagtggatgcgccggtgtgcgattccctgatgggaaagggagcctttgacgggacgaacgatctctacacggggatgctcggcatgcacggaaccaagacgtccaacctcggcgtgagcgagtgcgatctgctgatcgccgtcggcgtgcggttctcggaccgtgtgctcggcaatgcaaagaagtttgctaagcaggcgaaaatcctgcagtttgatgtggatgcggcggagatcaataaaaatatccgggtagacacatccgtgatcggagatctgaaggaagtgttaaagcggatcaacgcagaactgccgcagctggggcatgaggcgtggatttcgcatattctggactataaagtaaaatatccgctcacataccgggagtcggggctgaccggaccttatctggtggaggagatctaccgccagacaaacggcgacgccatcattgtgacagaagtaggacagcaccagatgtgggctgcacagtattataaatataaaaatccgcgcacgtttttatcatccggcggacttggcaccatgggatacggactgggcgccgcgatcggcgcacaggttgcaaatctgggaaaacaggtgatcaatatcgcgggggacggatgttttcgcatgaatatgaacgagattgctaccgcagtccggcagaagctgccgttgatcgaagtgattgtgaacaatcatgtgctcggcatggtgcggcagtggcaggatctgttttacgaaaaacgttattcggcgacggttttagacgacggcgtcgactatgtgaagcttgcggaggcgatgggggcgactgggtaccgcgtcacaacccgcgaggcatttaacgaggcgttaaaagcagcgcttgctgcaaggacgccggttgtgatcgattgtgtgatcggctgtgatgacaaggtgtggccgatggttgctccgggggcggacatcagtaccgcatttaccggggaggatttagccgcagcgcagtcataacatgtgtatatgttttgttacagggggcatggaggcggcagcgtagggaactgccgtaataaaagagaaaggaaaggaattagaaaatgagcagagtgtacaatttttcagcaggtccggcagtgctgccggaagaggtcttaaaagaagcagcagatgagatgctggattacagaggaagtggaatgtctgtgatggagatgagccaccgctccaaggtgtatgacaatatcatcaaagaggcagagcaggatctgagagatctgatgaacattccggacaattacaaagttctgtttttacagggcggagcatcccagcagttcgccatgatcccgatgaacctgatgaagaaccgcaaggcaggctatatcgtcacaggccagtgggcgaagaaagcttatcaggaagcacagatttacggcgaggcagtaaagcttgcatcctccgaggataagacgttttcctatatcccggattgttccgacctggatatcccggaagatctggattatgtgtacatctgcgagaataatacgatctacggaacaaaatacaagaagcttccgaataccaagggacacacgctggtagcggacgtatcctcctgctttttgtccgagccggtggatgtgacaaaatacggtgtgatctacggcggcgtgcagaagaacgtaggaccggcgggagttgtcatcgtcatcatccgcgaggatctgatcacggaagatacccttccgggaacaccaaccatgttaaaatacaagacacacgccgatgcggattctttatacaacacaccgccgtgctacggcatctatatctgcggcaaggtattcaagtggttaaagaagatgggcggtctttccgtgatgaaggagcgcaatgaggaaaaggcgaagatcctttatgatttcctggatcagagcaaactgttccacggaaccgttgttccggaggaccgctccctcatgaatgtgccgtttgtgaccggcaacgaagagctggatgcgaagtttgtaaaagaagcgacagccgcaggctttgtgaacttaaaaggccaccgcaccgtgggcggcatgcgcgcttccatctacaatgcaatgccgaaagagggcgtggagaagctggttgcgtttatgaaaaagttcgaggaggagaatgcaaatgcataagtatcattgcttaaatccgatcgcagcggtcggtctggatctgttttcggatgattatcagaaggtggaagacttaaaggatgcggaggcagtgcttgtgagaagcgccgcaatgcatgacctggaactcccggagggacttgcggcagtggcgagagccggtgccggcgtgaacaacattcctctggataaatgcgcggagaagggaattgtcgtattcaacaccccgggcgccaatgcaaacggtgtcaaggagctggtgtttgcgggaatgctctacgcgtcccgtgatatcgtgggcggcatcgactggtgtctggcgaatcagaacgacgagaatatcgccaaaactgctgaaaagcagaagaaaaattttgcaggaaccgagatttccggcaagaagttaggtgttatcggacttggtgcaatcggtgttctggttgccaatgcggcgacccacatgggaatggaagtgtacggctacgatccgtatatttccgtcagtgcagcgtggagcctttcccggagcgtgaagcacatcagcaacgtggaggacatttaccgcgagtgcgactatatcacgattcatgtgccgcttttggattccaccagaaagatgattggcgcggatgcgattgcaatgatgaagccgacggcgatcgtgctcaactttgcgagagatcttctcgtggatgaggaggcgatggtggacgcacttgcagcgggcaagatcaaaaaatatgtttccgattttccgaacaccacgacagtcggtgcaaagggctgcatcgtgacaccacatctgggcgcatccacggcagagtccgaggacaactgtgcgctcatggcagtgcgcgagatccgcgattaccttgagaacggcaatatcgtacattcggtcaacttcccggactgcagcatgggcgcttgcatgacggcaggaagaatcggtattctgcacaagaacgagagtggtatgttaagccattttacaacaattctcggcaatgccggaatcaatatcgacggcatggcgaacaagtccaggggcgactatgcatatgcgctgatcgatgtggatacgaacgtgccggaggatgtgctcgcaaagctgaagcagacggatggagtattaaaagtacggaaagtaaaataacgaggtgtgagaacaatggcagaaatcagaccatttgtaagcatcagaccacagagagggaaggcagcagagattgctgccctcccttatgatgtttataacagagaggaagctacgaaggaagtggagcggcatccgccgtccttccttagcatcgaccgcgcggagacgcagttcccgctgtcggtggatatgtacgatgacaaggtgtatgaacgggcgcatgacacactctggcaatgggtggaggacggcacgtttctgacggaggacaaaaagtgctattacctctacgaactcaccatgaatggaagagtacagacgggagtggcagcctgcgcgtccatcgatgattatgagaacggggtcattaaaaagcacgagaatacccgtgcggagaaggaggtcgaccgcatccgccatgtggatgtctgtaacgcacagaccggaccgatctttttggcgtaccgcgcggatgacgggatccggcgtatcgtggaaaagacgaagcggggagagccggaatatgatttcacatcggaggacggcgtgagacaccgggtgtttgtcattcgcgaggatgcggatattgctgcgatccacgaagcgtttgcgggcattgacagcatctacattgcagacggacaccacagggcagcgtccgcggtaaaagtagggcagaagcgccggaaggaacatccgggttacaccggggaggaggagtttaactattttctctcggtactgtttccggatgatgaacttatgattatggactacaaccgtgtggtccgcgatatgaacggatattcttttaagggattgtaccgtgaagttgagaagcggtttgatgtggaggagattaccggggcagaggataccagacctaaggagcggggaaccttttgcatgtatatggaaggacactggttttcctgccatatccggcaggaggaccgcacgccggaagatccggttgcagatctggatgtttccatactgcagaataagcttcttgaaccggtgctcggcatcagagatccgaagacggacggacgcattgatttcgtcggtggaatccggggcatggacgaactggtgcggcgttgtgagcaggactgcgcggtggcgtttgcaatgtatccgacgtccattgcggagctgttcgcagtggcggatgcgggacttttgatgccgccgaaatcgacctggttcgagccgaagctaaggagcggtctgtttattcatgaaatttaagaaggattataaagttggatggaggacgagagagtgaacgggatagcggcacttttggaacagggaaggtatctggcggcacagacagatgcattcccgtcgaccacggagaccgtggaggcattgaaccatgcacaggagggaattgaggaggtagcaaagaatccggggattatccgtacatggctggaagggctggtgccggatctgttaaacttcgcattccagattctgatcgcactgcttgtgtatgtgatcggaggcaggatcatcaagtggatcacaaagctggtgcggcgctcgatggaccgggcgggaaccgatgagggcgtcaagcagttcatgataccggtgatcaagtattcgctgtatgtagtgctgatttttatcattatgggattgtttggaattgcgacgacatcagcggtggcggtgcttggatcggcgggtgtggcggtcggtctggcgttgcagggaagcctgtcgaattttgcgggcggcgtgctgattttgctgttaaagccgttcaaggtcggggattacatcattgaacattcccacaataatgaggggacggtcacggagatttccattttttataccaaacttcttaccgtggacaacaagctgattgtgataccgaacggtacactttccaacagcagtcttaccaacgtgaccaacaaggacagacgtcgtgtggatctcgtggtgggcatcgcctatgaagcggatatccgcactgccaaagatgtgatctatgcggtggcggagaaggaggaagccagaatcccggaggagaagcctgtggtatatgtggacaacctggcggcatcttcggtggacattggactcagggtctgggttaagaccgaggattactggccggcgcgctggcgcatgacggaaaatatcaagtatgcgctggatgcgaagggaatttctatcccataccagcagattgatgtgcaaattaaacaataacgatagaaaaagattgacaaaaaaagtaaaatgtgctaatttcaatttgttgttttatacagacaggaatagtctgtaatgtcagaactgtattgaggagggtttttagaattatgcagcagggtactgtaaagtggtttaatgccaagaagggctatggcttcatttcagatgcagagggcaacgatgtatttgtacatttttccgcactgaatatggatggattcaaggagttaaaggacggcgagaaggtcgagttcgaggtgactgagggtgcaaagggaccgcaggcagcgaatgtgacacgcatcgcatagggagttcttatcagtagaatatatctgtgaagacatgggaggaggctgccgcattcaggcagcctcttttttgcgtttggacaatctggcaggtgcccagcaaatcagggacaatttcaggaactttcatgtggtactttgccggcaccgttcgcagagtgttccagacaaaatctatagatagtttactcttttgcagaatgggaaaagctgttataatagaacacagtgtaaataccggacatacaggatgaccgggcaggaaaggaattatggatttatgaagctttcagaattgacagcatatgagctgcttggtgagcaggagttaaaggatatccattcgatgggatatattctgcgccataaaaagagcggggcgagaatcaccgtgatctccaacgacgatgagaacaaggtgttttacatcggcttccgcacaccgccggaggattcgaccggtgtgccgcacatcattgagcacacagtgctctgcggatcggacaaatatccggtcaaggatccgttcgtggaactggtcaagggatcgctcaacacatttttaaatgcgatcacgtacccggagaagaccatctatccggtggcgagctgcaacaatgcggattttcagaacctgatgagtgtctatatggatgcggtgtttcatccgaatatctacaagcacagagagatttttgagcaggaaggctggcattacgagctggaggatgaagatgcgccggtaacgatcaacggtgtggtatacaacgagatgaagggcgcattctcgtccccggatgatgtgttggagcgcctgattttaaattcactgttcccggatacctcttacgcaaacgaatccggcggcgacccggagcatattccggagcttacctatgagcagtatctgaacttccacagaaagtattatcatccgtgcaattcctatatctatctgtacggggatatggacgttgcagaaaagctgcgctggatggatgaggaatacctcggaaaatacgagcagatcgagcttgattctgcaatccggatgcagaagccgttcgctgtgccggtggagatcgtaaagccttatccggtggcgtcgggggagacgcttacggacaacagctatctgtcttacaatgtggtggttggaaccgttctggacaaaaagttataccaggcgtttgacgttttggactacgcactgctttctgcgccgggagcgccgcttaagcaggcgctgatcgatgcgggaatcggcatggacatcggcggcggctatgataacagcacgctgcagccggtattttctgtgattgcaaaaaatgcgaatcaggagcagaaggagcagtttttgcaggtgatccgtgagacgctgcaggcacaggtggcagacggaattgatcaaaacgcattgttagccggaatcaacagctcggaattccgtttccgggaggcggatttcggacagttcccgaagggactgctctacggaatccagtgtctggacagctggctgttcgatgatatgcagccgtttatgcatctggaagcgctggacacctatcagtttttgaaggatcagatcggaaccggatattatgaggagctggtaaagacttatctgctggacaatccgcatgcgtcggttgtgattacggtgccggagcaggggctgggcgcaaagagagatgccgcgctggagaagaagctggccgaatacaaagcgggattgtccagggaagaacgtaagaagctgatcgcagacacgaagcacttaaagcagtatcaggaagagccgtcgccgaaggaagacttagagaagattccacgccttacgagagcggatctgaaaaaagaggcggcgccgcttcttaaccgtgagattgagacggagggcgtttccatcgttgcgcatgagatggacacgaacggcattgattacctgacctatctgtttgatgtgtgcgatattctgccggaggatctgccttaccttggcatcctaaaggcggtgctgggatatgtggatacggacgatcattcttacgcggcgcttgccaatgagatcaatatgtacacaggaggaatcggcagcagcatcggcatctacccgaatgtcaaaaagcagggtgaaatcggactttactatgaagtgcgcacgaaggtgctcgcatcgagactgccggatgcaatgcgcctgatcaaagagatccttctgacttcgcatcttgcggatgagaagcgcatctacgagatcctggcacagttaaagtcgagattacaggcgggactgagcgcttccggacattccgtggcatatacgagagcgctgtcgtatttttcggcggctgcctactgccaggacgcgacggcgggcattgcctgctaccgtgtgatcgcggattacgaggagcattttgaggagaaaaagcagcagctgatggagaagctgtcctcccttgtgaaaaccatttttacagcggagcgtatgctggtgagtgcaacctgcgaggagtcggagatcccggcggtgacgcaggcgtcggctgcattgaaaaatgtattgtatgtgccggatcagccgggtaagaatcgctctatgccgtcctatccgctggcaaaaaagaacgagggatttatggatgcatcccaggtgcagtatgtggcgcgtgccggaaattatgccgcacacggcttttcctatcacggggcgctccgcatcttaaaagtaattttaggatacgattacctgtggatcaatgtccgcgtcaagggcggcgcttatggctgcatgaacggatatatgaggaacggagatacgtattttgtgtcctaccgggatccgaatctctctgcaacgaatgagatttatgacggcattccggcgtaccttgagaagtttgatgccgatgagcgcgagatgacaggatatatcatcggaacgatcagcgatatggacacgccgatgaacccgagcgcgaagggtgcgcgttcgatgacagcctatctgcaggagctggactacgagacgctttcaaaggagcggagccagattatcggggcacagccggcggacatccgcgcattgaagcctttgattgcgtcggtgctctcagacggcagcctgtgcgtgatcggcaatgaagatgtgctgacatcggaaaaacagatgtttgagacacttgagagcctgacctgatgcggggcggggaaaacagtacagaaacgaggagaacgatgaaagataattttaaatccggatttgtgacgattataggaagaccgaatgtgggaaaatcgacgctgatgaatcatctgatcggtcagaagattgctatcacgtcgaacaagccgcagacgaccagaaaccgcatccagaccgtgtatacggatatggagcgcggacagattgtgtttttggatacgccgggcattcatcaggcgaagaataagcttggagagtatatggtgaatgtggcggagcacacgctttcggaggtggatgtcattctctggctggtggagccgtccacgtttatcggggcaggcgagcagcatatcataaagcagctaaagaagacgaaaacgccggtcatcttaattatcaacaaggtggataccgtggagcgggaaaagatcctggagtatatcgatgcttaccgcaaggtgtttgattttgcagagatcgttccggcatcggcgctccgggaacagaatctggatacggttgtggacgtgattttcaagtacctgccgtacggaccgatgttctatgacgaggagacggttacagaccagccggaacgcgccattgtcgcggagattatccgtgagaaggcgcttcatgctctggatgatgagatcccgcacggcatcgcggtctacattgaccggatgaaggagcggagagggcagaacatcatcgacatcgatgcaacgatcgtctgtgagcgcgattcccacaagggcatcatcatcggaaaaggcggttcgatgttaaaaaagatcggatcgaacgcccgctacgagatggagcggcttttggatacgcaggtgaacttaaaactgtgggtgaaggtgcgcaaggactggcgcgacagcgaactgatgatgaagaacttcgggtacaataaagacgatatctgatactgccaattttttgctggtataatggcggagccatcggagaacctaatcttagaggcgggaagcgtcaaagaaacggaggatatgccgatggaggaagcctggagagactttttagtatcaggaagagtgactgattacctgcgctaccggaatgcagtggatgtgcaggagagcagtaatattttggcgggggaagagcagccggatgggaaacaatattgtggtgaccgggatggtcctacaggtaatgccgattggcgaatatgacaagcggattacactgctgacaaaagaaagagggaagatcacagcatttgcgcggggagcgaggcggccgaacagccagcttctcgcagctgccaatccgttttgcttcggagagttcgagctgttcgagggaagaagtgcttacacgcttgccagagcgacgattcagaactatttccgggagctgaccggggattttgatgctacatattacgggttctattttctggaatttgcggattattattgtcaggaaaataacgatgagcgcgagatgctaaagcttttgtaccagtcgctgcgcgcccttgcgagcagtgcctacgacaaccggctggtgcgcgcggtgtttgaactgaaggcgctggcggtaaacggcgaggctccgaatgtgttttcctgtctttcctgcggcagcagggagcatctgacctggttttccgtcaagcgcggcgggattctctgtgcagaatgccgcaatgaggcgccggatgcggtggaattgaatgaatccaccgtctataccatgcagtacgtgatcttggcgcggattgaaaaattatatacgttttccgtgagcgggcaggtgctggaagaactgaccagacttttgcgcagctattttggcgtgtacgtgggacacgccttcaagtcgttaaagatacttgaggatgcggaaaaggttgaaatcatgtttttaaaatagtataatatcaccgatactttttcagaaagaatggagattatgtgatgaagagattagtgtgcacggtctgcagtgtactgttgtgtgtgggacttctctccggatgcggtacctcgctggagggagaggaaagtgtcgtgtacgtgggaaagaaaggcgtgatagagtcgctggatgtggagtcgctcgatcagtcctactacgatgagacggaactgaagtcctatgtggatgcagaggtgaaagattacaccgcggagcatggcaaaaatgcagtcgaggtggagagccttaaggtggaagacggtgtggcgaagcttaagatgaagtacaagacaccggaggattataccgcgtttaacggaattgaactctatcaggggaaagtcgttgcctctctggcggcaggatacgtctatgacggggagttcgcccgcgtggaggaaggcaaggttgtgggagctgccacaaagcaggatatttactctgaggatgatctgaaagtggctattatccgtgccaatacagatgtgaaagtggacggtgagatctgctatgtctcctgtcagaatgtgaagctgactggaaccgacagcgtatcgatccgtgacggatattatcttgagacgggaagtgtgacggcagctgtggatgtgaccgggcaggagaacaccggcaccgagcagcttccgggaaccgaacaggcggaaatgaccggggagaccgtgcatacggatgataccgagcagacagagagcacgtccggcgacggctcgttcgagacagacgtatatactttcattgtttacaaataaacatatcacaatataacctaagaaaggcgaggaatttagaatggaaaaatcaatggacaaaatcgtggcgctggcaaaatcaagaggtttcgtatatccgggatcggagatttacggcggacttgcaaatacatgggactacggcaatctgggcgtcgaactgaagaataacgtcaagagagcatggtggcagaaatttattcaggagaatccgtacaatgtcggtgtggactgtgcgattctgatgaatccgcagacatgggtggcttccggacatctcggcggtttctcggatccgctgatggactgtaaggagtgccatgagcgtttccgcgcggataagattatcgaggactacgcggaggagaagggcatcaccttacagagctccgtagacggctggacacaggaggagatgaagaacttcatcgaggagaaccaggttccgtgtccgagctgcggcaagcacaattttacagacatccgtcagttcaacctgatgtttaagacattccagggtgtgaccgaggatgcgaagaatacggtttatttaagaccggagacagcacagggcatttttgtaaacttcaagaatgttcagagaacttcccgcaagaagatcccgtttggaatcggccaggttggaaaatcgttccgtaacgagattacgccgggtaactttacattccgtacccgtgagtttgagcagatggagctggagttcttctgtgagccgggaaccgatctggagtggttccagtactggcgaggcttctgccgtgactggctgatctcccttggcattaaggaagacgagatgcgtctgcgtgatcacgatccggcagaacttgcattctatagcaagggaacaacggacattgagtttttattcccgttcggctggggagaactctggggcatcgcagaccgtaccgactatgatcttggcagacatcaggagacgtccggtcaggatcttacctactttgacgatgagaagaacgagcgttatctgccgtacgtcatcgagccgtctctcggtgcagaccgcgtggtgcttgcattcttatgtgctgcatacgatgaggagaatatcggtaccgaggagaagccggatatgagaaccgtgcttcatttccatccggcactggctccggttaagatcggagtgcttccgctttccaagaagttaaacgagggtgcagaaaagattttcgcacagctctccaagaaatataactgtgaattcgacgacagaggcaatatcggtaagagatacagaagacaggatgagattggaactccgttctgcgtaacatacgattttgagtctgagaacgacggtgctgtgaccgtgcgtgatcgtgatacgatggagcaggagcgcatcaagatcgaggaactggatgcttactttgcacagaagtttgcgtggtaggcagatggagaagataaaaaagttttggaatgccgtatcgtatgaggttgtgattgcagccggcctgatcgtctggtttctgacaggcagggcgttagacctgcagggctggtcatcggcatggaatgcgatggactattccatgggaacgggatcaaggcttctcatcgggagcatttaccgcctgttttacggagagtatctggattacacggtggcatacaaatacgtcgccgtgggaacgatgctcacgatactggtgcttgccattgtgctggggagaatgatccgtcttgccgtcgctaagaacgatcagatccggcacgccgtctttggggcggtggcgctgtaccttgtcgcaccgttttcgattgcctatgtgtggaacgatcagaatttaggcagactggatgtctacatgctgttggttgcactgctggcactgcttgttggtcttacgattaagaatacatatgtgaagtgtgtctgctataccgtgctcggtgtcgtgggacttgccattcaccagggatttgcatttttgtattatccgattgtcttttcggtgatggtatatgacgtgtttgaggaaaacagggtgcatgccggcaggtttgccgccgcgtttgtatccggcctcatcaatgtggcggtagcggtatattttcagtttttcagcagtatccattttgacagtgcgaaggaacttgtgacatttctggaggggagaacgaacctcaccatttcggaatatgcgcttgatattgaatattttctgaaaatggattaccagttgaaggagattacaccccagttttacaaatatgatgcaccgatccggcatgcgctgttggttcttctgttgctgctgccggtgcttgtgtggtgttttcagatttaccgggatgtctttggctggcagaaaaagagcaatgtgaagtggtatgcatcgccgtatttttacatgctgctaagccagctgtgttttgtgccgatgttcgtgatccacacggactggggcagacattttgcgccgctctttgccatgcagatttttatgtttctgttctatgcggcgaagggagagccggcgatggtttacgcgtgtgagaatatgtgcggcaggatgaagaagcatccctggatctttgtcgtgtcgatcctctggatcgcaaagctcgacagcttcggggctagagatttcttgaaacaggcaacgtatctgtttgatttcctgcagcgtgggttttttatcaactgaatcggactggaaaaagaagggcggaaccggagattgcggttctgcctttttggtttgcgcgccatgggcgcgctctaacgggtgaaagtcccgaacacgcctaggcaacgaggaagtgtatagccgaacagcaagggtgtctatcgtgaggtggaatctgaaggaagctgtaa

SEQ ID NO: 7 - DNA, 274994 bp, Roseburia hominis
acagcttccttcagattccacctcacgatagacacccttgctgttcggctatacacttcctcgttgcctaggcgtgttcgggactttcacccgttagagcgcgcccatggcgcgcaaaccaaaaaggagcgccttgcggcactcctctctgtgaaagaaatatataaattttgaagcaagctttttcttccgggcggtttccccggttttacagatgccagatgtcctcattgtactgtgcgatcgtacggtcagaggagaagaatccggctttgctgatgttgatgagcattttcttcgcccacgccatgcggtcttcataatccgcatagatgcgctccttggttgccacataatcctcgaaatccggaagcgtcatgaaccagtctttgttcagaagttcgttgtaaagacgctctaaattctctctgcatccgactgccatcatctcgtcgctgacgataaagtccactgcacgcttgatgttcgcatcattctcatagtagcttctggacacataatctgccttctcgtagtgcttgatgacttcctcggaggactcaccgaagatgtaaatgttgtcgtcgccgacaaactgatgcatctccacgtttgcaccgtccatggttccgatcgctaccgcaccgtttaacatgaacttcatgttggatgttccggatgcctccttggaagcaagggaaatctgctcatggatatctgcagccgggatcagcttttcagccagcgtgacattgtagttttctaccatcacaacctttaagtacggagatacctcagggtcttttgcaatcagttcggacaggcagaggatcagatgaatgatatcctttgcaatcacgtaagccggggctgccttggcgccgaaaatcacagtgatcggacgggtcggcttctttcctgccttgatctcgaaatatttgtggatgacatacagcgcattcatctgctgtctcttgtactcgtgcagacgcttgatctggatatcgtaaatggaattgtcatccagcacgattccctgtgtttttgcaagataatctttcagctcagtctttctgctgttcttgacatcaagcaggcgctgcagaacggaagcgtcatcgacaagcgcgccgagcttctccagttccatcgcatccttcttaaagcccggtccgatcagggattcgatcagatctgccagctcgtggttgcagtgcagcagccagcggcggaaggtaatgccgtttgtcttattgttgaacttctccggatagatcttgtagaagttgttgagctccgtatttttcaaaatctccgtgtgcaggtaggcaacgccgttgacactgtaaccgtaatgaatatccatatgtgccatatgcacacgtttctcgtcatcaatgatcgcaaccgacttgtcatcgtatttgcgcaccacgcggctgttcagttcgtagatgatcggaagaagctgcggaactgccttttccaaaaaatgaatcggccatttttccagtgcctccgcaagaatcgtgtggttagtgtatgcgcaggtcttcgatacgatctcaatcgcctcatccatcagaattccacgctgcatcagaagacggatcagctccggaatcaccatgctcgggtgtgtatcattgatctggattgccgcgtactcattcaacttgtgcagatcaccgcctcttgccagcgtctcgtcgatgatgagctgtgccgcattgctgaccataaaatactgctggtatacacgcaggatgcgtcccttgtcatccgaatcgtccgggtataagaacagcgtcaggttctttgcaatatcctctttgtcaaaattgatgccgtcccccacaaggctctcgtccacggtctccacatcaaacaaatgaagctttgtggtgcggttctcgtaaccaatcacatcgatatcatacagtctggactgtaaggtaaaaccgccgaactgtaccgggtaggtcacgttcgttttcgtcagccagctctccttctcgatccacgggttcggctcctcgtgctgtaaattgtgctcaaatacctgcttgaacagaccgtagtgataattgagacccacgccgtcgccgtttaatccgagcgttgcaatggaatccaggaagcatgctgccagacgacccagaccgccgtttccgagagacggctccggctcaacctcctcgatctctgccaggttcttgccgttctccgccagaacctgctttacttcctcataaataccgaggttgatcaggttgttggataacagcttaccgatcaaaaactcggcggagatataataaagcttgcgctttccctcgttgctctccttttccttcgccatgctctttgtcatctcaagcagcgcgtaataaatctcttcgttggagcactgtgcaatgcccttaccgtatctgttgtttacgatttcctgtacgttcatgtgaatcctccttgttttgcgaagcaaaatccgagtcctttgacgaggagaggattttactccttgttttgcatccccaattactttttgtatttccctgctgtatgagaacattatatgcagaagtccactttttttcttgtcatattatccccaaaagtggtacaatcctatcatgaacattttagagtatgaaaactatcaggaaaaaattccacatggcaacccgctgtttccttatatcacctacccttgctcgattccgcttgacttttcgcgcgtgcctctgcactggcacgatgagatggaaatcatctatatcaaaaaaggaaccggagcaatcacggtcgatttcaaatcctacgtggtgactgagggaaccatcgcgctgattctgccgggcaggctacacagcattgaacagtacatgcaggaaagcatggaatacgaaaatatcattttccatccgggcatcctcatttccaaaaaaacggacaccagcaataccgaatttcttgcgccgctgttgtcgggcgtcctgtccgttccgctcttatatcagccgggatctccctgctatgcggagattgccgcctgcattgacgcaaacgatgaaatcagccggacgaacccgcccggctatcagttctttatcaagagccagctctttatgcttttttacatcttattcaacaaatgcctcttaaaagagccggcaaagcgcgaccacaaatcgctggagaagatgaagctgatcttaaaatatctggagaaccattatatggagcgcattacgattgcagatatctcggcggaggtcgggctgagccagtcgcatttcatgaagtatttcaagaatacgatgggcacttcctttattgaatatctcaatgaataccgcctgaccatggcttcccggctgttgatctcctccgaatcctcgattcttgccattgcggaggaagtcggctacgagaatctgtcgtactttaaccgcactttcaaaaaaagattcggcatgactccccgggattaccgaaaacaatccacgaagcagttgtaaaacgggtcccacagaggattttccttgttttagacccgtttttcttcatttttccagtcaaaatggtgctttttctatgtaaaacgggtccagagcagattttttcctctgccagacccgttttttgcaaaaatccgggtcccacagtcatttttttctcctgtggacccggatacctctttttcacacgtctgaacataccatctggacagtttttctttttctcgtgctttctctttcttttttcttacgattctatatcaaagtcaatgcttcccataccgcagtccagatcaatcgttcccacagccccggcattcgtgactttgtagcttccgctgagatcggaatagctttctccgtttaccgtgagatcccccatgccgcaggacatcttataattatagtcctcttccctgccgcgcagggtgatgctgccatcccccatgccgcaatgcgctttcacattctctgccacaatgccgtccagcgcaaatgatcccataccgcaatccagcttaatatctttataggtgcctccttccagatcaatatcaccggctccaagcttgatgtccagggttcctgtcacagcaaaatctgctcccgtcagttctcctgctcccacattcagctccatcgttctgcagttcacactgcccgatgcaaaatctgcatctgccgccccgatgtcaaagtccatggtatcaaaggtcattttctccggaatctcaatcacaatctgcgcatcataattgtccggaaactgcttatgaatctcatactgaatctgaagcgtatctttattcatatcccctttataatatttttctttgcagccgtaggttctcaccacaaggtttttatcatccgtcccctgcttgacatagatttccgcagcatcaatatcaatatccagattttttatgccggctgcctcataggtataaacttttgcatcgtcgtctgctccccagtcatcctctgtgtcttcttcatccgaagaatagtaaagttcatatggccggatatgccagttgcccgcatccagttctcctctttccgccatgcgtctgattgccccaaagcctccgccaagcagagcggagatgccgccgagcaataatcccattcccccgagaactgccacaatgatcaggcagatttttgaaaattttttcatgctgccgcacgctcctttctcttattaaatggctttttgcaaagcttccagattcctttcaatgcccatggcagaaatcctccgaaaatccagaccacgagcaccaccgcaagaataccgatcgccagcacgatgagtcctcctcccataagcccgattccgattgcaggatttcctgcaaatgcacttccgattcctgcaccaaagagcaccacaccgcagattaacagtgctcccatgactgccacaaccgctattgcaattccaaacagcgccgccacaatgccgagcaatgctgacagtatgaccagaatcattaccagccacaccggcgaagtgatgaccagaagaacgatcgcccatcccggcattccatccttctcctgcgtagaatacgctgcattctgcgctgctccctgtggtactcccttcgatgcgttctgcgctgccccctgcactgccggattccactctgctcctgttgctgctccctccggtgcgctctgcactgccggattccactctgctcctgccgatgctccctgcgcgccggaagaacacgcgtccccgggctgcacacccagatctttgataatgctgtccgccactttctgcggtgattccagttcttctaaaatctttgcctcattcgcctctccggcgtcctcaaaatagctgcggtagaatgcaagcgcctccgttctttcctcctgtgaaatcccggacagcagcgcttccagctgccttaaaaattcatctttgttcatcttcaaactccctcctcggaaaataactctgatattttcgaagaatagtcatcccattctctgcgataatcgtccagcttctttcttccctcatccgtaatcctgtagtagcgcctgttgcggcctccacattctctgtcatacaccataaggcatccatctttctgaagtctacgcaataccggataaagtgtggattccgaaacctcaatcgccactctcacatcctgcgtgatcttatatccatatgtgccttcctcctccttggagacgaccgccagaacaatcgcatccagcagggctgcacctgtattgaacaccatattaccggctcctttcctgttctgtctgatattacttatatgtttataatattattttgttatcaatactatatatcatataatatagtattgtcaatattattattcaaaaataatacatccattttctaaaagagaaaaaaaagaatcccgcaaacaggaatgctcctatgaatcaaaaaatcgtacatgcatgtgtaacgcttacacaacatgtacgatttacatttttgattcgctttatctccggcttctgtctgccctacgcttcccagtccgcgcgtttgataatccccacgccgatcggatacggtccggtatgaacgccaatcgttgcgccgatctggtaaatctcaatctcatcaatccccaggcgctccctcacgagatcttttaacatctcacgaaaatgacaggcttcctcataatcatagccatagccgatggcaaaactgtattcgcccggctttgcggtgcgttcgtccagataagccttgagcatctcaattactttctgcatggatttttcccggctccgcgcaatgccggaggcaaaaatctcgccctccttcagtgtgatgagcggcttaattttcaacgcgcttcccgcaatccccatcacttttccgattcttccgccatgctttaagtaatcaatgttgccaatcgtaaagaagattctgccgctctcccttatggcaaggagcctctccaccatgcggtcatactcccaaccgaggtcgcgcagccggcatgcctcaagtacatacaaaccctgcagcaccgtgttgatctctgcgtcaatgactgtgatgcgcgcctttggatattcctctaaaatcatatctctggcagtcgtcgccgactgcatggagccgctgaacttcgtcgtgatacagatacagatcatcggaacatcctgctttgcgagcgggagaaaaacctgataataatcatccaccgacggcatcgacgtcttcggaaatacatccggatgatccaccattctctgatagaactcgcggatatccagttccaccccctctttcagataagtttctccatcaaaagatacatagaaaggcaccaccagaatatcgcgctctcttgtgagctctcttgaaaggtctaacgacccgtcactgataatttgaatcttttcctgcataaatctccttcataatctgttcatcagaataaataaacaccgcgctccgtgacacggatctccgggattaccgtaagcgccataaaagaaagggtaacaaacggatctacattctctgagataccaagttctctcgtctccttctgcatggcagagagcttttccgtgacttcctcataccgtctgtcgctcataagacccgcgatcggcagcggcagtacatcgattacctttccgccggacacgatcgcatagccgccctgctgctcctccacagtccggatggcaagcagaatgtcatcgtcattgtctcccgccacaatcagattgtgggaatcgtgcgcaacggacgtcgctacggcaccgccctttacgccaaagcccttgagcggtgccacaccgatctctccggtcttgccgtgacgttccaccacacagatcttattgtatacttcattcgggacaaaatatccgttttctgtcggcacttcttccaccagatgcgtcgtcacgatctgatgcgcattcatctgtatcacatcggtcttttcgttgcatgcaagctgaatccgctctctggaaagctccccgacatgaaccgtgtgaagcagttcctccggcactggaacccaataatctttcttatagtcttcctctcccaggatcctgccgtccttcatcacatcggtcggacgcacctcctccagattatcgaggaacacaatgtcggcgtgatatccggctccgatggcaccgtatcccttaagcccgtaaaacattgccggctggtagcttcccatcttgtatgcctttgccaccggaaccccaagtgcaatcgccttgcggatacaggtgctgatatgtccttccttgcggatttcctcgatatgcttatcgtcggtgcagaatgcgcactggtcgagcgccacattggcatctaaaagcgtgcggattaacgtttcaagattcttggcaccgcttccctcacggatatagatgtgaaaaccggcgcgcagcttgtcgagcacttcctcggagttcgcacactcatgatcattctccacgccagccagacggtacgcctgtaccgcctttcctgtaatgcctggtgcatgtccgtcgatgtgcttctttgcaaaaagttccagcttatccgacatccggcgctcgccctggtaacactccacaaaacgcatggtctccccgagtcccaacactcgtgcatcatccacatacttcatcatatcggacgccagaaactccccgcatccgtttgtctccacatcggttgccggaacagaggacggaatcatgaagaaaatatgtaccagcgccttgcccgcacatttcaggaaataatccattcccttcacaccgcacacattgacaatctcgtgcggatccgcaacaatggtcgtcgttcccgcctgcaccagcaccttggacaattcgcccggagataccatactggattcaatatgcatatgggcatccagaaatcccggtaccagatattttccggtacagtcgatctcccgctcgccctcgtaggaaccgactcccacgatcgtatcgccgcagattgccacatccgcttccagaatctcctccgtgaatacgttcaatactttgccgtgctttaatacaatgtctgctttccggattccgttcgcgcaatccagccgtctctttctgtctaccatagattccttcctctcctccgtttacgaaaacaatcccttaaagaagtccgcgatcgagctgaatacatttgagaaaaatgtgcctacgctcgagagcacgctgctgtctcctccgccatccttaaaggaatggtacagtgactccgcataatccacaaggctgtcaagattgattcccagagatgtaatctttaagagcagatccacgatctgctgacgctcggaatctgacagtgtcacattatatttgctgcaggcatcatcaattgcctgattgatgctcgcctcatctttcagatcattctgtgcaatgaccgacttgatgtaagcgataaactcttccacttcctcatcggaaagtccggcaatcgactgttctaactgcccggtaaccacgagctcatttaaggatgcgtcgatgatatccgcattgatcgtctcacctgtcatctcctggtatgccttgaatacgccgacaagcgccgccgtgccggagatctcctgcggtcctgcaacgatgatatccgcatcggtaatacccgccgttgtcaacgcatttttgtacatgccgactgtacagtaattgatattcctggttgaaatatttaatccgtttcccttatcgcgttttacgatcacaacggaagaccatgacttgcttccgatctgtgaggaactgatataggaatccagatactgatgctcctctgcattcgttgtgtagaccacatcataattgccaaggttcgccggatcaatccccatcagtgaaagcaccgtattcttctggacatccgtcagatccgctcccagcgcaagatatggcttatcatccgcctggattgtcacgttatcactgtttgctcccgtggcagcgttctccgctgccgaagcctgtgactgatcctgcgcctctgccgaagtctgatcctgccctgcctgattctgcgactctgctgaagtctgatcctgacttgtctggtctacgacaacctctccctctacattcgctggtgtatccgccgcggatgccgtcacaggcgccgatgcaagcatcaccgcagccagaaataaactggtaactctcattccattctttttcatgtgaaatcctccttccaaaacaagtctctattttactacgaactttccttaaaaacaaccggcgttttccctccagtagttttatttatataaatttaagaaacctgtccggcaagattacagttccacatgcacgttcagccaagccgcaatatccgccatgacctgatcgcggtctgtctcgtttaaaatctcatggcggtcatcctcgtacaggcggtaggtaatatccgaaacccccgcatctttgtacatcccgtacaccttcttaactccctctcccagatctccgaccggatcatccgcaccggatacaaaaaacagcggcagatttttcgggaccttttttatattctccatctgattgtcaaacaataccgcctccatcaggcctttgtagccgtttacggtaaacagaaaagtacagcgcggatcagcatagtatgccttgacattctccacgttcttggaaagccagctgttggcataatcctttccatataaatcgtagcgcttgtacggcttgctgtaggaaaggctctgcatcaggcggcttctgtaatgccatccacggaatagtgcgatcgtacggcataaaaacagtccaaacttcatcgtgctatccggcattgccccggttcccatgatgacggcgccagccactccctccgggtgaatacacaggtatttgcgcagcatgtaagatcccatgctgtgtcccatcataaaatacggcacgccggggttctctgtctggatcgtcgtgcgcagcgtgtgcatatcctcgacgagcgtgtcactcggatccggctctgcaaaatatcccaattcctcctcggatgcaaccgacgcaccatgtcccagatgatcatgtccgaccacaaggaccccctggtcatttaaaaattccgcgaacggcttatagcgttcaatatactccaccatgccgtgcgtgatctgcaagaccgcccggtactctccgctctccggcatccactttaccgcatgaatcttcgtctttccgtcctttgataaaaaactgaactgtttttcttttgtcatagcattgttccctcactttttattatttatactctctgattcctactctctgctctgtatcctttgcagcaaaaccggcatcatccggcttcccctgccgactgcaggatgctcttgcagacattctccagttcatccgcgctgctcttctgctctgccagttcctcctgcatgccggatacatatttcaggaatgcctccctggcgcgcacattttcgtccgccgactgctgcagcacatctgctctcgcgaccgccgtatcctggatcagccccctcagcccaatctgtccggtctcataagccgccatattctgcgcacagtcgcggtaaagctttcccatggaaatattattctccttgagcagctcgtttaagtggtgtacctgctcctccagagacgcgatccgttcttccgcctccccaagctggtcttttaacgccagcgcctcctgctcataatcgtccgcatatgcacgcacctgctctgccgccgtcacaaaccgggttccgctctcccccattcttcctgcttcgatcgcagaattgagcgccagcacccccatcgttttcgacagttcctccatgcgctctgccctctcaccaagtgcctggcgcatctcgcgaagcgcctgcggagcctccgagatatgcttcatcggcgtcgtaaagtgcttgttgttctccacgatctcgacgaccttttcattctgccccttcacctgctccataaaaacgctgtggttggcgtcgaacgtcgcgattccgttattcattgtgatcaacgtattgtgaagttctcccgccgcctgcgcgccgttctccgacaactccccgttctgctgcatctgctgttcgatctcttcgatctctttttccatctgtgcacgcgaggctgtcatgcgtgcaaactgttcctccgcggtatccttctgtcctgcgatcttatggagcagctccctctcgcgcttctccgtctcccttaatgccgcaagttcctcttctaataaagccttttctctctttccactaaacatagctactccttctgtccacccgccacgttctatttatagttgcgaatgatgagctggacactctccattccctgatatacattgatttccggatagtaaatcaccgacatccggatggcattcgccctgccgcgaagcgcagcgtccacctccgtctgcccgtatttttcgctgtaatactgcttccatgcctccacatccccaaaatagaccgcagagacatgttctcccgccgccgtcataagggacagcttcaacacattctggttcctgcccaccacagaagcccgcagaagcgcaagctccctgtccgcgaactgtggcttactgttgccatttccaaacggctctaagcgcgccagctcccggatcagcccgatcgtcggatacgcggcaggcattgccatatctatccttatcttaggtataaaatcttcttctgtcaattcacagcaggcatttattttgccgcggaataccgccacatcctcgcacagagacagccctgccgccatcggatgtccgccgaattttgaaaaacattcccggcacttgcacatctcgtcatacatcgagtacgcttccgtggatctgccggaccccttcaccccttcctcgccgtccgtcagaacaaataccggcttgtggtaggactcccggattctccccgcaatgatccccgccaggctttcatgcaccccgggcaaatagatcaccagcaccttctcgcccgctgttccctcgtcgacgatctgttttgccagttccacgccgtctgccgtcatgcttttgcgctgtgcgttcagttccacgagttcttttgcaattttccctgcatccatctcatttttttgcaagaaaagattcagtgcaatcttagcggtctcaagacgcccgctggcgttgacgcagggaccaagcacaaatccgatatggtacgatgtgatctgctccggcgtcagctgattctgtaaaatcaaggcgcgcatgccaaggttcgctgtccggtgcagccgctttaatccctcccgcaccagaatccggttctcatccgtcagttccatgacatcgcccactgtcgcaaacgccacaaattccagaaacgcgaatgcctcctccgcgtcaatacaaaacttctcgtaaagcagctgtataatcttccacgccaccgtcgccccgcagagccctttgtacggataggaacactcctgctgcttcggattcacaatggcatccgccgcgctccgcagataccgccgcactccctgctcctccacatagggaatctcatggtgatccgtcaccagaaccgtcatccccagctctttcgcatgcgcaatctcattgatggctgcaatgccgttgtcgcaggtgatgatcgtgtccatcccctcctcatacgccgcatcgatcagatgctcgttgatgccgtagccgtcacgcatgcggtcgggaatcgcgcaggacacactgccgccgcatcgtgtgatcccctgatacagaatataggtagacatcacgccgtcgatgtcgtaatctccaatgatccggatcggtcttccctgccttatcttttctgacaggatacaaaccagcttctctgactcataaagcagatgcggatcatacagatccctgcatgtgccgttcagatatttatcaatcgccgcatcaccgatcaccccgcggttgcggatcagccgcgctgtcacgggactgatgccaaaccgttctgcaatcgcctgaaaatcggcgcctttttttatttcataccacttttccatcttcacttatgcctgttccatcgtattctgcccgtcgccttcgtattccacggagagaagcgccagccccagcgccggtgccgtgtagcccgccgcctgtctgtccctcctggcaagcacgtccgtcatactccccggctctcttctgccgtctcccacctcaatcagtgtccccgtcagaatccgcaccatattctgtaaaaaaccgttccccgtgaaaaaaagatctatctccgattcgtgttcctccacacgaatttcataaagcgtccgcactgtggactttttcattcttgtattgccgcagaacgacttaaaatcatgctcccccagaagaagtcccgccgcctcccgcatcctttccacatcaagcggaatcctgtaatcatacacatacctgcgcgcaaagacgtccggaacctctcccgtatgaatccggtagcggtaggttttgcacactgcctgatagcggctgtgaaaccgctcgtccacctctgtcaggctgcttacggcaatatcctccggaaggtaacggttcaatccatccagcagctcccccgtattgcgcggctgcttaagatgaaaattggcaacctgcccgatggcatgtactcccgcatcggttctcccggaacctatgacatccacctgctgtcccgtcatccgtgtcagaacagtctcaagcttgccctggatcgtcgcgtccgtcgcatgctggctctgccatccgctgtagcgcgtgccgtcatactgtattgtcatcctgtaattcgccataaaattctccaaaaaagtccccagtttgtaacttattctatcacaaaccggggaaaaaaccaacctctaaaccagctccgcaatgcgcgtaaccgcgacataaatctcggaaatacggtaccaggtccgaaagtcgatcactcccgtgaccggaagtccgaagatactctggaaacgctccaccgcctccctggttgccggcccgtagattccgtccggcgtaatcgtcggaatggccgggtaggaacgcgagatgcgcgccagctgttcctgaatctgccggaccttttctcccgtcgatccgaccgacagatcgattctcggccaggacgccgggatgcccgagacctcctccgccgtgttgatgaacatgttattgccgtaatagtagcgcagaatctcaatcgtctcataattctggtcgccgagatacttgctgccccactggctcagccagttgctgcaggtcacgcgctgcccgtcgcaatactgcgttaagatcggctgtctgacattcggtctggagagatagttctggaacatctcatccaccacatccgagatgctctggtaaatgttgcgcccgtacatgaatttctggtcgtatgccgtggaggacgtgatcgtgaagctgtagcctttgttgcggtaccactccgtgtatacacgattgagcgtaaacgacatgatggcaagaacattcgcccggatcgttgtgtccggccaggtcgagtagatctcgctggaggcaacattcttgatataatcacgataacggacatagtagtctctggctgtcggatcactcggagcgccgtcatgtacaatcacatattccgggatcaccacacggcttaaaacgatctctccggtttccgtgacgggtttgatctcggcttccgcgatcttgggcggatattccgcaaaaagggtatgtgccggaatgacgatgttatcggtcatgctttcggtggtttcctcggcgtccatccggatttcctgcagcgacagctgacccgaaaagacctcaatgccggagatattgatcggacgatatccttttgcagtgacctgaatggtatactccgcgtaaggctgcacctcgctcggctgcattgacagttcaagcggaggcgtatcaagcgtaagtgtttcggacattccggaagcatccgtgttcacctcctcgaccgtgctgtcgggatctccagaataggagatcgatatttttgcatcgtcgatcggcgtgctggttccccgctcgatgacctgcatcctgagatccccgcgatccacattctcgttctgtgcatatctgatatctggcataaaaacctcatcgattcttttcgtattatcatatgccggcgccagatgaaatgtgcgcatccgccctgccgaatcctgccgcaaaaaaacggattgtcactttgagcagccaaccccttttgcacgacgaggaatagaatgggaagatcatgcctatcgatttctgagggaatgcatctggaaattcggttcaaaaaatgtggcatttctaaccagccgaatgtttgcatcttcgatgatccgtgtttttccaagtttggagcactccgcgggtcatgtccgcatcccggaagacaatttgtaggacatgccccgtcggattgtccaaacatggaagagacacggaattcgatgcaaacattcaaccggaagaaatgctcacatttttctccaacgaatattccatctgcatttccctcagaaatcggcaggatgtacttcttatcatattccctcgcacatcaaaaagggactgcctgcttcaagcggcaatcccttttttctttccgttatatgctaagacacgcgcgtctcatccacaccttccacagatcttctgctttattctacggtaacaacctttgccagatttcttggcttatctacatcgaaccccttatcggaggacacatagtaagcgagaagctgcaatgccaccgatgccggcagcaccatgaactcatcctgcatatccggcagcgtgaaaatctcgtactccttcgctaaatctcccgcaatgctttccttgataaaaacgacaacgtccgctcctctggactttacctccttaatgttggaaagttccttggacatcagtttttcctgcgtcaccgttgccaccaccggcgtatcctgcgtgatcagcgcgatcgggccgtgctttaattcgccggatgcgtacgcctccgagtggatgtaggatacctcctttaacttcagcgatccctccagaagaatcgagtaatccagtcctcttccaatcatgaacaaatccttagcgccgagcacctttttggcaaccacatggatatccctgcggcgctccagcaccttcttcatgacctccggtgtccgctgcagctcccgcacaaagctctgggtctgcgcgtcgtcaaagacacctctgctgtgcgccatacgcgccacgatcagataaaataccgcaagctgtgtcgtatacgccttggtacttgccaccgcgatctccggtcccgcattggtgtagagcacatagtcgctctctcttgcaatggaggaacccttgacgttgatgatcgcaagacactttgccccgcggttcttcgcatacttcaccgcctctaacgtatcgatcgtctcaccggactgcgacacagcaatcacaagcgtcttctcgtcgatgaccggatccgaatacatgaattcggaagccatctgcacctcaatgtgcatgtgaagaatggacttgacgagcgcctgtgccaccagtcccgcgtgcattgcggttccgcacgctacgatgcagatatgctcgcactctgtaaaaagagtgtccggcacgccgtctgctgtaaaatccggcatacctccgacgatacggttcctgatggtattctcgatggcttccggctgctccataatctctttttccatatagaacggataaccgttcttcccggcgctgtttaattcccagtccacggtcagatactttggcagcacctcattgccgtcaaaatccgtcagtgtcagtttgtcagcggacagctttaagatatgatactctggcacgacaaaataacggtttgtaaaacggcagagcgccgtcagatcactggcaagcatcgcgccttccttacagatcgtcgccacgatcgggctgacattgcgcgttgaatagatcacatccttctgatcttcaaataaaatgacaagcgcaaatgttcccttcagcttcgagacggtcttcttgatcgcttcctctggattcccttcatagaaccggttcaaaagcgctgccaccacctcgctgtccgtctcggacttcaatgtatccgccaggtcgtaatccgcaatcagttccctgtaattctcaataatgccgttgtgtacgagcgtgacttttcccacttgatgcgggtgtgcattgcagtcgtttacaccgccatgcgtcgcccatctcgtatgaccgattccgcactgtgacaccactttttctgacgcgcagatcgcccgcagatcactgactcttccggcacatttgcagacttctgttttcccgctctcctcgtcgcgcagggcgataccggcgctgtcgtatcctctgtactccaacagttccagcgcatccaaaaggacttctcttacgtcctcacttcctgtataacctataattccacacatatgatttccccatttctattacaatctgtatataacaatatttttattcaggtctcttctatttctattccatcaaagtctgttccatcaaacatcgtatttgttttgcagtcacccgcatatttgccgatgtgtctcgcactggaacggtacggaaaggcatccgccgaattttcgatcacctttctcctcgttaacctgccagggcaggtgcatggcgcttagggaatctctgtggattacggtacagatcagattgcgtatctgaacatataacgttctccttatgcagttatcaaggttcaacgtgtttactatactatgatacgtgaaaaaagtccagaggggattctgttttgccgccgggtatgctatacttagctcatacaacagtgaaagaaggaacctcattcatgctcctgaaaaaccaaaaagaagacaccaccgactacaccaaagactggcccgcgcgctactacgacattcccaccggcacgctgcggcgcgaacaccttaagcgcgcaaaagcagaaggctttgccgttcctgcagattcctaccgggaaatgctctgcgagcggcgctttttttccgaaaaaaaagacggcactgtggatggttttttccgcgcctggaccatgatcaaggcttccgcagccgcaggcgtctcttttttccagaaaaagcgtcagaaaaaagaactgctcacttacatgaaggatctttgtctctccccggatgatctgcttccagaatccgcggatgcggttctcatcgaagagtggcaggattttgcgcggggactcatctcctcctgcaccgggagcaaagcctactgttcgacgctctttggttttgtgccgatcaagaatgccaaggtggcggaaaagctcgccgcagagatccttctggtgaccagggattatccggctctctttgatctggcggacgagtttgccccgttccgcaaagtcatgatcgagactttctgccagatgattgagaacggcgaaacctatctgcaagcataaaaaacagccgcacagaatgttttacacactctgtgcggctgttttctgcttatactttcctgtattttatttcatataattcttcacgtctctcgatcctaccttagaatacggaagtctgatgtattttccgttctccagattgaggtcgtctaacgtatcccccacggagagcgcgtaggcaagatcgagcattgcctgtgcctgcccttccttgtcgttgtagacggttcccaccatctcgccggatgccacggcggcaagtcccacatcagttccatcaattccgaccaccaccggccagtccgcccgcttcagatgcgaggttttcaacgcatcgatggctccgagcgccatatcatcattgttggcgattacaagctcgatctccccgtcatattccgcaagcatctgcgtcatcttggtctgcgcctgcgcccggttccagttcgcaatcccgtacgcgagcttttccacctccacgccgttgtctataatcgttgagaccgcatactcggtgcgcacgatcgcatcctgatgcccggcttctccctccagcaccacatactggaagacaccgtcaccgttcttatcagcatccggattctccttgaacgcatccgccacaatctccccctgcatgattccggactcgaatgctttcgccccgacataatagaccctgtcccagcgctccagatcctcctccaccagttccctgttgaagaaaatgaccggcacattatttttttccgccatatcgatgatcgttgtcggctctgtccggtcgaccagattcacacagatcacattgcagccggcatctaacatttcctcgacctgactgttctgcgtcgactggcttccggccgcattgtagacttccacattgatggcaatgcccgtctgttcttcctgctctgccgcatattcgttgaaatccgtcatcatctgcgatacaaatgtgtcatactgatcatatacggtgacgccgatcttaatgcttgtcactttctgtacctggccgtctgtcccgcagcccgccatgcttcccagtgacaccagcgcaccaagcccggccgccattcctcttagcatcctctgtgacataacacccttcctcacttctcctgtttctctctgctactgcacaatcgggaacagcactttctggatatccgcatcatacagatgttcccggtcgaccaccagataattgaccttgctgcttctcgtggtatccatgtgataaatcagctgctttgcgattgcctccatgctctgataccccatattgaattcattgggaaccacgagcgtctgtatccagcccttgtccagatagtatacatttttctcggaactgcccacgccgtacagcgagcaccggtcaagtctccagcccagctcatccccggcaaaaaaatccaccatcatctccgtctcgtcattgccgagtgcaatcagaatgtccaccggtttgtcctgctctaacgtatagaacgcgtccttgatgctctccgcctttccttccaggctccactcgacgactgcaccgctctcgcgcaatccctgcgatacccccgtataacgctgctgcatggagcgctggctctggctgcacgcaagaattcccacgcgcttgccggcaaggtcatccccgaaatcggactgcaccgcctgtgcgagcgctgctcccatctcctcattatccggcgccaccaacgcgtagaccccttccggatcaacgtccgtctccagcagaagcaccgccgtctgaccggagagatcctccagctcctgtccggcgtgatccgtattcatctgcagaataatgccgttggctccatttgtgacctgctttttgaccacatccatctcttccattgcggtggaaaagctccccgtcgacacaaagctcaaactgatgttgtaatcccgcgctgcctgctcaagcccctgtctgagggaagtccagcggtcgctgttgctgttctcgacaaccacggagacgcggtaggacgtctcctgcttaccgacgtttagcatattgtaaaacgcccagataatcaccgccaccagcatcaggatcaacataccaaaataaagtctatttttcttcatcctgccgttcccccttcagctgttttagtcttcctccctccagcagttccgtattttccggtgagtacgcaatgtacggaaggtgaatccgcacggtcgtcccctcatccagacagctctcaatctcaagaccatacggctccccgaagcggagtctgatccggttatgtacattgatgagtcccacaccggagccatgcttgcgcactctgttgttctctgtcaggagcgcatctaccatctcatccggcataccgagtccgttgtcgcgcacttcaacatagacatcgtctcccttccggtatcccacaaccgtaatctcaccgtcgccgtccatggattccattccgtaatagattgcattctcaagtaaaggctggatcacgagttttaccgtacagcagcttaaaatagcatcctccacctgaaattccacagtgaatttattcttatagcggatcttctggatattcatataatttctggcatgttttaattcgtcctccatggagatgatcgtctttccgcggcttaaggaaatgcggaacaggctggcaagctgcgtcaccataaacaccgcgtcctcataccgctcgccctcgatcatccagacgatggagtccagcgtattatataaaaagtgcgggttgatctgtgactgcaaggcgtccagctcgctcttccgcttttcttcctgctccaccagaatatcatgcatgagttcctggatctgcgccaccgtagaacgcagcgtcttcccgagatgttccacctcaagcgaaccgcccacatagatatccgggttcatatttcccgcttcccagtccttcaccgaatcgttcaggcgctttagcggctttgcgatattcgcagagacaaactggtttaaaagaataatcatcagcatggacagcgacatcagaagaatcacgaacatccgcatccctgagattcccatatcaaaagaactcatcggaaccacactcacgatcttccagccggtgtaactgatggtcttgaccgtgacaatgcgcttttccccgtcatattcctccttgtggctgccatcctcgtaggatgccgccacaagattgttctccgaaaacagatccgtgtagatcagcttctgcttcgggtgatagatcagttccccgcttccgtccatcagatagacatactccgacgcattgtccgtatttgccttcgtcaaaagctgctcgatactgctgtaattcatatccacaagcagcacaccaagtgtcgaattgccgccgcttgtcagctccaccgcctggcttagcgatacgacccagtaatagcggtaactcggatcgtcaaacaaattctgtacatgcggcgtggaaaaatgcacgttctccatctgtcccgtcgcctccgtaaaccattcctgatccacgatgtcgaggttgttcttctccgtggcaaccggcgctgcagcaaccagtcttccgtcgttggtatagcaggcgatgctgatcagattgtccttgttcgcctcatagagaaggttcatttcctcatcaagcgagtccgtcgccagatccttgtccttaataacgctgtagtacatggcgtcggaaatacgccgcatgttgcgcagataactctccagattgattgccgtctggttcagcagctgctccgcgctctgcgtcgtcatatcttccattttattgacaaaacggttgtacagggaaatccccagaatacccatactgatgaccgatacaatcgtaaaagacaatgcaatcgtcatctgaatggactgcggcttgatgtgtttttccaggaaggaagtgaccttctgccgccactgttttactctttctctcatcctctttgcaccctatgcgccctatgcctcctgcgcagcttccatccggcttgtcttatacttggacggcgacatgccgaactgctttttgaatacatagctgaaatagttcggatcggtatatccgactttctccgcaatcacgtaagtcttctcattctgtgtcagaagcagctccaccgcctcctccatccggtaatctgtcagatagttgatgaacgtcttcccggtctctttcttgaacaccgtggaaaaataggcggtgctcacattgaggtatccacagatcgtctcaattccaaggtcagtatccgcataatgctccttcacatagtcgattgccttcgacacaaaggacttcgtcgtatcctggcgctcgttctgcacctgtttttgtaatttcagacagttctcacacagccattcccggagtgcatccgtcgactccagctgcatggcgcgtgtatacacatccccgttgccgccgaacacatcttccaggttgatctggttgttcgccccgaaacgcgacagctccgtgatcagctccataatgagaatccggtaccgctgcagtgacatcttgctgcccgcaagcttctccgtaaattccgcaatcgcatccagaagcggctgttcctctcccaccttgacctttttgatgatcttctggataaagggctcctcccacggcagatcggcattctcctgcgggtcgatctccgcaatattgatggctctggtattgccgtagagcacacggtaggacacggcattcttcgcgccgagataggacatctgcagttcttccggaccgctgcacacatgtccgattcccgccgtgatcttcgccttgcagacacgctttgccatcttacagatcttatccatgcagtcggtaaaacgcgtgatcgcctcctccgtgggcagctgggtaatcacaatgccatcccccagataggtcacgatcttgctgtcatattcagaagctgccagctgctcctccgccagctttttcacggagaccgccagcaaaaacggatcgatcggaagcgccccctccatcgggttggtcgtgctgatgtgcagcacggtcaccacaaaatagggtccctttagcgtaagactgcagtttcttgcatattcctcaatggagtcctccggaatccgtccgtcgatgagcgacgtcaggaaattttcctgcagcatcggaagactctccagataatattcccgaagcttgtcaatattgcgcttttcgtccagttccttgtccagattgttcttgatccgctcaaagacctcgcgcagttcgttggcattaatcggctttaaaatgtattcttccgcctcgatcttgatcgcttccctggcatactcaaattcatcaaaaccggagaaaataatgaccttgatcttctggtactgctcctttagcttccggcagagcgtaagaccatccatatagggcatcttaatgtccgtcatgacgacatccacggaaagctcctccgccatctcaagcgcttccacaccgtttcttgcatagcccgcaatgcgaaagcccatgccttcccagtccagcttcttcatgatgacctggaatacctcttcctcgtcatccaccagcaaaacggaatacaaactcatattctcccgctccttttcactcgcactcattcattcaacctccgtactgatcctccatccgcttccagagaatgccgagaatcaccgtacagattatgatctccgccactgccacatagacattcacaaacaccagaatcgccatcaaaaaggtagccgcaccgaagaacagcagcagctttcctcccgccttgcagtacgcttcctcgtccttcaccggcggcttatgtttcccgcggattgcctgactgtcgtgtaaaacgatcagccttatggcataatatacacagatcacaagtaaaagcagcggaatccccgcctgctcaataatcgtatcaaccgtcaccttaaaaatcctcctgtactctcaaatctaaaatagcggctggttctaatgtcccagccgctattcattataatatactttttactttcttgctatatactttctgatatccagagagattgcgatgaagataacaacaccgattgcaatgtactgtgcgtttgcattcatacccaggtactggagagctacctttaacagctcgaatacggcaacaccgataattgcggatgatactttaccacgaccacctgttacagatacaccaccaatcgtacaagctgcgattgcttccatctcgtaaccatatccggtctggacggatgcaccgccggcttttgcaccgagcatgaaacctgcaagaccatacatagctgctgctttcatgtagattaagatcagagttgcttttaccggaacaccggcaacctctgctgcctgtgggttaccaccgattgcatacatgtacttgccgtgacgggtcatgttgaaaatgaaccatgtgatcgccgccacaataattgcgatccagatcaggtagttgatgccgaggaacttaccgttagatacgttcgtgtactgctctacatagccgccgagcggtgttgcattggttacgataagtccgataccatagacgatctccatcattgccagtgtggcgatgaaaggcggaacgtttaagtaagcaatgaaaaatccggtaaccgtaccgaatgccgcgcataccagcatggcaatcagtgctacgacgaatacgttgagcggctgcatatccgggaagaattttccggaataatccatacgctgtaacagcataccggagatacatgcaccgaaaccgatcatacgtcctgcggaaagatcacatcctgctgtgataacacagcctgcgataccaagtgcaatgacgagtcgtgaactcatattcatcagaatattcatgaagttgttctttgtgaagaagttatcggatgtgaatccggtatagattaccaggatgaacatgacgatgataactccgttgttgattaagaaatcttttactttctgttgatttgtctttgtcattttcgtctcctcctatctcatcagaatctcgttgcaaagttcataaccattgcctgtgtcatctcttccggctggtcgatctcgccagtaatcttaccgttacacataacacagatgcggtctgccataccaagcagctcagacatttctgatgaaatcatgatgattgccttaccctgtgccgccagttcattcatgatctcgtagatctcatgctttgcaccgacatcgatacctcttgtcggctcatccatgatcagcacatccggatcattggcaagccatctggaaataataaccttctgctggttaccaccggataagtttgaaatgtgctcgttcatgctcggtgtcttgatggacagcttcttgatgctgtcatccacaactttgttcatcttcttatgatccagcacgaatcctgctttcaggtacttgttataaatggagacgccaacgttgtccttgatggacagacatccaaagataccgttgcctcggcggtcctctgtaatgagtccgattcctgcgttcatcgcatcgatcggatgcttgatctttaacttcttgccatgcatatagatctcaccggatgcgataccgcggataccgaagataccttccatcagctctgttctctgggctccaaccagtccgccaaagcctaggatttcgcccttgcggagcgtaaagctgacattctggaacgaatttgcatggattgagcagaggttcttgacctccatgatgacctcgcccggtgtattctccttcgccggatatacgtttgtgagctcacgtcctaccatctttgcgatgatctgatcggtcgtcagctctgccgccggccaggttcctacataggtaccgtcccgcatgatcgtgatatcgtctgcgatacgcttgatctcatccatcttgtgggatatgtataccattgcaacacccttatcacgaaggtcattcatgatacggaagagtgcttctacctcattatcggaaagagaggaggtcggctcatcaaagatcacgaccttcgcctgctgggataccgcttttgcgatctccacggactgcatctgaccgatggaaagtgtgccgagctgtgccttcgggtcgaaatccatctttacctctttcagccacttctccgtctccgcatacatcttcttgtgatcaatcaccttgagcggtccgtaattctttgtcgggaatcttcccagatacaggttctcagccacgcttctcgccggaacaggctgtaattcctgatgtaccatggcgatgccgtatttcattgcttcatccgggttgttgacctcaatcttctgcccgtccagataaacctctcccgcgtccatcttgtaaataccgaaaagacatttcatcaaggtagacttgccggctccgttctcacccatcaatgcatggacggttccgggacgaagggaaagctgtacattgtcaagcgctttaacacctgggaacgatttgcagataccctttagctccagtttgtactcagccatgtttctcctccttctatattgatacagattctgttgttatctgtgtactgtcgatgttattgtcgatgttctttaattttttctaatctggtctgtcacacaactatttcatatctttaagacaggtgcggatgcccgaaaacacccgcaccttctgtttacctgctatcaatcatcctgcgcagtaattattttaccatgtcaaggatttcctgtgcattgtcttttgtaacctttacatagtcacaaccaatgtaatactcgttggtctcaccattgatgaagttgattgctgcatcagctgcaccgtgggactgtgagaagtgatcattgaatacggtacctgtcatggttccggctacaacatcctcaagagcctcggataatgcatcaacacctactaagaagatatccgtacctacggtacgtcctgcagactggattgcctgtaatgcgccaagtgccattgcatcgttgttacagaatacaacttctactttatcgccgtactgtccaagagcgtttgctacgatctgctgtgcctgatcctgctgccagttaccaacctgatcggagaggcattcaacctcaagacctgcatcggtaagagcctttacggaatactcggtacgatactgagcatcaacgttctccggatcaccttctaccataacgtactggatctttccatcgccgtttaagtctactgtgtcaagaccaaggtctgcgatcatctcgccctggaaagtaccggactgacgtgcgtcacatccaacgtatgtaacattccagccgttgtcttcccatctctgctcttcctctgcatccggctcacggttgatgtatacgagcgggatatctgctgctacaaccttgtctgtgatggtagctgcggatgaagagtttaccgggttaacaatgagaacatctacgccctcggaaatgaagttgtcgatctgacctgtctgtgtcgcctgatcgtttgctccgtcaacgattgtgatattgtctttggagaagccctgctctaccagataattctcaagctctgtgcggaacagtgtcatgaagttatcggagaactggtaaatgcatacgccgactttcttgtctgcatagtcaccgcctgctgcttctgttgctgctgctgccgtatcggaagcctcggtagccggtgctgctgcatcggttgtcgtggatgctgcgttatctgttgtggttgtctcgccagaagagtttccacatcctgttgccattgttgcaaccatagtagctgcaaggattaaactgattactttctttttcatctctgaaaaacctccctttttgtattcgtaactccttgttacattatgaattatagcaatggaggtctgtaaagaacatacaatattcttctctttttcttgaaaatacttctgtttcttttgtgtgtttcgtataattttatggtttttcattttttcttcttgtgcatattttgcagatggcggtttttgaccggttctgtttcgtgcaaatatacaaatgtccctgtgtgaaagacaacgcttccacgcagggacatctgctctgcttcgactttatacctattattatatcatcgttgtgttccgccttttgcgtaccggaagttccacaggaacttctaagatgaactcgtcagagttcattgtagtaccttttccgcgatcgcaaccgcatcgcggatacagtccggacagctccgcaaaaccacgccggtttccacacccttcaattccttacagacgagcgcatggttcttctcggcaaactgtctggtgatctccctggtcagctgataggtcgccgccttggtcttcgggttcttcggatcggcacagctgttcttgaagcccgcaagcattaccgcaccggagaccgctccgcaggttgcctccatgccgcccatgccgagtccgaatccttccgccgcggcaaacagcgtctcttccggcacgccgatctcctccgcaaacgcacacgccaccgcctgtgcacagttgcatcccctgtcatgcaattcgattgctttttcctgttttgtcattttataacttcctttccgttccttataaaatccttataatttgcctgtatgctgtttctgtgaacatcttatcacaacttatcacaagaagtaaacaaggaggattccagaacgtatgaatcagacaacaatcacaaaacaacggggactctcagactttgcgctcaaatattttgccatggtctgcatgattctcgaccacattcactattttttctcatttacagggaagatcccactgttcttttcgtggatcggcaggcttgccgccccgctgttcctcttctgtatcgtggagggttttcttcacacgcacgaccggaaaaaatattttctgcgtatttacgccatcgccattttcatgggactggtgcagttttccttctataatattgcatccggcctcgtccggccggacggctttttcccgcagaatcagatgcttgcatccttttccgtcctgctcgtcgttctttggggcatcgaccggtgtcagaaaaaacagtggatccggggactttctgccatcctgattccggtctttctgccctttcttctgtacgggctgttcgccgtatctgcagcctttggcattccctacggcaattttctcttaaaccttctggtgtacagtgtcctgccctgccacactgcgatcatcgacggtggcaccgccacactgctcggcggcgtgattctctacctgacgcacagacaccgccgattgcaggcaggtgcctttgcacttttcgtgcttgcgtgggacatcctgcccgtgctgctttttatgcccgcaggaacttctgcctctttcttttttaccgatgcttatgagtggctggaagtttttgccgttatccctatgttatgttacaatggaacccgtggacacggctccaaaaagctgttctactggttttatccgacgcacatttacgtgctgtacgcactttcgttccttttgtacctgaccctttatggaatgggttcttgatagaaatgaggtttttatggctcacattctcgcaattgacgatgatcccggcatcctcgcgctgattgaacatgcactccgccgggaggggcataccattacctgcatgccgcatgtaccggcggatcttgcggcgcacctcgcagagtatgatctcatccttctcgacgtcatgatgccgcagacggacggctatgaactctgcagcgccatccgcgacgacacggactgcccgattctgttcctgaccgcaaagaccatggaggaggacgtcgactacggtttttccgtcggtgcggacgactatatcaaaaagcccttctccatcgttgaactgcgtgcgcgcgttgccgcacatctgcgccgggagcagcgcgaaaaacaccactgtctctccatacagggcatccgctttctgctcgcctcccgcgaggtcgcagcaggcggtgtcacgctcccctttaccaggacggagtatgagatcacacttctgctcgcaaaaaaccgcgggcagacattttccagggagcagatctacgaagcggtcttaggatacgacaagacaggcgatgcgtctgccattacagagcatattaaaaatatccggaaaaaatttgccgcagtaaatatggcgccaattcagacagtatgggggatcggttatcgatggaacgcatgaaaaaaaagaaaaaagaaatccggctgcgcacattttttgtgcgctttttactaaagcttgtcgccgcggtgcttctggcgttcctgctgtggcttctccagattaccgtctccgtcggtacgggtctgatcctgcctgcggacgccgccgaaaaagaggctcttgcctaccttcacaccatcggcgcacatacggacatcgtgtcttccgggatcccatccgcctgcggctacgccatctatgacgcatctggagagcttcttgaaacggacatgtccggttccatccgcgaaaatgcagatcttctcgcactttccgggcaggattccctctccgcaaatatgctcggacgaacctatgttaaacgccagaccgacacccggattgtggtgctcacttatgatttccggtctgcctttgcaaatcccacgctccggcgtctctttccgagcgctgaactgctggaagtgtttctcctgctgttcctgcttcttgcagcttttgtactcgtcatcacacggcaggcaaaatacctgtcgcgggaactttttcatctgcaggaagctgccgacgaaatccgcaatcagaatctcgactttaccatccggccgactgccatctgcgaattcaaccaggtagccgcttctctggacgcgctgaaatccgaactttccgcctccttaaaagagcagtggcacatgcagcagcaacgcagacgtcagttttccgcgctcgcccatgacatcaagacgccgcttacgatcgtccgcgggaacgcagaacttctgtctgagacagcgcttgatccgacgcagcaaacctgtaaccggtttattctggaaaatgccgcgcagatccaggactatctgtcgagaattatcgagctcgcaaagacggatgatcccgctgcatgttccgcagagtgccgttttcaggcgcagcttcacacggcatcgtttttcgacgatctgctcgggaatacaaaaagtctcggtcagaaaaaagaactgcatgttcttttttccaccgagactcttccagccgttctgccactgccggaacatccgctgcggcgtattttaaacaatctgctcgacaatgccgtgtgctactcaccgcacaaaggaacggtcactttagatgccgccatccgcgattatagggatgcacccgagaaagaaagcacgctctttctcactgtatccgatgagggacccggcttctgcgaggacgccctgctctacggcacggaagccttttacagggaatccgccgaccggaatgacaaaagccacttcggtctcgggctctccatcgccgaccagctcgcccgcggacttggcggatcgatcgctctgtgtaatgccccggcaggcggagccgtcgtaatcgtaagacttcctctgaccgggcagatacagcgcgatgcggaataaatcctattctaccggaacggtccagccgtacttatccggaagcttgccccactggataccggtcagtgtgtcgtacagcttctgtgtcagctcgccgatcttgaaatcgttgatcgtgacaacatcatctttgtaacggagttcaccaaccggagagatcacggctgcggtacccgttccgaatacttcctctaaggttccgtcatgtcctgccttcatcaggtcatcgacggataatctggtctcgtttaccttgtaaccccagtctctcaacagatgaatcatggaatctctggtaacgcccggaagtaccgtaccctcgatcggtgctgtgtagatctcaccggcgatcttgaacatgatgttcattgtaccgacttcctcgacgtatttgcggtgctcaccgtccagccagagtacctgggagtaaccaagcttttctgcctttacctgtcctaagatggagcctgcatagttgccgccgcacttggtgaatccggtaccgcccttgactgcacgcaccagctcgtcctcgacaagaatcttcaccggattgatgccctctgcatagtaagcgcctaccgggcagcagataatcatgaatttgtaagcggacgccatatgtacgccgagcgcagcctctgttgcgaacatgaacgggcggatataaagagaggtctccggctcagacggaacccagtctgcctccacctttaccagcgcttttaccgcttctacgaacatatccaccgggaactccggcatgcagagtctcgcgttggaattgatcattctcttcgcattcatctccggacggaacagctggatctttccctctgccgtgcggtatgccttcataccctcaaatgtctcctgcgcatagtgcagcgtcacacaggcaggctccagactgatcggtccttccggcacgattctcgcatccttccagccgtcttccttcgtccagtccatgacgaacatgtaatcggtcatatacttgccgaatccgagatgtttctgatccggcttctcctttaatacgtctctttttacaaatctgatatccattatgctaccattcctttcccgacatataaaattcttgaaatcaattatgatactttcttttttcagtgtcaagattattccaaccgcttatgccgctcatgattgtaagttatatattagtcatcttcccatatccatatggaatgaaaaacgccgcaaaaaagcggagcaggatcttttctcccgctccgccatcggagtctcttttccctattttaccacttttttcaacggaatccagagaataaatgcatacacgcttccgatcagggaagtcacaagctgcgtcacggaaaaggtcgtctggaacactgccatctttgcctccatcggtgccggcagaaggttcggaatcagaatcagcgagatcacaattcccatgaacagtgcctttacgacagatcctgccgccatgccggcaatcagtccgccgtttcctttgcattttttcgtgaccagtcccacacccaggaccagaagggcattgcccgccatgatacacggcatgatcgccggaatggcaccgatgatcgggcttcccgtaataaagaatgatgtgaccggcgtgatcacagagagaataatgccgcagggaattcccacacttaacaccgctaagatcaggcatgcattgatgaccggtccggtaatatagacgctcgtgttcttaaaaaactggctcacgatacagatcgccagaagaaccgctgtcgttgtgatttgttttgttgtgattttcatcgcttcctccttctgatgcagcactccttcgcagatgtaatgcactctcccgtcactgcaccaaagcaagcataatacttctctctcataaaatcaagctgtcactccgccagcagattctccacaagtgcgcagaactcgtcccggctcagtccttccgactgcacattcacggtcacaccgtttttcttataggtcgccagatacccgtccgtgaacgttcctccactgctgcccgccggataatgtgctgctgtcaccttcacaccggaaaccgtcatcggctttaatccgccggatacataggacgtcatctcccccatgtccgttgagcgtgcgcgaatggtaaaccatcccgctgtctcactgttctcataacgcatgacacagttgtcatcgatcacattgccatctgcatcatagccaatctgatacgttttctcctcatccgtctgcacatagccgtccggaatcacatccggaatcaccttgattccgtaatagttctgaagctgttcctctgtgagtgaaaccgtcttcgccgcttccgccccgcaggcaatcgatgtctgaagttcctccacttcgttaaaataccagtcaattcccgcagcgctctccggctgggcagcctcttgtataccgttgccatcccccgcagtgctttgtgcagccgcctcatattcctccgcactctccgcggtgccgtccggcgctgccgcatcagatgtcacggcaccgtcggataccgcagtatcataagcttccgccgtttccgcgctctctgtctttgccatgtccgtgcgcgccgtactctcatactgctgccatattccgtaggaacctccgatcaaaagaagtgccacgcaggcagccatctgcataaagtgctttttccgtgctccgagatagcgcacgtcctcggcttcctgtatgtatgtcggatccgcttcgccgagcgcatccagtaaatcgtccgtcttcatattttccgctcctttccgccgctatgaaagcagcccctcgcgctccagatgcatccgcagttttcctcgggaccggtacagcgaagattttaccttactctcgctgaccgcaagcctcccggcaatcgctccgatgccatccatataccagtatctgcgcatgaaaataatccggctctcacggtctaacccctccaggaaccggttgatggacgccgccagttcctttcgctctatctgcgtcagcggctcctcgcccccggcgcagtcatgcagttcttcatatatatccggcatgacgcctccgcctctcttttcggaatgctttctgcggtagcagtccagcgacagattgcgcgtgatcgcacccaggaaagccgccagaagatgcgggcgctccctgggcatggaattccacgcgcgcatccaggtgtcgttcacgcactcctctgcatcctgcgcatcatgtacaatgttgtgcgcgatgctcccgcagtaacgtccgtacttctgctgtgtctctgcaatcgccgtctgatccctgtcccagtacagcgctatgattttttcatcctccatgccttctccctctcagttaaaagctctccaccgttccgatgaacaccggaataccggtgtccttctccacgatcgcatataaaaacggcctgtctaaaataatgcgctccggctgttcaaccattgccgtctccttgcacatctccacaaccgtggccgctccggctttcgttccaagcccgtccacatcgatgtgggtcttgtgcagcaccctgctgatgctgatatttcttccgtccgggcagtaccccatttgggaaaaatccgcctgttcctcatcaaacgcgagcggcattccaagcgccgtgagcgtatcttttagttccagatcggtctcgcctgtaaattgcggcagacccgtctctatcattgtatcattttcctgccggattgtctcgtgaaacgtttccccgtccagttcttccagccattcgctcagtgacagtccctcctccggaagcagcgccacaaagtcatagccctccttgtaagcccgacaaaagcccttggcatgttccatggtcagatagcggtacgtggtatcgtacatcatggaaacctcctgcccgcttccgtcctccgcataaaatacggcatcctgtatctggctctcatcatagggcgtttcccactccgcatcaaacgccaccgcattcaccaggtacatgaccgcaagctccggaatctgatccagaatctctgttatcatgccgtctgtctcctgctccaccaggcggttgatgtcccggcaggtcgtctcgtcaaacggggcgccaaagacttctgcgtcatacgccgtttttacggtgtcaaggaaattctcatccggcacaaatgcatcgtccgccgtcttcacccacaccgaatcagacatgtggaatctggcgccctctgcatccggcaggctcttgcagatcctgccaagcaccatactgccatcctccgccgacattcccgggtacaaaaccgctcccatctgctgcttcgtgtcgccgtccgctccggtccgcgccatctcgagcgccatcatcacagagagtggacacaccatcgtattcttcgcgccctcgccggtctgcacctgctttctgctctcccgcagcagatttaaggaaaactgcgtataggaatcctcaaatgcttccctgatagcaccgagatctttttcttccattgcagtatcctccgttcctgtatcttctgcctgtcctgtctgtccgtttgctccggttccttccgtctgaccttcctctttggtcccgtattgtccggtaagatcagtggttgtaccggacattccgctgttcgcacagcctgtcatccccactgccatcactgccgcaagcacacctgccgtcacccgttccattccttttctcctcataagcttctccctctcttttctatcatccggtttttgtctttcatataataagacgcaaaaaaccggaaacggttgcatccatttccggtttttgtaaaaattttctatctcacatcttctgttctctctacagccttaaatactcaaacgcctgatagacatccagcgcaccgtacccccactcccggttcgggtaccccctgtcctccgagcgctttgcaccgcggatgagcatatttttgatcgcggcgttggacatcaccggatcgttctgctgcaccagcgcccactgcatgatctgtgctaccgcccccgccgtcaccgccgccgcggcgctggttcccgtgtaggtcacatagtttccacgcagccccggtccgtacacattcaccgcgggtgccacaaaatccggcttgatctcccccgccactgtgtagccgcgcccggaatccgcatacatgctgttattggagacctggtatccgccgaccgtgatgacctgtgccgccgtccccggcgcagtgagcgtcgtgtccgggttggatcttaggaaaatcacatttccgtccgtaagcttctgcatcgggagccacatattatagttgccgctcacaatattttccgggtaaacccgtacaatccacagtcctcttctcacatcggaaaagcgcagatagattaactggtttgccgtctcctttgtctcgatacggtaatccaccgacacggtcgttccctcaaagacgaaccggaatgacttggaggcaccggaacgcagcgacactttcggaatccgttcgcccgtcggagaaatcacagatatcgcgtacaattccggcgcgcccgcccacagttctatgaaaaagcccgccatatcctgttccacgctgatctccacatcctcatagtccatctcacggcggagcgccccctgaaagtggtgcctggtgttcgcctcgtttcccgttgccgtcacaatcgagcgtctccgcctggtgctgatatagttcaggaaattggacagcgggccgtccgtcccgtgtccccccatgctgttgccgagtgcaagacagatcacaagcggcatatttaacacatttgcaacgtcatttaaataggataccgccatcatcaggtccgtctcctgataggcaggcactccctccggcacgaagaaaaattcccgcagataacgctttgcctcttttagctttacaacggcaatcccagcgtttggcaccgccccgataaagccgttcgggatatcctctcccccgcacacgactcccgtcacgaatgttccgtgcccgttttcatcgcgggacggcaccacatcatacggccgctctgcttgcagcgcttcatcaatctcctctttgcggtactctgcaccgtacagaattccctccggcggcgttccgtcctgtaccgtctgatcccagatccgcaggattctgctgctgccgtccgaataccggaacagcgggtttgtgtaatctacgccggtatcgatgatgcccaccaggaccccttcgccttttaacgcaagcaccggctgattctgcagccgggtgattcccgatgcatcgagcgccgtcgtatcgagcagtgcgtagcattttggtatcgccgtgtaggtataattcccgatagaaagcggcggcagtccctctcgcgggtagaaaaaaatgtcgtaatcctccgcgatgcgctgcacgcatccgggcgtggacggaacctctgcctccaccccgtacggaatcaaaaaatcataatactcctctgaatatacctgctccatgcaatttggcataaaaaactccggtcatccattgctttcttaacaatagatgccggagtgtaactatttattccatattatcagttgctggctgcaatctgcggattctccgtactcccaataccgatgcagccgcgcagtgtgatgaccgggctgcccttcttctccacatagtccttcgtgatcgtgaccatgccgatgttgtcgtccttcggaatctcatacatgatatccagcatgaattcctctatcaccgcgcggagcgcacgcgctcccaccttcttctcttttgccttgtgtgcgatcgcgcgcagcgcatcctcatcgaacgccagcttgacctcgtccatggcgagaagcttctcatactgctttaatatcgcgttcttcggctcctgcaaaatccgcaccagcgtatcttccgagagcggctctaatgtaaacaggatcggcagacgtcccaaaaactccgggatcataccgaacttacgcacatcctccacggtaaccttggagagcaggttctcgtccttgtcatactcatcctttaacttcgcgcggaatccgatcgaagcctcctgattcagacgctccttaatgatctcctccagctccggaaatgctccgccgcagatgaacagaatattcttcgtgttgaccatcgtcatcggcaccatcgcgtttttgctgctggctcccacaggcacctcgacctcggcgccctctaaaagctttaacattccctgctgtacggattctccgctgacatcccgctggttcgtattgcgcttcttggcaatcttatcgatctcgtcgataaaaatgatgccgtgctccgcacgctccacatcattgtccgcagccgcaagcagcttgctgactacgctctcaatgtcgtcgcctatgtagcctgcctccgtgagtgacgtcgcgtccgtgatcgcaagcggcacatccaaaagccgcgcaagcgtcttgaccagatacgtcttgccgcagccggtcggtccgatcataagcatgttggacttctcaatctccacgccgtccttctcatccgccgcaatccgcttgtagtgattatagaccgcaaccgacatcaccttttttgcctgctcctgtccgaccacatattcatcgagcgacgccttgatcttgtgcggtgccgggatcttcttaatgtcgataaccggctccgactgcgccttcggctttttcttcttcagcttctgattgttcggcagtccgccctgcagatccgacaaattgatcatgctgatgttcggaattcttcccatgttcatattcatcatatcatccatggaaaaaccgcttccgttcatgctgtcaaacgtcttctgcatacagtcctggcagatgcagatattgttcggaatacggatcatctttcccgcaatatgctccggacgtctgcagatatagcagatgtcctcgtactccgtgtcctgattctgatctgtgtcatccgaagcggaactctgcattacctcgccggcgccggatgtgctctcatgatccgccccgtcttccgcacggggagcctcacttcccgtctgcgcaccgtgagccgcgtttcccgccggcacaccattatccgcgcttcccggctgtgcgccgccggaagttcctgtatttgtatctgcgcccgtctctggcgcgtcatctataatctctctgaaatcattgtgattcatactaatcctccattcttgcgctgcttctaagcgcatctcaagtttgtgcgaagcacaaatcttgcgtgtgaaaaatcttatttttcacactaatatcccctattcgctttctatcatgaaatttaggttcattataatgcaaacattgtttaatcacaaggaaattacagagatttcatagttattttaggaattcatcaaaaatggcgaaagcctcttttgctttcgccattctctatctcacatatccgtaaaacgcgctctatctgccgtttccgttattatctgtggttccgttgttattattgtcattgccggtcagatcatccacaccgttctccactccgttgatgacatcctttccagcctcgccgacaccgtctaccacgtcgtccacaacattgccgtttccgttgttatcaaccgcgccgttgttgtccatcgcaccgttatcgtttaaagttccattggtatcgttcactgtgccgttggttgttccgttcgtgccgttggtcgttccgtttgtgccattggtcgtgccgttggttgttccgtttgtgtcggttccattgacggtgctctccgtgccggttccgttcgtcgtatcattgactttgtcattgttcgtaccgcaggcagccatcgcgctcaccgcgaaagtaagtaccagtcctgcgagcagtgttctccactttctcatagtcatattctcctttttctcagaatcacttctgttttcaaggatagtatgaccctaacgttttccttttattcccgcggccgatgtttttcttttgaattttatttttgaaaattcaatcttaagatttgtaataaccaagctctctcgacagttcttcctgtacttttttcacatccaccgcaagttccttgacgcgctctctcgtcatgcggctggtcggtccggaaatactgaatgcgtattttacctctttctggtagccgtgcaggcacgccgcaatgcagcggacgcctttttcgttctcctcatcgtccagcgcgtagccgttctgccgcacttcctccaacacttcctgcatctgcgttagatctgtaatcgtcttgtccgtctttttctcaatgatactctcgttccagatctttttgacttcctcgtccggaagcgtcgccatgatcgctttgccgacaccggagcagtacatcggatgtaccattcccacatgggacaccatgcggattgttccgaccttcgcctcgatcttgtatatatataagatatggtttccctcgcgctgcaccagatgcaccgcttccccggacagatccgagagacgttccatatacggctttgccacctgcagaatatccatccgctcgaggatctttcccgccatgttgaccaccttataggaaagcatatatttctgcgtcgcctcatcctgctttgcgtatcccatataaataagagacattaacagtctgtgtacagtgctcttgtgcagatccagcgccgtgctaagttccatcagtcccatctccccgtggtccgcaagcgtctccatcacctgaaaaatacgctctgccgactgtaccggattttttccttctctctcttctgccatagtatctcccatgctgtatctcagtcagtttcatcattcaatctgtcgttccgtattgcggaactgccttgttatcatatcatgaccgccgtccgaaagtcaactctggaatctctgctgtcccggcgttttgttttatggaaaatacacgattttgtttcttgaatcggttgacaaggtttttccacatgttataataattttgtaccattacgtgaaacatagttccgcattatggaacatgaatgataagtaaaaggagaagaatcatgaacaaagtattagaagagttttccaagattggtattatcccggtcatcgcactggaccatgtagaggatgccgcacctctggcaaaggctttatgtgacggcggtcttccgtgtgctgaggttaccttccgtaccgctgctgctgaggagtccatccgcatcatgtccgagcagttcccggagatgttagtcggcgcaggtaccgttcttaccaccgagcaggttgaccgtgcggtaaacgcaggtgcgaagttcatcgtcagcccgggcttaaacccgaaggttgtaaaatactgcgtggacaagggtattccggtaactcctggctgctcaaacccgagcgacgtggaagttgcaatcgagcttggtcttgaggttgtaaaattcttcccggcagaggctgctggcggactgaacatgattaaatccatggctgctccgtacaccaagatgaagttcatgccgaccggcggtatcaacgctaagaacctgacaagctaccttgatttcaagaagatcatcgcatgcggcggttcctggatggtaaacaaagacatgatcgcagccaaggactgggccggcatcaccgctctcaccaaagaggcagttgctaccatgcttggattcaagctcctgcacgtaggtgtcaacaatgcatctgaggaagttgcttccacagagtccgcaaagttcgcaactttacttggacaggatgtcaaggttggcaacagttccatgttcgttggttccttaatcgagatgatgaagaatccgggacgcggaacacacggtcacatctgcatccagacaaattatctggatcgtgccatctatcatctggagaagagaggctttgctttcgatgagtcttccttcaaatacaatgacaagggtgagcttaccgttgcttacttaaaggatgagatcgccggattcgctgtacacttcaaccagaaataaggagaacgtcatgacagatcagaattgcgcatattgcatggaaggtgatctggtagccgcattcggcatcaagatctgtgaacttccttcctccaaggtatatcttttcaaggaacagagccacaggggacgtgtcatcgttgcccacaagaagcacgtgagcgagatcacagagctgaccgccgaggagcgtgccgcttacatcgaggacatcaaccatgttgccgaggcactgcatcaggcattccatccgcagaaagtgaactacggcgcttatggcgataccggtcatcacctgcacttccacctcgttccgaagtatacggacgagtacgagtggggcggcgtcttcgctatgaatccgcagcagaagttcctctcggatgaagagtataccgcactgatcgaggagatcaagaagtatctgtaggatatgtattttcgttggattttatgaaaccgaggcaaaccgcaaaggtttgcctcggtttgttactgtactcatattttttgacatactgtagataaattgataaaataacagaactacaggttttacacatacgagtgggatttgtggaggaaatgctatgaaatattttgtaacagatcgcgaaagggatggcacttgttaccatgaattttacaaaggacgatgggatggcaaaacattttggaaagaggattccatatctttacatgataatataatgtttcaggcaaaggaatttatagctgcactcgtagtatgtgttcccaaatatgatcctttcggagagacagaaattacggctgatgaatggataaaaataggaactctcatatcttcaaaagataatatttcaaaagaggtatacgaagaagcaaataaatgggcaaaagaagtttttaaaagctatggttgtttcacgatattaggtctataaataaaaactcatacaaattgccttttgtaaaaacatatcaaaaaatgccacccttggcatccggcattttaccggcgtattcctgctccagttcttctgccagatacgcatcgctcatacagtgcatatccgatacgccatcacggatcagttgatatacctcggaatgataaaagaactccaatgccgcatccagtgaaattccctgccgttttgcaaaacatgcaatgacacggctatattttttttgaagtaaaatcggatttgctgtcatacaatttcactcccttcaaaatgcaggagagacagtgctctctctgtgcggaaacaaatttgcacattcggtttttcataacgaagacgtttgatagcctccgctttatcaatcaatccatcaaaaaacaattccaccgtattgaataccttatcattggcaacaccaccaataacgagatcataatctgtcgcgtcttttccaaaagaaccatggtagagaatcatacttccacgcccctttctttcatcacatcaataagatcatctacgatatattcccggctctgtgtatgcagcacttcatattccggcacaatataaccgctcagaatatcacttttttcggtaaacgcctgatacacacgctctgcatccatccccagttttgccgctacattttcaatacaaaatacgacaaactcgagttcactgtaatttttgattttttcatccgccatcataagcaagctctcctttatgacaatatgaaaaacagctttctcttcttatcactgttagtatagcacttcatatccgtatgctcaatcagattacctttaaaaaaggcacccgggtcataacgacccaagtgcctgtatatcctgatccttttgcgtgagcttcctaccggtgcgtatcccacagtccacagtaggcgtccaccggatcctccccgataaatgcgtcgctgccgctcatcagcttctcgatgagcgcatcaaacgtctgatccgcactgtcgtaagtgttgatatacgttctcgcctgcggaatgtctgccagtacgaacggctgtccgcatccgatcacgataaccggaagttcatgaacgtaccacgggatctctccgccgcccttgctcatgccaaatcccggtcttgccaccggctggaaaccgcctgcaatgtccaccagtgtgatgatcagatcctgattttcgacgaaatccttgatcggcgtctttccggcaaagtacatattgatgtccaccttttctcctgctgctgcacgctttgcaagtgcgtcgagcgggctctcgtagataaatgcgtcaaagcccttctcgatcagcttgtcacgcagacgctctgccgggctcttcttgccgccgcccatatattttgccatcatggttcccatcacgcccgcggataatccgctgacggagacgatcatgatgcgcttgtaacggctcgggatcatcggaagcacatcctcgtccttgtattttacgagagtgattcctttctcggagatttctcttgccatcgccttgtgctcttcgcagccaacgacctgctccatcacctccaccggaggaacgatctcatttttcgcttttttgtgcagtcccatgtgtgctttcagagcaagaatgcggtgcagggcgtcatttaaacgctcctcggtgatgatgccgttctcatagcccgccatcatgcttgcaaaatcctcatccatctcattgaaaaaaaggaacatatcgacaccggctgcaatcgtgtgcggaagcatctcgctgcgcttcatacagcaggtcagtccgaccatgtgggaagcatcggtcagcaccataccattaaaaccaagctttccgcgcagaagtccctcgatcagctccggcgaaagggttgccggcatgatgtcctcatccttgattcccgggttaaaatgtctggtgtacgcaggctgcataatgtgtcctgccatgatggcttccagaccgttgtcaatgaggttctggtatacttttccatagcttgcatcccactcctcacagctcatgtcattgacgctgtctgccacgtgctggtcgcggaagtccagtccgtcgcccggaaaatgcttcgcagcacagcagaatccctcattggtgtgtgcgccgtccatatatgccttcgtcatctcgcacacgcggtccacatcgtttccataggtgcgcagtccgatgaccgggttctcccagttgtagaggatgtcgctgaccggggcaaaggagagattacacccgatcgccgccgcctctttgttggacatacggccgagctcgtacgcgtatctggcgtctcttgtcgcaccgatcttggtctgctggccgatcatggttccgtcagtgcaggcgccgttgccgccattctccgtgttgcacgcaatgataagcggaatcttgctgttctcctgaagaatccggttctgctcacgcacctcggcaccggttgccgggttgtagcggataccgccgatgtggtacttgtccaccgtcatcttcagatactcttcgtctctggaagatcccatattgaagaaaagctgaccgatcttctcctcggtcgtcatacccgcgatggtctcttccacccacttacaatcctcttcggacaggtaaaacggttttgccttcatatctaccataattaaaatatccctctctttctcactccgaatcggcatgaacaccgagattccgctcaaatgcctgattcagttccttttgatatttcgcatcaaagcttcccgcgagaagttttggaaacgcttcctctaaaaggcgtttccagctctccccctcatgtccgaccagaatcggatagaaccggacgccgtttttctctgccgcgtcccggtctcccggtgcatcgccgaccatcagaatccgcccgggctcataccccatttttctcaattcaccgatgcagaaagccttggttcccgcctcctgcgtcagaagcgtactgcagtcttcggcaagatgatgtctgccccattccgcctcgaccgcctcccggttcgcggacgacaccgccgccagatccgcctgttttgccatcgcatccatcgcagacttcacattcggaaacggccggtcctctgccggaagcgcatggatcgcgcggttggtgcggatgctccagagcagcgctttttcaaaacacgggttatcactcttctgcgtcaccgcaagcagcgccgggttggagagctccttcgcctcttttgtccatgcctcatactccgcaagtccctcgatgttaccgagacctctcttctccacctccgcgagcgccagcgccagtcccttaaaccggttgataccgcgcgtgatggagtagaggttgatagaaagccaaagctccatgcactccgcttcatgctccgtcagtccgaatgttttgatccactgcggtccgaagcaggttctgtgctttacctccatcgtgtccatcgcacagccgtcgctgtcaatgcacacgatacaatcactttttttctgaaaatcaaaataccccattgttccacctcatgtattgccgcctcttccggctcctttgcaagcttttatacgccggagtatgccgcaaatgctccgtcgattggaatacatgcgccattgacaaatccgcttgcctcctcacatgccaggaacaggacggaaccgatcagttcctccacctcaccaaaacgatccatcggcgtattgtttaaaatcttgccggttctggctgtcggtgtcccatcctcattgaacagaagctttgcattctgctgtgtggaaaaaaatcccggtgcgatcgcgttgcagcggatacccacctttgaaaaatgcactgcaagccactcggtaaagttggaaattgcagcttttgcaccggagtatgccggaatcttcgtcaacggtgtgtaagcgttcatcgaggaaatattgatgatgctcgcaccttttttgttgaccatatcaagcgcaaatacctgtgtcggaatcagggtacccatgaagttcaagctgaatacaaaagagacaccgtccgcatccaggtcaaagaatgtcttcatctgtccgagatcctccggcacaaaatactcgtcgtcggtcgtcgctttcgggttgttgccgccggcaccgttgattaagatatcgcaggttccgaagtccgcagcgatctgttctctcgccgcctgtacgctcgctttctcaagcacgttgcacttgtatccctttgcaatatagccctttgccgtaatgtcatccgcatgcttttttgccgcatcctcatttaagtcgagcagcgctacctttgcgccggtcattgccattgcctccgcaagcacggagcagatgactccacccgcacctgtcacaacaaccaccttgcctgtcagatcaatctgaaatggtaacttcatgttcgtcttcctcctgatttctatttttctgatatttatttttcctttgaagccttctccacagcctcaaataatccgttgatataggttgctccaagcgcacggtcatagagtccgtagcccggtcttccggtctctccccagatcattcttccgtgatccggtctcacatatccggtaaatccattgtcatgcagcgctttcacaatcgcatacatatccagagagccacagctggagagatgtgcacgctcctcaaaaccattctcaagcactgcaacgttgcgcagatgtgcaaaatgaattcttcccattgccgcatattttgccgccatcttcaccacatcgttcttgttcgagcagccgagggagccggtgcacagtgtgatgccgttgtgcggatcatccacaagaccgaggaaacgatcaatgtttttctcgcaggtgatgatgcgcggaagtccgaaaatgctccagcacggatcgtcctcgtggattgccatgttgacgtcgcactccgctgcaaccggaatcactctctccaggaaatacttcagattgttccaaagatcatcctcagacattgcgttgtactctgcaaccacctgctttaactcttctctggtgtagcttgcatcccagcccggaagtgtcagatcgctgtcactctgcagcggattcacagcatccacctgctcctgataatataccagggaggtcgaaccgtccggcagcacgtggtcaagctgtgttctcgtccagtcaaataccggcatgaaattgtagcagatgcacttcactccggcttttgccacacgtctgatgttctcgcagtagttctcgatgtagcggtcgcggctcggcttgccaagcttgatgtcctcatgtaccggaatactctcgatgacttcaaaatgaagtccggcatcctccacctgctttttcagtgctgcgatgctctcctcgctccacacctctccgaccggaacgtcatacacagccgttacgatcgagtgcattcccgggatctgacggatgttctccagtgtcaccttgtcatctggtccataccagcgaaatgataatttcatagtttcctccgttctgcggaaggtcctttccgctcatgtgatatttgcttgtatacatgtctatgatattgctccatgtacgtttctttgtttctttttcttgactatatcatgcttgtatacaagcgtcaacatccatctttctttttttctgttttgtataattttttgtatctgttttgtctattattcacaatttacaccggtttttccgcaggttctgctttttctcctgttgtatacaagtgggtattcccaggcagattttccttgtttcatcttcttgcgccgtgttccgcgcgtcttaagttccggaaggactttttatcgaaatccgccagaattccgtctactgtcctgcactgtttttcatcctgccccaagaaacagcgttcccgttttttcccgatcctatgtatacatatgtaaggtgcatgtcccaggcttttgaaaaatagattgtaatttgttccattgggatttatattagaaatatgttcacattttgaatggtaagaatgggcatcaaactgcccgcagaggagtatgttatgaacggaaccagacataccggcacatccgttgccgtttataaagatttaaaagaacagattcttcatctggagcttccgccgggatctgccatcagcgagatcgacacggccgccacattccatgtatcgcgcaccccggtgcgggatgcttttaaaatgcttgagcgcgaggggcttctggaggtccgcccgcacatcggtacattcgtctccctgatcgacctcaacatgatctccgacattctctatctgagggagaccttagagcaggcagtgttaagagatctgaccgcagggtacgacaaatcccaggaattccgcatccgcctgctgttgcagcgccaatgcgaacttctggaacaggatctgcccgccgagggactcggccgggccttcatcattaacgacaacgagttccacacaacgctctacgagctcgccgggaaacgtaccgtcatggattttctgaccggagtgagctcccagtacgagcgcttccgcacctttttgaatctgggcgaccgcgacaatctactgcggctgtacaacgaccatatcaaaatctggtcgtgtatctcctcgcgggattatgaggggctctcggatgtagtttcccatcacatctacgacggcttcaatgcaagcaccgagatcatctccaggcatccggactatttctgtccgtttcactagaatcttttagagccggcaatccgcaggcgggttacgcctgtcggattgtctcacagacgcggtcccactcctgttttaatgacgtcattttctcttgcagctcttcgcgcgttcctgcacgtaagagcgcaacaatcgccgcgctctgctcaaaaagtcccgtaatccccagcgttccggtcagtccttttatagcatgcacctgctccaacagctccgcttcatcctgctgctccaatgccgtccaagccgcatccatgtgtgcatcctccggcagctttcgcagatatttttcataaatcgcctgctttcccataaaccgtgccaatgcggcatcgtaatcgattccggctgcgcgcagtgcgttctcatccatggcagtctccccctatcacgctttctatggttaaaattctactaccagatgcagcaatacgcaaacatttatttcttcattttcggctggaaaatcaggcttgccagatagccaaacaccagcgctgccgatatgcccaccgcgcttgcctgaaagcctcccatgaaaattccaaggaagccatattgatccaccgcctctttcacgcccttccacaatacatttccaaatccgagcaacggtacgctggcacccgcacccgcgaattccacaaacggttcatagacctgtatcgctccaagcagtgtgccaagacacaccagaagcaccatgatgcgccccggaagcatttttgttttttccattaaaatctgcaccagcgcgcagatcagcccgccaacccagaatacattgacataatccatagcattttccccctttctatcccgcatgctcgatgacgaccgcatgcgcaattcccggcaccgtcattccctcattaaaggaaacggtggagagcagcgctcccgtcgggacaaacaggattcttttccatttcccttcctcgatctgccgcataaaatgtgccgagagcgtcactgccgcacacccgcagccggaaccgccggcacccgttccctgtttgtctgcatcatagatctcaatcccgcagtcggtgtggatgctgctgatgtcataccctccggctctcgtcagatcccagagaatctcctgcccgacttttccgagatcgccggtaatgatcttatcgtaatccgtcacgtttcttccgaaatccgacagatggcggcagatcacgtcactggcggcaggcgccatagccgctcccatattcatcgaatccttgatgccgtaatcaacgatcttaccggtcgtgatccccgtgatgcgcgccttgcttctttttttcccaagcacgtaagcaccgctccccgtgaccgtccacgtcgctgattttgggcgctgattggcatattccagcggaaaacggaactgcttttccgcgctggcaaaatggctcgacgtcatcgccacaacataatctgcataccccgccgccacacacatcgcgcccaatgagagtgcttcgccgcaggtgctgcacgctccataaagcccgaacagcggcacctggtagtccatgagtccgaaggatgtcgcaatattctgcccgagcagatctcccgaaaacagatagcggatgtcctcggttttcaagcctgcctttccgaccgccagcgtaaatgcttccttctgcagggtactctccgcctcctcccaggtattctgtccgaacttgtcgtcctcgcccaccacgtcgaagcggttcccgagcggtccttcgccctcttttttcccaacaatactcgcactgcttatgatgtaaggagcctccgcaaacgcgaggctctgcttcccgacctgtatctccatatcactgcttcctttcgcaagacttttccttagtatgcggcggacaaacgtgtattataccggtaaaataccattttgatttttgttttcttctgttcacaaactttccggcaccggttcgactttttctgttgtgaatatggttcgttattgcgaaaaatgattcgttgcccggatgatagtttaactgtccggaaattggggaggctgggcgtgaaactggtttgactgtttagaaatgtttcgcatgatcttgaaatgatcggactactagtcaaaaacgaaatttcgccggcagacaaaaacagagggtgcatgcgggtgccgaatttccggcacgcatgtgcaccctctgttttatcaccttttttgcgctgttttctgcgcatctgaagttccgctggaacttctaatatgaatctgtaagattcattatatcatctttttgcgctgctttctgcgcatctgaagttccgctggaacttctaatatgaatctgtaagattcattatatcatctttttgcgctgctttcttaaagctctcctagaaatcgacctctgtatcgtagtagcagcattttaacagtttttccatctcctcctggctcggctgacgcggattcgatcccgtgcaggcatccagaattgcatttgctgcaatctccggcagtctctctaagaatacttcctccggcacaaatccctgctcggtcggatagctgtccgcgccgtaattcttgatacagtgcggaatcttaagattatcattcatgccgcgcagatatgtaatgaggagcgccactttttcatccagcgtatctccgcccagtcccataaaatctgcgatctcgccgtagcgctttttcgcagtctcatccttggcgttgaatgcgatgaccttcggcagatacatggcgtttgctgcaccgtgaatgatatgtgcgccgtaatctgcaaatgcagcacccgtcttgtgagccatcgaatgaacgattccaagcagtgcattggaaaatgccatacccgccagacactgtgcattgtgcatggaatcacgcttttccatgtctccattataagagcccacaagatctctctggatcatcttgatcgcatgcagggcaagcggatcggtaaaatcacagttcgccgtggaaacatacgcctcgatggcatgcgtcatcgcatccataccggtatgtgccaccagcttctgcggcattgtctctgcaagctccgggtccacgatcgccacatccggcgtaatctcaaaatctgcaatcggatatttaattcctttttcgtaatccgtgataatggaaaatgcggtcacctccgtcgccgttccggatgtggaagagatcgcgcagaaatgtgcttttttgcggagcttcggaattccgaataccttgcacatatcttcaaacgtaatgtccggatattcatacttgatccacattgcttttgccgcatcaatcggagagccgccgcccatcgccacgatccagtccggcttaaattcttccattgccttggcacctttcatcaccgtctccaccgatggatcaggctcaattccctcaaacagacagacttccattcctgcttcttccagatactgctttgcgcgatccagaaatccaaaacgcttcatggaacctccgccgacacagatcatcgcgcgctttccctcaaagtcctttaaagcctccagcgctccctttccgtgatacagatcgcgcggtaacgtaaaccttgccatatgctcctccaatccgccacttcctgtggcaaccattttttacagcctttgcccgccgttactatcataccccaaatccggcatcgtttctgcatatgttaagtataacatatgggcaagcgacgtggcaattctttccgtttctattctgcacattttcataagagattttcgcatcgtgttctgatatgccgttcccatgttccggcgtggcaggttggggtggattccaggggcttcacatctaaatcaggtgactcggttttttagttttttaggttttttagggtttttaggattcttaccgcccgggcttggcggcattctttctgttagtcgctttccgcttcataccacgcagcatttctttgtcctccgcacttacacggtatgactccagcattttctgaattgccttattataggtaaaatcatccagttcattttccagcagaaatgcctgagtctcctgcggaaattttgcataggcagttgcaattccccatgcaactcccattttgcaataatagccctcatgcttcaggctgttatatacggcgagcacacggtcgatatattcaggcaccagaaaatgatccatcagcatcactgccacaacccgctgttcaaattcactcttagacgcgcggtattgcatcaaaaaatcccacacctctgcccggtgctttcgggcaatcttaaatgtagaacaaaacccatcattgactgaccagtcgtggattttcggaataaacgctgcggcatattccaaaagctcctccatctccgctttcacgtagccaatcacaagtccctgcagcatgatctcctcgtagctgtcatcgcgtgcctccttaagataagttctccagtcttcctttgcgagctgcttcgccagcgagcgcagcaccggaagccgcactcccagaatcgaatctgtccccggaatcaggctgctggtaaaatctttgaactgcttttccgcatgtttctctaaaaaatcacgtatctgttcgtttgtcattctttcctctctttgcactgtcaatgaattactgtaaatgcgattctgtgtttgcgctgccttctgcgcacaatatgaatccgtcaggattcattatatcatctttttgcgctgctttctgcgcatccgaagttccgcaggaacttctaatatgaatccgataggattcattatatcatacatcaacgataccccggcaaaaggaattatcgcaataagcctagacctcttctgggtgatgtgtaatattattacaaacacacttggggatttctaataatattacttatcaaagcagggcgcaatatgcttattgcggcaattccatgcaagcacgttcgcatggaacatatccgtccgctgcacgtaagcatgcgcatccgtctttgcttcatgctcacttttgtctccgcgaacattatgttacaaaccgtggattctggtctatgcgcgcaaaaacgtgctctcagacccgcgaaatagtcaaaaacgggtctcagacggcaaaatgtatctcccagacccgccacgcccccaaatgccgctttttataacctcattttcctgctgcatcctcccagaatcagttttttataacctcattttcctactacaaccgctctggaatcagttttcatagatctcaccgtccacaattcttaccacacgacccgcatgttttgccacattcagatcatgggtaatcatcacaatggtatttcccatctgattcagattttcaaagagcttcaatacctcttttccgctgttcacatcgagcgcgcctgtcggttcatctgcaagcagaatggcaggttttccgaccagtgcacgcgcaatggctacacgctgctgctgtccgccggaaagttcattgggcttatgtccgatacgctgtgagagcccgagcatgtcaatcgtgtccatactcgcctcctgagcctccgcgagccccattccgcgcatcagaagcggcataacaatattctgcagcacgttgtaggtcggaatcagatgatatttctgaaaaatgaaacctattttctgattccggatttttaccagttccttttctttcgcctgttcgattgccacgccatccagcagatagtttccgctgtccatcacatccatgcacccgatgatattcatgagcgtactttttccggaaccggaaggacccaaaatggcaagatattctccctgctttacggtcagcgacacatctttgagcacatggagggactgcgttcccatgcggtaggatttgttgatatttctcattgtgattacgtctgtattttctatactttctgcttttgtgaccgcgcagatcgccggctccatatccatcactgcatccatatctctacaataacctcctcaccgtcttcgctggtcactatcagaagcttcagcagatcgccagccgccagccgctgaaacgtcgtctcggtacctgccgtggtgtgcaccaccgtgctgaccggaatcaatgttgtcacacttttaccactcatgccgccatttccgcccagtgctcctccaccgttacttcctgttccgtccgatgttgcatcgcccggcatgtcgccattttcttcctgcggcatcccgtccgacatctccgtgctatcatttgttccggaagttccctgcgacatcctgccagacgcccccgagccatctcccggcgcccctgaaccatcacttcctccaggcgctcctgagccatctcctggcgctcctgcggtatcacttcctcccggcgcccctgagccatcacttccttcaggtacccccgagccatctctgcctttttctgcattctcagtgtcttccgtgctgcttgcaagatatgcctccaccaccgattcatcgacttccatatatgtcaattcatttccctcgatgctggtcacataggcatacacatatttctgattatccgccagtgtctccgtgtctgccgtcctgcgggtccatgcgaaaatgcctccgccgccgagcactgctgcaagcgccacaatgccgcccgccaccgctttcttctttatcatgccaaacctcttttcaattatttattccgcgccaagtgcctccactggaaccagattggacgccttataagccggataaaatccgaagatcgttcctgttcccaccgcaaacacaagcgcaatcaaaaatgctgacgccgacagttccacacggacgccgaggtactgtacaatcggcgccacagccagcgatgccagattccccagcacaccaccgatgagactgattgccgccgcctccgcgaggaactccagcagaatgtcccgcttggaacagccgatcgcttttaagataccgatctcattggtccgctcttttacagatacaaacaatacgttcataatgccgattccaccgaccacgaagacgatcgccgccatcgcaatgagaagcatcgtcagaatctggttggaagcctccgccgcctccatcttgcttcctgcatcctcaaatgtgaactcagcgttcgggtaactggtggcaagcacttctgtcacttcctcgatcacgccttctacattattcacatctgccgccagcaccgtgatcgtcgggctgaccgatgatccgaccagatatttcacaccggtcgcataagggataaaaatggaatcatccgggctgataccggacgcgaccgttcccatgctttccagcacaccgtttaccacataaagccggtcgtcgatatagatcacgcttccgtatgcctcaatggcactgccgaaaatctcttcggcaacgcttgcgccgagcacgcagactttttctttgttctcatcatcatcgtcggtgataaagcttccgaccgcgagggagaggttactgatcgtctcgtagttacttttcactcctgcgatggtataggtatcggcttcatcgagatctccgccatccacactggattttgtggtgtaggaaatggtcgctgccgagatgccggacgcaaatgtttcgatgtcatccacatcatcctcgctcagcgtgatattttcctgattcatgcggtcttccatatcgctctgtccgccgaaaaagcttcccatatccggcataccgccgccgtcaccggaaggcatctctccccccggtgatccgcccggcgcctcgcctcccgatgaggaaccgcctcccatatcgccggagggtgctccgccaaaaccgccgccaaagcctccgccgccacccggcgccatcattgccatgtcggaatccgaatcatcgctgcttcctccgccgccaaaatctgtcccgccgtcataggaaatgtccaccgcaccggcatttaagtttttaaactggtctgccacgtccgcctgaccgcctttaccaatggcaatgaccatcacgatggtggccgcaccaacgataatgccgatcgaggtcatgatcaccttaaatttgttctgtgtgatattgatccagaccagtctcaataattcttttggcttcattctgtcacctgactttctatcagcacagtttcaccttccgtgagcccggacgtgatttccacgttgaccccgtcggaaaatcccgtctccacatccaccatgcggatcgttccgtccgcatccttcactttgacataggatgtcgttccgtccgactggaccgccttgttggatacatacagcacatccgtcacctgcctgctgataaatgtgacgtttcctgtcatgtccgtgtatattccggtgatgtccccggtaaacgcggcggtcacattgtaagacaccgtggaggaaccgctggaagatgaagtgtcaatgctctccacctcccccgcaaacgtctggtcctcataggcagacagctcgatctccacgacatctccgactgcaatattcgtgatgtcctcctccgacacggagactgtgatcgtcaccgcatccgtattggaaaaagtggcaaccgttgcgccggaagagatggtatctcctgcctcatacgacaaatcggtaatggttcccgtatactccgcatagatcgtgccgtcatccccgatggcagcctcaaattcctcaagtgcctcctccgcgtcggacagcgtatcttttgcatcggtaatgtcattgtccgccccggagacatccacactgtactgactggatgcattttttgccgagagttccgcttctttcaacgttttctccgcctcaatggacttcgtggtatagttgtttttcgctgccacaagttttgtgtacagtttgtcgtaattttcctgctcctcggtaagcgatgcgcttaagtccacgcccgcatcgatctgctcctgatagtaattgatcagagacgccgacgtatccaccgcttcctgcgcgtcatccacagcctcctgcagctgctttatggcagcttcgtaggtctcctgtgcaacagattcctccgccgtgctcagattgtaggagtagcttgccgatactttttgcttttctgcacttaagcccgcctcgctgacggctgtcttcgcctccgtcaccgcttcctcaagatcttttttgtaggatgccacgctctcctccgtgagctttaagatgggagcgccctccgcaaccgactgccctgcggcaacatagaccgtttccacctcaagggtcgatgccgtgctggtggacgacgtcgcattttctcccgcactgttctgcgcagacgagttgttctgcgtgcttgcagaggaagaatcctctgaaaaatcaagagtctgatccagcgtgccgatcgttacgctgccgctctccgtcacgcccgccgtcagatttcccttctccacggttacttccttatatacggcctgctcttcgctgtcacttcccgactgatatgcaaaggtgacggttcctgcggcaagcactgccgccgcagccactccggtcaccagccaaagctttttcttcttcattctgtctttcctcctgcttcctctgtctcagacgctccgatcgtctcggtttttcctgcggtcttagtctcttccatttctgtggctccagtcgcctgtgtttcaaacttcaccgttgcctgtacgccagtagtaagtgtgccgtctgtattgtccacggcaacaatgaccgcatacgtcacattggacatgcttccgccggatgttttttccgatgcgatggaatagacggttccgtcgattgctcccattctgcttccactgatctgtacctgcacggtgtcgccgaccgcaagttttgcaatatcgttctgtgatacctccacagaaatcagaatcgtatccagatcgtaatagcttgcaaatgcggtatttttgatcagtgtatcccccgcctcgtaagtcaccgatgcaagcgttccgtcacggtccgcacatacaacgccatcctcgatcgctaagagtgcgctctgctgttccttcagctcatccagcgtatcctgcgcttcgtccacagcactctgcaaggtttccagcgaagcttcatactcggtatccgcatattttccctccagaaccgcctcttcatactgctgtaaaagcgccggctgcgccgtcgtctcattgcgctctgcctcgtcgcaggcgtcactcagttcctccagctcgtctgtcagctccgcaattttctcatttgcctctgtcaccttcgtgttatattcctcgaccgccttctggaatgtctgattagcaagctgcagtgcactgtttgcgctctccgcctctgtctggctctgcgacagggcgtcggctgcctcctgcacggcggtatagtccgcagccagctgatccgccagcgccgcaagatccgtgtaggacgctccggcttcaatctgtgttttcatgttcgccatatccgctgcatatgcgttctttgccgcctgactgctgctctgtgcatcagaaagctgggtctgcttttccgtgagtgccgcctgcgccgcatcgactgccgactgtttttcattgatcccgacctgtgtgtagtaggtgccgttgtcgatggcatcctgataatcggagatctcctccaccgcctcatcgtacgcttcctgcgcctcgctggcctttaccgacagctcgctgactgctgcatcataagtatcctgcgcggtgtccgctgcaagttttgtggaggaaagctcgctctccgcctccagtacgccgctctcaaaatcgatcttcgcagactgcagtgccgtttccgcatctgaaatggcatcctcatagtacgcctttgcatccgccatgctctcatcgtcgatcttgaataaggcatcgccctccgccacggtgcttcccgcttccacgtagacttcttccaccatcatggttaccgcattcacagaaaaatcaggcagctggctctccgttttcacctgtgtggttcctgtcccggaaaagctgccgtcttcctgtccgtctgtctcatctatctgtgtgtcctcctccgtctgatccgctgtgcccgaagccgctatcacatgatagccaactccgcttcccgcaactgcggcagtcagaatcccggcaagtattccgtaaaattttctggaatgttttcccaggagtttgtgtacccacgctattttcattgtttcatcctttcccttccggcatttcatcctctctcatgtttcacggtaaggatagcatcgctttctaaagggcagctgaatgcaatgtgacggttatgtgacagaaccgttaaatatctgtgtttcacggcaggcagggacacttcctttgacagattaggaaaaaagtattacaatactcccgtttctatagatctgttacattggagattattcatgaagaaaattgctttttttgatatcgacggaacactgacttccgagattgacggttcgattccggaaagtgccgtctatgctatacgggcagcgcgggcaaacgggaatctgatgttcatcaataccgggcgctgttttcagaatgtggaacagcgtttccgtgatgtgggttttgacggctttgtctgcggctgcggcacagatatctactgcgacggtgccgaaatccttcatgtcgcacagacgcacgagaccgtaatgaagctgcttctcgcagccagggagtgggatatcgatatcctgtttgaatccaggaaagaggttgcttttgatctggcaagaccgctccggcacccggatgccagacggcagtatgaggcgtttgaagaacgcggctatgagatgccggagcaccttgagaatcctaattttttctgtgataagtttgtcctatggtttgagcaccccgagcagcttgccggtttccgtaccacaagtgaccgctattttgagtgcattgaccggggcggcaatttccgcgaattcgttccgctcggctactccaaagccaccggtcttaactatgtgcttgattattaccagatagacaaaaaggacgcctatgccttcggcgacagcaacaacgaccttcccatgctcactgctttgacaaacagtgtcgccatgggcaacgcctctcctgccacgctttttgacaaggtgtcctatgtaacaaaatgtgccagcgaagacggcatccgccttgcgctggaacatttcggttttatctaaagtctgcggttatcccgcacgagcaccacagccatcacgatggctgtgagaagctcggatgccgggaacgacagccacacgccattgatgccgaatactgcggcaaaaagcaacgagcagccgattatgcagacaaatcctctcataactgatgtcacaaacgattcccgcgcacgttctgtcgcgcttaaaaatcccgctcccacaatattgattccggcaaacagaaagccgataaagtacagccgcattcccgtgtgggcatacgctgccagttccgcagaatgttcactgttaaacagacttaccagagaatccgtaaatccgtagacggctccgatgagcactaccgcgatgcccaaagccgcggcaagtccgaggtttcgtattttccggacggatttcacatctccttttccgtagcagtcgctcacgatcggctgcgctccctgcgacactccgttgaagattgccattgccacaagcgcaaagttcgcgatcactccgtaagccgccacaccgatatttcccacaagaccgagcatcaggaaattgaacacggtcgtgatgactccggaagaaatctcccccacaaatgccgggacgccaagctgacacgccccgaataactgggcgatggacggcgcgtgcagccggaactgcacagtattcttttttccaaggaaatgcgcgctgcagatcagaatgctgatgatcggcgatgccgccgtggcgagcgccgctccctctagccccatgccgagcggaaacataaaaatatagtcaaacagaatgttggaaaaacttcccgcgagggttcccgccatcgctaaggacggctggttatcgttgcgcacaaatgccatgatgacgtagttcatcatgaaaaacggcgtaaacagcagaaagattctcgtatacccggttccaagcgccacaattcccgcatcgccgcccatcagcgcaatgattttatccgggataaaaatgcccgcaagtgtaaacaggattccaatcatccacacaaaacagatggcgttggaaaaatagtcgtgcgcccgctcctcgccctgcgcccttaagatcgtaaagcgcgtcgcagaaccgacaccgatcatcgaaccgatcgcaaaaatcagattgtagatcggtagcaccagatttaaaacggtaattccgtccgttcccgctgccttcgcaataaaaaaggtatcagcgatgatataacaggagatacctaacattccgaatatattctgtgtgacatacctgacaaattgttttgtgactgacatttacttttccccgcagttctttttcatgctcattgtttcttatcttacatccggagcgaaccgcatgtcaagccatgggctgcagggcggcggaatgcactgtttcccagattattatgtccttgtatgcttttcattcctttgctttacttttcatttgtagtatgatttaataaaaacaatatattctcttttttcgctgcttttccgcctgaatttaaaacagcaacgggcaggaactccgtaccatccagaaccagcttcagaagcttcctccaggaaagcttatctgctcccgtaacggcaccaccgtcaaatggtatcagggcgacggtcactccaagacctatattccgaaagcgaaccgcactctcgccgaacagcttgcgctgaaaaagtatctgcagcagcaggaacaaattctcttgcaggagcagacagcaatcactgcctatttaaaatactcccccgcgggcagcctctcttccgatgatccacatcttctctctgatcccgcctgcgaagatctgcttcattcttatttttccacctcaaaaaatattccggacgtctcgaatgtttcagatatctcggatatttcgactcgttccgctgtcgaatggtctgccgcttcctacgaacgcaatccgctccatcccgagcaacggcttcacaaaaccgtctccggcgagagagtgcgttccaaatcggaagccataattgccatgctgctccacctaaacgccattccttaccgctacgaatgtgcgctctcccttggcggcgtcactctatttccggatttcaccatacgccatcccgtaaccggcgttctctactactgggagcattttggtctgatggacgatcccgcctacgcaaaaaacgccggctcgaagctttctctctatgccgcaaacggcatcattccatccgttcatctgatcaccacgtacgagaccaaagcatatcccttaaacgccggcatgattgagcatctgatttcctactattttctggattccgcggtctgaatccgtgcttctctcttccactgtcatttccttcttttcgttcacttctcgggtctggaacgacgttttttctctcccagacccgaaaatcacaatatttcgggtctgggagaacatttttcttcttccagacccgggtggcttcttttttctcttctttttctcttctttttccctcttttggacagtttctcgggtctggaacagcgtttttcctctctcagacccgaaaatcacaatatttcggatcttggagaatgtttttcctcttccagacccgcacggaaaaggcactacaccattccccaccattttaatccccaatagatgagtccaagcacccagcttgaaaatattccgtataaaatgaccggtccggcaatcgtaaagatcttgcagccaattccgaagacctggccctctttctgaaactctatggcgggcgcggccacaccgtttgcaaacccggtaattggcaccagcgcgcccgcgcccccccagtttgcaatcgaagggtacagattcagaccggtgagcagtacagacagcagaatgagcaacatagagcaccaacttccggatgtcttctgatccagtccgtaattctcacacacgttcagaataaactgcccgatgcagcagatgatcccgcctgtcacaaacgccttcgccatattccaccagagattatgggtgggagtcacctgcttcacataatcattgtattttttttgtaaacgttctttttccttatccactgcgcaacctccgtcttttttgtcagtatgcgcattttatttatttctattccttcgaccgctccttccgccattttgccactgtaatgccgtgatgccccgctttatgcattcttacgcccctccggccgctccttccgccattttcccactgtaatgctgtgattccccgactttatgcgttcttacgccccttcggccgcttctttcgccattttcccactgtaatactgtgattccccggctctatgcgttcttccggttctccgaccgctcctcccgccatttctcctctgtgatgctatgctgctctacctttatgcgttctgccagtcatccggcaatgtgaccgtccagagatatttttcagtgcgtccccagtctaaaagttcccgcatctgctcatcatatacatcttcgggacggtagtccgccaccatcccgaacagatacttttccttctcatccgctggtatcagcgtcggtatcttctccgacagaagcgcgagtagttcctccggcttgatgtcctccgggatctcaactccggaaaggttggcgataattcccgcagcataataaaattcataatttcctgtcagaattgacttctgcatattgcacttgataatcacgctctggcgtgcgatggatggcaccataattttcctccgtaaaaaaacaatctcccatcattgtactactgtgccttaaaatttccaaggaaatagtacagcgatcctgccacttttcctgccgccatcgcaagcatgacccagaagagtccgacctttaagcccatgcgccggaatgtaatcggaaatgtattcaggatctccgcgagcgccaccgcgatgcttcccacaaatatcccggcagaaataccgtacacgcacagaagcgccggtccgaacggaatccggatctgcaaaaaaacagacgccagatttccacagattccgcccagaatcacggcattttcaaaatgcagtgtctctgccgcgcggttgcactttccaatcatacgcggaatgacaccgatgacgatcaaaaacgcaaatgttcccgcagagacggcaagtcccgcggcaagcccgcagaagcccaaaaatatatgctcaattaacatcgatgctgtgtccctttctctccgcgttctctatgaacgtagtatctatgtccttctcatatttgcgcatctccacctgcatcggcgtcggatccggcgtgatcttcttactgcccacatgattgaaaaacagcgtaatgccaatggcaagtccgatgctgtaacagatttcaagttctgtcacgccgcttgactcctttcccatcacctgccgatagaatttggaaaagacatctcccacggatacatcgttgttgaacgccataatcgtgaacgccgccccgaaaaaaatgaccacgcagagcgcgacggtctttaacgcattgatccacttcggtttctcgggattgggaatgtattcaatgataaaatccttctctccctcattgctgatgtccacattcggatattcctcatgaatcagttcgacgatctttaatatggaaaaaaccttcatctggttcttctgtttgcgcggattcatcgcctccgcaaacgtatagatttttttctgcttcagctggcgcacaatcgaagtatccgggcactccattttcgcaatgtccccaagcgtcacatgccggtctgtcacgattgtattctggtcaatcttaagatacagtgtctcactctttgcactcatgccgcagttcccgcttcccatgtagaattccgttccaccagcacgccgtccaccggggtctccccctctctcccgtatttcagatataaaagtgccccgcagatcagcgcgatggccagcactcccacaaggcatgctctgtattttctgcaattcatattcctgtcctcctgtccgtttttacatcacttgcatgatttatgcattattatgcctgtcctcacagatattatgtacaggacaactgacaaaagtaccagattgctttttttataaaaacgtgttactttttcatatggacattttattatcagaaaggcggacatccaaatggctgtaaccaaggaaattctggctctcgccgtggaaatcggcgatgcactgcttcggaatggtgccgaagtctaccgcgtcgaggacacggtcatgcatattcttgaggcatacgaaattgaaaattatgatgtttatgtgctttccaacggaatctttgcaagtgcaaacgaggatcgtgaagatgcctgcagcatgatccgccacattccgctcggcaccacgcatctcgggcgcatcgctgcattaaaccagctttcccgcgagatctgttcccacgaatgttcgctgatcgacgcctggaaccgtctggaaagatgtaaaaatatttcgttcggtaaacctgtcatccacatcttcttctgcggactaggttgtagctgtttttcctaccttttcggaggtacagccctggacagcatcgtcggcttttttatcggcatgctgctgcaggtatttctgtttgccttaaagcgccataagaattccaagtttatcacgaatatcctgggaagtgcattcgtaacgctgctgtcgctgattgtactctcctttggtacccccatcctctacgataaggtcatcatcggagacatcatgccgctcgtccccggaatcgcgctcactacgtcgatccgcgacttttttaacggagattatctgtccggtgccattcacatgattgacgccatcctgaccgcattttgtatcgctgtcggcgtcggcaccgtcattacgatctatcattttgcaaggggaggtgcagcgctgttatgattatccagtttattgtgagtttgtttgccacactctcttttgcggaactgtttggcgcgccgaaaaaggaactgtttttctgcggtctgaccggtgccatcggctgggtcgtctatgtgatcggcttaaacagcaatatgggcacggtgcttgcgaatctgaccgccaccttcgcactcaccgtattttcgcgtattctgtccgcgatccgcagaaatccggtaaccgtttacctcatcgccggtatttttccgctggttcccggagcaggtatttactatacgtcctactatttcatcatgaacgatatgacgcaattctccaactatggcatggaaaccatcaaggtggcaggtgccatcgtgctgggaattgtctttggcttcggtctgccgcagagctggtttaacgcgctgcagcgaatagaaagaaaaaagacggctttgtaaaatgaaacgttatattcttcattcctgccccgcaatctttgccgccagttcttccagatactcccaacgctccatcttttcctcgagcgcccgttctgctgcttccttttccgccagaagttccccaagcttcactgagttcgtggcgttttccgccatgtcggcatccagctgctccacttttgcttccaggttcgcaatgtcatcctcgatcgtctcgtattccctctgttccttataactgaatttcagcttcttctcacgtttccaggtgtttctggaatccgcctgctctgctgcatcctgcccggatgtcccggtcacaccgccggcctcctgtgcgctttccgcctccgagactccgcgtgctgtcattccctgaacttccgccgtttcgcccggctttctgccttcctccgccagtcggttgacataatctgtataaccgccttcatactgccggatctctccgtttccctcgaaagcaaaaattcggcgcaccacgcggtcaaggaaataccggtcatgcgataccacaatcacgattccctcatagctgtccaggtagtcttccaggatcgcaagggtctgcgtatccagatcgttcgtcggctcgtctaaaatcagcacattcggcgcctccatcagcacgcgcagcagatttaatctgcgccgctcaccgccggaaagctttccgatcggactgtactgctgcgctgccgggaacaaaaaacgctcaagcatattcgatgccgagaccagaccgtccgttgtccgcacatattccgccgtgttccggatataatcaatcactttttcctccgggtccatgtaggcgattcccgcttcgcggcccgtctcaatctcctgcgtatagtagccgatcttgatcgttgccccgactgtgatcgtgcccgcatccggcttgatgcgccccgcaatcatcttcatcagggtcgtcttgccgcttccgtttgccccgatgaatccgatccggtcccctttcagaaaaatataggaaaaatcccgtagcagcgtccgcccgtcatatcccttggtaatgtgatccagctcgatcgtggtttttcccattctggaatagacggaactcatctccacctggctgtcgcgctccggcgccttctgattcttgagttcctcatagcgctgcaagcgccccttctgcttggttgtgcgcgcttttgccccccgtctgacccattccagttccttccgcagtacagactgacgcttgcgctcactcgcctcggcgctctcctcccgctccgccttccgctccagatagccggaataattcgtctcatagctgtagattgcccccttgtccacctcgacaatacggttgcagacgctgtcaagaaaatagcggtcatgcgtgatcatcaccagcgcaccgcgccattttttcagataattttccagccagtccgccattgccgaatccagatggttcgtcggctcgtctaaaatcagcacatcacacggcactaaaagtgctgccacaagtgccagacgttttctctgtccaccggaaagttctccggttttctgtgtaaaatcggtaatgccgaggcgcgtcatcatgctttttgcatcgctctcaaggctccatttctgttcctgtgcatgcgcgtctgcatcggtgcgctctgtcctcccgctgccgacaaaatttaagacacactgtgtcagcacactgtcaagtaccgtcatctccggatcgaacaccggattctgcggcaggtatcttaccacgatatggttggcgcaggtcacctgaccttcatccggttcctccagccccgcaatgatttttaacagggtggactttcccgtcccgttgataccgattaccccgactttttctccctcctgcagataaaaggaagctttgtccaaaagcttcctctctgtgtatgatttcgttaaattctccgcgttaataatattcatgtctcttctctttctttcctgtttctgtatgactcaaatggctctcaccggccggcttccttctgcgtttctcctgaaacagccgcctgctacctgtcgttttgcgctttctcctgaaacgtgcggatataccgcaggcactcctgttccggcagaggtctgccgtaatagtatccctgaatacattccacaccaagctgttccatcgcttcgctctgctcccgctcttcaattccctcgataatcagcggaatccccagctgtttgatggtgtgaatctcattttcaagcacgatgcgcgccgccttgtcgtggaacgacgcccacacgatctccttgtcaatcttgatctcctggaatggaaaacggatcagataggaacagttcgcatttccgcttccgtaatcgtcgagcgcaaacgacactcccatttttcccagctcatgcatatgccacagcatccgctccggggcgccaatcgccgtgcgctccgtcacctccagcgtcagcatggacggcggaatatggtaattctcaagcaccggccggatggtctcggtcagattctggcgcagacactgcaccatcgaaatgttcacatggatggtgcggattccaagcgagccgttcgagagcacatgttttgagagaaaacggcaacactgctccagcacctgttccccgatatggatgatattgccgtcgcgctccgcaagcggaatgaattcctctggcgggatgaagcccagctccggatccttaagccgcaccagcgcttctaaggacacaatctgtcgttctttcagggaatataccggctgatagtagaccagaaatcccttctcccggatcgcccgcgccacggcaatctccacttttctgcggcggcggtactgtgcgatcatgtccgcgtccgcctccacgatgacctgcgcgccggactttccggcattttcaagcaggaactcccgcattccgtaatattccgccatcgccttaaagtccatcgggtagtgctgcaccaccgtctccatatccagcgcaatgcggttctcctgcaccacccagtcactttcaaaccgcttttgtatctcacattttaacctttcacactgctctttggtgtctgcaaacaccgtaaatgcatctcctgccgtgtgaaacacatgaaattttccacacagatcatacagatactccccgatctcgcgcagcagttcattgctgttctcggtacccagaatcgtgtggatatggtaaaacttactcaaatgaatcgtgagcacatagccctcgccctttctgcggagccggtcctcaagctgcgattcaaatgccgtcccgtttccgattcccgtcgtcgtatccagaaacaccaccggattctgaatctgcagatagagcattatgagcacgaccgtattgctgacgctggtgcaaaggatctctctgtaccggtattgcagcccgatcatggcggctgccacagccgtgtaggcgcacacgatgaccttcgtgcgaagcgtggtatatttatgctgccgcacgacaatcagaagatccagcaaaaagaagatcacaatatacgcgtatccgtaatccgcgccgacgccctgataataactgccgtcactaaagtagtaaaaaaatccggtcaccggcgtcactgccaccagcacaagaaacacggcaaacggaatcatgcccgcagccgcaaataccgttctctccctgccgcggatcgcacatgccgccataaaataccggtaaaccagatatgacgaagccccctccaacacaaaaaaagcaaacgccagtacctcgttcagacgctgcggaacgagggctgcatttgctaatcccacacatgataaaatgttcatcagacactctgcttcacacacaaacaaaagccagccgaatacccgtgtcttctccccgggaaactggcgcacgaatacaaagtgcagtaatataattgtcataattaagagtgatgcgatctcaaaatcataattatactgcacctgtatctccctcctgctcttcctgtgctgcctttgcctcaagaattgcctcattgagctggagcatctttgcgtccagcatggaaacgattcccgaacactcgcgcagatccctgctgatgtaatccggcgcatttccctcaaacttatagtagatcttgtgctcgaggctcgcccagaaatccatcgccatcgtccggatctgaatctccaccttcgtgtcgataatgcagtccgacaaaaagatcggcaccgtcaccagcatgtgatagcttttgtatccgctctccttgggatgtctgatatagtccttcacggagattaccgtgagatcattctgcttgccgatcatctcggcaaggcggtaaatatccgacgtaaaagaacagacaatccggattcccgcaatgtcgttgatgtaattcaccatgttgtcgatcgaggagtcatagccataccgcttcagctttttgacaatgctctccggcgctttgatgcgcgacttgatatattcaatcggattgtactgatgtacctgttgaaattcgtcatttaaaatctcgacctttgttctcacttccttgagtgccgagttatacagaaaaataatggtgttccagctatctacgccttcacccagggttacttcccctaacgcaaccggcttgtccatgtgttcccctccagatgtctccccttatcatttattgcaatacgctccggcaaaagtccggaaaacctccggcttcccggactcgcgggcgcgtatttcgcagtacacgtccaagaaatcacagatttcttggactaccgggcagtcgccctatcaaaatcgtgccagcgaaaatgtgctctgcaagcaggcaatttttgctgttacgattttggcactgctcattgcttatgtacattataccatattccggggggattaggcaaatcgaaacacagcctgctgaaaccggttctttatttccttccataacttatgcagcttaatcctcctcgataacctgcatttccagaaaatcaaaatcaatctgctcgataaaggaatcctgcgtaaagcgcgtcttggcatggcgcttgaattcattcacattcgcctccagccagatcggttttccgagatcaaattcatagcacacttcctcgagcgcatgaaagactttgtgcgtccttgtctcatcggactcatccgtgatcgtcgtgtcccgcagcaagtggttgttcttcatcatcttaaaccagattctcattttccgttccttctcctctgcctgttggtctcatacataagcagtgctgcggatactgccgcattcagggattccacacttccctccatcggtatccgcacgtaggtatctgccagccccgcgatctcatcggacaatccattcccctcgttcccgatcagaaacgccgtacctttgcagtaggacggttcgtcatactgcatctgtcccttcagatgcgccgcgtatatgccaaccttctgccgttttaattcaccgatcgtctctgccaggtcgtccgcaatatagtagggtacccggtaaatgcttcccatcgtagagcggatggtctttggattaaacagatccaccgtcgtccggttcatgatgatgccggtaattcccgcaccctcgccggtccgcagcatggttcccagattccccggatcctggatgctctcaacgatcagcagatgtgtcctgtccccgcgcagcagaccggaaagcggatactgcggcatacgcaccagacataagatcccctgcggcgtctgtgtgtcggaaatgctcttaaatactgcatcggcaacgacctcataggtctttcccgcaagcagctgctccgcttccggttcctccagaaagcgctcggagacataaaccttagagagccactccggcggaacctcctcaaacatctttctgccttccacaacaaacaggttctggcttttgcgctcttttgcctttttcatcaatgccgtaatatttttcatctgctgattgctgctgctcgtaatcatgactgctcctttttgttccctaagcggaaaaaactccatgagttcccgcccatggagtcttatgattgttccaaatactgttatgtatcttacattgaaaggttcttgctgatctgatactgatactccggaatgcatttctgcattgcaagtgcctcatcgatgtcgtcatccacgaaatcgccgtgacgataaccaacaacacggttgctcttgccctcgcagagcagatccactgccagcgcacccatcgtggatgcatagacacgatccttacaggtcgggcttcctccacgctgcatgtgacccagaatcgtcgcacgcgtctcaacgccggttgcagcctcgatacgcttcgccatacttgcagaatgtccgataccctccgcattgacaataatgtgatgctgtttgccgcgtttacggttctcgatgatatggtttacaatcttctgctcatcgtaatcatatttctccggaagcaggatatcctctgcgccgttcgcaataccgcaccataatgcaatataacctgcaccgcgtcccataacctcgatgatgctgcagcgctcatgagaagtagaggtatcacgtaccttgtcgatcgcttccattgcggtgttcaccgctgtatcaaaaccgatggtatactctgtacatgcaatatcaaggtcaatcgttcccggaagaccgatggtgttgatgccgagtgccgccagcttctgcgcacctctgaaagaaccgtcaccgccgataacgataataccgtcgattccatgcttcttgcagatctctgctgctctctgctgaccttccggtgtcttgaactccatgcagcgtgctgtctgtaaaatagtaccgccgcgctggatgatatcggaaacgtcttttgcttccatatccacaatctcttcctgaagaagtcctgcataacctctcttgattcccttgactttcttacccttggcaatggcttccctaaccactgcacggattgctgcgttcatacccggagcatcgccgccgctcgtgagtacaccaatggtgtttatctctttcgccatttatcgttccctcctcatataatatacccatttaatctatcttattttaatctctttatggtttcttttcaatgctctttttgacaacttttacgttattttcccccaaaaacttagttaaattgttcacaatctccgtttcaatgcagatactgtagttttcgggcagccgcttcatcgccttgatcgatgaaatatagatcactaccgtgtcttttccatccgaatcatgaagcatggcatagagttctttttccttttccgcaaacgcttccttggtctcaaactgaagccataattcatcgccgcgccgcgtgggcgcctgcgtggcgcgaccgtctcccgcggatgccggactgctgcccgcattcccgctgtaagcgcgccggctgccgttcccctgccgataggtacgctgctcctgcggcattccgttttccgcctcggcaaaggtacagatctgttcacagatgatcttggcgtttttatcctcctccacgttggcatgtccgcggataaataccttctcatcctcattcagcagcgtatggtagcgctcatactcgccagggaatacgattacctccaccgtgccgaacagatcctcgagcgagagaaacgccatcgttttattgttcttcgtatatttgatggtcttctccgtaatcattccgccgatgataaccttctggttatcccgcagcttgacctcgccgctctcctcgtccagcagaaagtccgacgtcaccgccgatataattttgcgccatttttcctcgtattcctccagtggatgaccggtcagatagataccgatgacttccttttcaaagccaagcttgatctccttgctgtactctccaacgttgggatactgaatctcataggcttttttctcctcctccgacaccagatcaaacaggctcatctgtcccgccagcgacttctttttcgtctgcacctgctgatccatcagagcgttgtacaccatcatcatctgctgtctgttgccgtctaaggtatcgcaggcaccggatttgatgagattttcgacggtgcgcttgtttacctcagagtccgccacccgctcaataaaattctgcagggtacggtagggaccgttctgattccgctccgctatgatcgcatccaccaccgaacgcccgatactcttgatcgcatacagtccgtagcggatgccgtctttcgtcgccgaaaaacgtccctcgccctcattgatatccggggccagcactttgattcccatctgtctgcaggtatagatatactccgccaccttccgcgggttatcaatcacggaggtcatcagcgccgccataaattccaccggataataatatttcagatacgccgtctgatatgcgaccaccgcgtatgccgccgcatgggatttgttgaatgcgtacttcgcaaaatccaccatggaatcgtagatctcattcgccgccttctcactgataccgtttgcaatacagcctttgatcccctgctcctcatttccgtaaacgaaattgtggcgctccgcatcaatgacatactgctttttcttactcatcgcacggcggatgttatccgcctgtcccatggaatagccggcaagattctgcacgatctgcatgacctgctcctgatagacgatacatccgtacgtcggctccaggatcggttccagttccttgcaggtgtatgtgatgctctccggctcgttttttcccttaatgtactttggaatgaaatccatcggtcccggacggtacagagagattccggcgataacatcctccagactctgcggttttaactccttcatgaagttcttcatcccggcactttcaagctggaagacgccctcgcattttccggttccaatcgcatccagcaccttcttgtcgccgtaatcaatctggatcgcatccggatcgctgttgtcattataatcgatgtgatcgacgtcgatccgcacaccgtgattcttctccacaagggcaacggcatctttgattacggtaagcgtccgaagtccgaggaagtccatttttaacagaccgagttcctcgatcgttgtcatgacgaactgcgtggtaatcgtgccgtctgaagctctggaaagcggtacatactcatccatcgccttctgtgaaatcacgacacccgccgcatgcatggacgtatggcgcggcagtccttccagacgttttgccatatcgatgagtgtatgcaccgtgtcatccgtctcgtacatggtgcgcagctccggattcatggtaagcgccttatcgatggtgatgttcagttcgtttggaatgttcttcgcaatcgtatcacagaaattgtacggcagatccatcacacgccccacatcgcggatgactccgcgcgcagccagcgtaccgaatgtaacgatctgcgtcacgcagtccttgccgtatttcccgattacatagtcaatgacctcacttcgtctctcatagcagaaatcaatatcaatatccggcatcgtgacacgctccggatttaaaaaacgctcaaacagaagattataccggatcggatcaatattggtgataccggtcgtgtaggagacaagacttcccgccgcgcttccacgccccggtccgaccgggatgccatgcgttctggcataattgataaaatcccacacgatcagaaagtaatcgacatatcccatcttctggataacggaaagctcataatcaagctgcggcagcagctcgtcatggcggtccggataacgctggatcagtccctcatgacacaatttgttcagatacgtccaggaatcatacccgtccggcaccgtaaagtgcggcagcttcgtcacaccgaattcaatctccacatggcaccggtcggcaatcttctgggtattctcaatcgcctgcgcggcgtaagggaaaagtgcgcgcatctcctcctcggatttgacataatactgtccgccctcatagcgcatacggttctcatcggacagctttttccctgtctggagacacagcaggatatcatgcgcctcccagtcctccgcataggtatagtgcacgtcgttggtggcgacaagctcaatgccaagctcctggctaagccgcatcaggccggcattcaccgtcttctgatccgggattccgtgatcttggagttctagaaaataattgcccttgccgaagcatgcctcatagcgctgcgccgtcttcttcgcctcgtcataaagacctctgaccaggtagcgctgcacctcgcctgccagacaggcgctcaacgcaatcagcccctcatgatactgttctaaaagttccatatcgacacgcggtttgtagtagtatccctccacaaatcctttcgacacgatcttcatgagattctgatacccctggttattctccgccagcagcaccagatgatagtagcggtcctccccatgggacatctcgcggtcaaatctggaattcggcgccacatagacctcgcagcccaaaacaggattgatccctgccgccttcgcttctttataaaaatcaatcacgccaaacattacaccgtgatccgtgatggctcccgctgtcatgccgagttctttgattcgttttacatattccttgattttattggaaccgtccagcagactgtactctgtatggacgtgtaaatgtgcaaatgacataataaatcctccgttttttcattatattatgaacaacggaattattcaaatcttttcacggatcattcccgtgctttccatagcagaaatagatagacagacacgtcccgaaattgtttggttgatgacagcggcagactcgccgcttaagaacgagacagactcgtctctacattccagacaggaactcttccacagttgttgagcgtgcagcaagtttcagccacttttccagtgtctcatcatcctgttcccctgcaatgcgctgctgctcttctgccggaatagttccaagctcggctgctaatgacaatatactctgtgctacttttgacgctgcaagtgactccgccatcggcttcgcaagcgtctctgccatcggcttcgcaagcgtctctgccatcggcttcgcaagcgtttccgccattgattccgctatcgaaggtgccatcagctttgccctccgctccgcttcctcacggatatactcttccatcgtcatatagcctgcctccaattttcgatcacgttttagatatttgactctctcatgaatattacggattttttcatccggatgcatctctgcaacttcctcagtgctctgctttaaatacgcaaacagatgcagtagttcaggtgttatgttctcccatatacaagtacctcctctgtgggaagtgcctgtctacaaaaattattataaatcattcttccgtcaaatgtctattaggcgaaatcacgaattgtaatgtctgcgttttcacacagatgcatttcttttttatttatgctataattcgttccgtgaattagcagaaaggatctgatccattatgggaaaaacaggactgattgttgagggcggcggcatgaaatgcgcttacagtgccggcattctcgacaggtttttagatgataaaatcacattcgactattgtatcggcgtctctgccggagctgccaacaccctctcctaccttgccggccagcgcggcagaaatctgcgcttctataccgtacaccttgacgatccgcgctatctttccgtccgcagcctgcttcggaccgggaatctcttcgggctcgaatatatctacggaacgctgaccaactcagacggtgccgacccgattgactacgatgccatcatgaaaaatccggctgaattttatatgccggcaacggatgccctcacaggaaaggcagcctatttttccaagttcgacatcgtgcgcgacgactaccgcaccatcatggcgacctgcgcgcttcctgcgttctgccgcccggtcaatgtgaacggacatttctactacgacggcggtgttgccgattctatcccggtacaccatgccttagaacacggctgcgacaaggttgtcatcatcctgtcaaatccgcgcgatttcgtgaagcagccggaggcacaccggccgatctacaagcgcatgctgcgcagatatcccaagaccatcgaagggatcgaccaccgccatatcaattatcaggcttcgattgatctttccaaccggctggaaaaagagggacgtgccttaatctttgcgccgagccgccatctgccgcttggcactttctccagggacgctgccctagagcagaagctttatgatcttggagtatctgattatgaagcaaaacgcgctgccctgcaggagtttttaaaggcgcagggtcactcataggttttctttaaaaatgcctctgccccctcctgtgttttttccatgaattcccctatatccgtccagcggagcagaagtgtatcttccgtatagccctgcttcttaaaataagtttgggcatactgttgatacgcctcctctgtcagcgggtttccgtccgcatccttacagacaatctgcgcctccccttcatcaccgctgttccccgccacatacagccatgacatggttgccagagtctccaccttaatctcatcctccaaaacagacatggcgtctgtcgcatagagatgctccgctggcgaaaccctcaaatcatcatacacaatataatattcctgcaaagtttctttcgtttctttccgatacacggtaagctcatccgcaatcaaatccggttgggaatccccctctacaaaagacgtcttcagttcctttaacgtgccattctcctccaccctgtaaaacctgctgtacgtatagattccggttcccccacagttcgatacaatcagctccagtctgccatcgtgatcaagatctgctatcgcaaactgatacatctcatctgcgtaatctggatcattcacccactgattccttgtccgcgcaatgacggcaagctgatcgtccgcatcctccacatcggaattttctgtctgctcttccgcctgtgcaatactttgtatcttctctgtctcatctgaggaatttaactgagcttccttcgtctctcgctccgtctctcccatcccgtctgcgtgcggtaaagccgtcccgcacccggcagttatcgcacagataagcattcctgctatcatgatcttcctgtttttcatcgctcctgtcccacttttgaaaaatacatcggtatctatccttttaaaatatgtagtatctgttttattttaatgacttcacaggcatttttcaatctttcgtttcactcaagaacaacgtgtgcgcttgccgcacacttgcgcgccctcgcggtatgcaaagcattatttacctcaccgcgaggtgcgcatcctcgcggagcgtttttgtgtaataggaacgaagttccctattacacaaaaaaaggggcggaggctttctgcctccgtccctcttctctgttcctgttttagatcaaccctcacgctttcactgctgccgtcagttcatttccggagacatcaatcagaatcgtatctccctccctgactttatccgcaagaatcagctttgcggaaagtgtctccacatgcttctgtaagaaccgctttaacggtcttgcaccgtagatcggatcatatccgttttccacgatatactgctttgccgcatcggtcagctccaccgtgatctcacggtctgccagacgtttgttgagatctgcaaccagaaggttgatgatgttaccgatgttgtccttcgtcagcggcttaaacataataatctcatccagacggttcaaaaactccggacggaaatgtccgcgcagttcgtccataactgccgcttcgcactccggattgatatccccgtttgcatcgatgccctcaagcagatgtgctgatccaaggttcgatgtcatgatgatgattgtattcttaaaatcgacggtacgtccctgtgaatctgtgattcgtccatcgtccagtacctgcaacagaacgttgaacacatccggatgtgccttctccacctcatcaaacaataccaccgaatacggctttctgcgcactgcctcggtcagctgtccaccctcatcgtatccgacatatcctggaggcgctccgatcagacgggagacggaatatttctccatatactcactcatatcaagacgcaccatattcgactcatcatcgaagagacttgctgcaagcgcctttgcaagctctgtcttaccaacaccggtcggtcctaagaacaggaatgatccgatcggcttactcgggtctttgatacctgctttggaacggatgattgcttccgtcactttcgtgacgccctcatcctggccgatgacacgtttgtgcagttcctcgtcgagatgcagcgtcttgttacgctcgctctccgtcagctttgccaccggaattcctgtccatctggagatgatccgcgcaatctcttcctcactgacgttttcatgcaccagggaaaggtcgcgtttcttcacggcttcctcctcgatctccaactgcttctgtagctgtggcagcttgccgtactgcaattcggctgccttctccagatcgtacttctgctgtgccatcttgatctcattcttgaccgcttcgatctcctcacgcagcttctgtactttttctaccgactttttctcattctcccactgcgctttcttcgtgttgaattcatcgcgcagctctgccagttctttctgcagatttgccagacgctcctggctcagacggtcggtctcctttttcagcgctgtctcctcaatctccatctgcatgacacggcggttcaactcgtccagttccgtcggcatggaatccagctcggtcttgatcagcgcgcacgcctcatcgaccagatcgatcgctttatccggaagaaaacgatccgaaatataacggttggagagcactgctgccgataccagcgcagaatctgtaatcttaactccatggaaaacctcgtagcgttccttcaatccacgcagaatggagatggtatcctcgaccgtcggctcatccaccattaccggctggaaacgacgctcgagcgccgcatctttttcaatgtattcgcggtactcatccagggtcgtcgcaccgatacaatgcagttcaccacgcgcaagcatcggctttaacagctgtccggcatccatcgcaccatccgtcttgcccgcacccacgatcgtgtgaagctcatcaatgaacaggataatctgtccctcggaacttttcacctcatcaagcactgcctttaaccgctcctcgaattcaccgcgatattttgcaccggcgatcagcgcacccatatccagtgcaaacaatttcttgtcctttaagccctccggcacatcgccttttacaattcgctgggcaagcccctcgacaacagccgtcttgccgacacccggctcaccgatcagcaccgggttgtttttcgtcttacgggacagaatccgcacgacattccggatctcatcatcacgtccgatgaccggatccagcttctggtctctcgcacgggctaccatatcatacccgtacttctccagcgtgtcgtaggttgcttccggattgtccgatgtcacgcgctgattgccgcggactgtcgagagcgcctgcaaaaaccgttctctggtaatgccgtactccttaaagatctccttcaatgccttattcggatacttgatcagcgccaggaacagatgctcgacagaaacatactcgtcccccatctgcttcgcctcatcctcggcatgaatgagcaccttatttaaatcctgtccgacatagacctgaccgccggacaccttgacacgcgctgccagatgccgctcggcgttatccatgaagtgctccttctgaatctccatcttctcaatcagcttcggaatcagtccatcctcctgccgcatgagtgcaaccagaagatgctcctgctcgatctcctgatttccatattcataggcaagcttctcgcaatcgttaatggcttccactgacttttgtgtaaatttctgaatgttcataagcgtacctctctttctcttcctatgatatacaggcggcacatatctatgcgccgcctgctttgttctccctgttacaattatgttatagcaccagttgttagcactgtcaagaggtgagtgctaattttttcagataattttaccgccagcagaagcagggacttcctgcctaatatggtctgctctccaacagctccgagagatccatctcacagtcaaaatatgtctcctccacatactggatcttctccacgctttcccccgcctccaggcggcggatcgtctcctccacaagcggggctgtcagcggattgcattcaaaatcagccgcgatgtccccggtctggattgccttgagggcatcccttaccgcatcaaaggacaggataataatgtccccgtcactgccaatcgtcctgcccgcctcccggatcgcctcgatagcgccaaaggtcatattgtcattctcgctgattacaacatcaatatcctcgtatttttcgagaaattccttcataacctcctgcccctttgcctgcgtgaaatcccccgactggcgctccagcatcacccagttttcattctgctggagaacctctgcgaatccgtctgtccgcccgatctgtgcagaggagcccagcgtcccctggagagatacgatatgaactgtctccccgctccgcccctgcttttccagataattctccagccagtgcccggcgttcctgccctcctccgcgaagtcactgcccacccagcatgtatacaggctgtcgtcctccatctccgccctgcggtcagacagaatcaccgggattccggcttccttcgcctcctccagaacggattcccagcctgtctccacgatcgggtcgagcacgatataatccacctcctgcaggatcagattgcggattgccttcacctggttctcctgcttctgctgtccgtcctcgaagatcagatagtagccgttttcctgcgtgaacacatccttaaaggactgtgtgttggtggttctccagtcggattccgagccgacctgcacatatccgaccacaatatagccgtcctgctgcatcgtctgctccgtatccagctgtcccgcagtctctctctgctccccactcccacagccggctgtaaagagcagctggctggcaagcagcgccgccgcgattccttttttccccacagtcctcttctgaaatatgttcatattcctcccgccttttctcctgccggctgcacctcctgcccggggtgcttttttaacgcagcacggtattttcccatagaggagccaaaaggctgccgcatgaagcggacagcccctggacagccttgtttttatttgctcttctctttgatctttgcaaagatactctgtaatacgatgaaaaagcagagcagcgcagccaccgcaatgttggaccacgagctgagcagcttgccgttcgtcttcaccagtgtggaaatcgttccgttgataagtacaccaaagaaggagccgatgacatttcccacaccgcctgtcaataatgtaccgccgataacggaggaagcaatggcatccatctcaagtccgagtgcctgctgcacatttcccgacatcgtgttcaggcagtagcagatgccgccgatcgagcagaggaatgaggaaagcacatacgccttcagcttcgtcttcttcacgtccagtcccatcatggtcgccgactgctcacttcctccgactgcgtaaaggcttctgccgaacttggtatagcggagcatgaaaaatacggctatcagcacgagcagcgccacgattaccgatacacggataaacggaacctgcaccacgcccttgttgttggtataggagccaaacggaaggctgatcttcgtattggcaagctttacaaaaaatgcattgctgctgatggagatctgttccgtgctgatcacggctgtcatgcctctggcgaagaacattcccgccattgtcacaatgaacggctggatattcagatagccgacacagaagccctgcaccacgccgaacacaatcccgatggcaagcacaagtatgcagagcagaaccgcattcatgttccagcgctccataccgacggcaagaatcatgcagtccatggcaaccagcgagccaacggaaatatcgatgccgccggtcagcatcacgcaggtcattccacaggtgatgcagagcaggcccgcattattgataaggatgttcaaaaacgtctgcagatgtgtgaagcccttattggaataaatcacacagcccacggcatacatcacaaaaaataacgcgatggtaattatcagaagaaccgtatttccatttaattttttcgctttcattatgcagcacctcctttggcaagctgtctccttacagacatttttttcataaatgccttaaacggaggtgcctggattgccacaataatgataacaatgaccgccttgtacaccggtgcctgctcggtcgagatgccgagcgcatacagggtggtggtgatcgcctggatggtgtacgcaccgataatagagcctgccagccggaactttccgccgccgaggctgttgccgccgagtgcaactgccagaatcgcatccagctcgaagttcagtccgatgttgttggaatccgcagagctgatccgggaggaagcaacaataccggcaattcctgcacacaatccgcagacaacatagcacaggaaaatgatgcgctcggaattgatgcccgcgatgcgggaagccttcttattgatgccgacgctctggatatataagcccagtgcggtcttgcggagcaccagcgatgtgatcaggatgcacacgatggcaaccacgatcggtgtcggcataaatccgagatagccgccgaagattttgaaggaatcatcccggacgtatacgatcatgttgttgcagagcagaagtccgattgccctcgccgccgaaaacaggatcagcgttgccaccatcggctgcacattcagatacgataccagaaaaccgttaaacgcaccgcaggcacatcccatcaggatgccgccaagcacaccgacgatcagcggcgctgcaaggctgttggtggaggacacgccgtagcctgccagaagcatgcagcagaacgatgccgccagtgacatgaccgagccgacggaaatatccgttcctgccgagcaggacacaaccagcgtcatgccgatggcaagaacggcaatctcactgccgcggtttaaaatatcaatgatgcgtccgtacaataccccgttgcggatggagatggtaaaaaagttaaatgcaaaatttcctgccatcacatcatagatgatatttaccgccatcaccagtatcatacagaaaatcggtaaaaacaacggctggctgaccagcttcttaaacttactcattcctgccacctcctgctatggactgcattacatgcccctgggtcagttcctcagtgatctctcccacttcctgaccatcccttaataccaccagcttggagcatgttctgagcatctcctcaatctcggaagagatgaagatcagactctttccctgatccgcaagctcgatcacaagcttctggatctcagtctttgtcccgacatcgatacctctggtcggctcatccagaataaggaattccggatctgtggcaagccagcgtgccagaatcaccttctgctggtttccgccggagagctgcccgatcagggtctccctgctcgccgtcttgatctgcagcagctcgatatacttgtctgcgatctcgttctgtctgctcattggaagcagcttaaacattccgcgctttgcctgcattgccagaattatattttctcgtacagataagtctgcgataatgccctctgcctttctgtcgtccggaagaagtcccattccaagattcatcgcatcaatcggcgcattgatctttgcctcttttccgttgacaaacagcttacctgtctggtttttatccgctccatagatgacacgcgccagctcactgcgtcccgagccaagcagacctgtcagtcccacgacctcacccttatgtatctgtaaatcaaacggcttgatctttcccttgtggctcatgccctgcgcatcgataaccaccggcacattggtgaaatccttcttctcttctgattttacagctgcaaggtcatcaaaatccttgcccatcatcgctgcgaccagctttacccttggcagctcctcaatcggatattctccgaccagtatgccgttccggagcactgtgatccggtcacagactgcgtatacctgctccagaaagtgtgtcacaaacacaatcgccacacccttttccttcagctgccgcataagaacgaacagcttttcaacctcatggtcatccagggaggatgtcggctcgtctaaaatcagtaccttacaatccatatccaccgctcttgcaatcgcaatcatctgctggagcgccagtgaatactcttccagatttttggttacgtcaatatcaagatccaggctcttaataatcctgttggattttgctgtcatcgtcttccagtcgatggttccaagctttgtcttcggctccctgccgataaataaattttctgccacactcaaattcgggcaaagattgacttcctgatacaccgtggatatgccctttttctgtgcatccagggtcgaatgattgaccaccggtccatcgatcccgtcaacgcgtatttctcccgcatcgaacgcgttgattccggtcagacacttgatcagtgtagatttcccggcaccattttctcccatcagtgccatgatctcgcccttccgcagtgtaagatccacattgtccagtgcctttacgcccggaaatgtcatggtaatcccccgcatggtcagtaccacattatgctccattttactccaccctttccttaaaattgggagagaccaacgggcctcccccattacaaattccctgtctgtgaagcagcttcttctctgtccctgctataatgtttgtcctgttgccagaccgtcttaatactgtgcgtcaacgatctcctgtgtaaccacggtaagctcctgctcctcgccgtttaccgtgatggatgaaaggatgtcctcatttacataccagtgctcaaccatgtatacttccttgtcaggtgtgctgccggactctaactgcttgataacatcctctacaaacggagctgcaagcgggttgcactcgaagtctgcattgatgtcgccggacattacatactcaagacctgcggtgcaggcatcgaaggaaatcaggatcacgtctccgtccacaccataggagatacctgctgccttcatggcatccatcgcaccaaatgcctcgttatcgttctggcataccactacattgaactgtccctcgtagctcttgatgtaagactccataacctcctgtccgccagcctgtgtgaaatcaccggtctgggaatccagaatgttccagccgtttgcatctgcgatctccttgaagccgtccgtacgtccgatctgtgcggaagcaccggttgttccctcgataacgagcacgttcacgtcgctgatgccctttgcatccgtgtaagcctttaaccactcacctgctgcaagaccctcattcttgaagttggagcctacccatgaaatatatttgtccgaatcatcaatcgtacggtcaatgacgataaccggaatacctgcctcctcgcactctgtcagtaccgtgtcccagcctgtcgatacgatcgggtcgatgatgatgtaatccacatcctgctcgatgaagccacgtactgcctccagctggactgccgaatcctggtcgcagtcaacgaactggagatcatatccgttctctgccgagaagatggactgtgcggaattcgtggatgcggtacgccagtcagactcatgaccaacctgtgcaaagccgattgtgattacatccccgtcagctgcgtctgccgcatctgctgcgtcagaagcatccgctgcttcgctgtccgctgccgtatctgcgtctgctgcatctgctgccgttgtgttgctgctgtcagcagcctcctcgcttccgcagcctgccagtaaggttgcgcccattgccatgcacatcagtacactcactaacttttttttcattttaaaaacctcccaaagtttttattagatttggttaagtccttaaccatgtacctattatagctttcggacggtttaaaaaataccgactggcttttgaaataagtataattttttactaaattatgaacagctcattcacaattttgccgtatttccctcaaaaggtgtaatttttttggaaatgttgcgttttcttttgattttctctgcccggcacggaatccgcacccagatctcggtgccctgcccgtaggtgctctgtatcttcagtccgtactccctgccataattgagctggatacgctggttgacattgaacagtccgaagccgcccgtctcctccggctccggctcctgctccccgtcgcggagcatggcgcacacctgcgcaagccgcgcaccgtccattccgattccgtcatcctgcaccttgaaaatcatgacatcctggcagagtgcaccggacacccggatatgtccgccgccgcgcttgttcttgatgccgtggtagagcgcattctccacaagcggctggagcgtcagcttgatgatctcatattcatagagctcctccggaatcgcaatctcatattccagtatgtccctgtagcggaactgctggatctctaagtagctgcggatgtgctgctcctcctcctttaccgtgatgaactcccgccccttgcttaaagttgtccgaaaaaagcttgacagggacgacaccattctcacgacctgctccgtgtccttcgactccgcgagccagatgatgttgtccagtgtattgtacagaaaatgcgggttgatctgctcctgcagcacgcgcagctccgccgcgcgcagattcagctcctccacgcgtatatcctccacgagatgcccgatctcctccaccatctggttaaagctgctgttcagaaccgagagctcatccagctcctcgtcctgcgcccggatcgcaaaatccccgcttcccgctgcctgcgcagcctcacacagccgctggataggctccgtgatgccccgcacaatcctcctgctgaccatccatgccccgagcagtatcaggacgagaatcactgtgatcgccgtgatggcactctccacatccgcgcggattcccatccgcagctcctccatgttcgttgtctcatagtagatataatactggatctgctcctgtatcagctccgtcaggacgcggatattcagatccagacgctccatgttcgtctcataaagcccggtcacgagcgcatccttctcgatctcctccacacgatcctccagcgtgtcaagactctttagtatgcttgacagccggttcgcagcgtactcggaatctgcctcctcatagagctcgccgaacacctcccgcgcggcctgtatcatccggtgcggctgctccgtgtccaccagctcctcggcacgctccgaattgactacgataatatacatcacgtagtccatgtcctccttgaaattgatgttgtaagcgtttgcctttgtgattctcctgacaatcccgtcatactcggaggaaatcttgttcgtcataatcagaagatacgccagaagtatggtcagcggcaccacacagatcagcagcagcatatagagcctgctctttagtgaaaaccctctcttcaatatctatctccccttttaccctctgctgcggtactcacccggtgtgcagccctgcgtcttcttgaacaggttgctgaaataatgcgcatcccggtagcccacctcaaaggcaatctccgttaccttctttcccgtcgtcctgagcagctccttcgctttttccatgcggattcttgtaagatattctacaaacgtctctcccatttcctgaccgaataccgtgctgaaatggctcggactcagatttacctccgctgcgaccatattcagggaaatcccgtccttctcaaaatgatcgttgatgtaggtctttgccttctgcatgatgccgtcgtattttccgtccaccgcctcactgcgcaaatccagcaccgccgaaaaaagcttcttaatatattccctggtctgctcaaccgtggtcaggtaggctaccatctccttcgcatcgccgcaccgctccacgagatccctgctcttgtaaccgctcttctccagaacggaaaccgccgtcacatacagatccatcaccacgtactggcgcaggaagatagactttacattgccgtccccgagctgtgcaaagtaatcctccacgaagccggatacctcctccctagtgcccgtgtacagaaaagcctctgcctgccgctggctcaggctggagatattcagctccccgagctttacatcctccagaacctccgccgcagtctcccccggcgtctcctcctcaaggatctggttgcgctctaccgaatagcgtctggaaaagcacaggttggtctgccggtagcactgctgcagctcgctgaaacgctccaccggtgtcccgagcgccgcgacatactccaccgccgtctctctccggaaatactctgccagcaggctttttacctgctctgtcgtctccgcgagagactgctgccctgtgcccttcagcacaaaatcgtactccgcccggctctgctttgcgacaatcagattgccggactgctccatgtacttctccagctcctgctcgaaggcttttatcttctccggcaggacatcctccttctcctcggagaacagctggagcagcatgatattgtactgctccgcaatcagctcaagtcccagttccttcgcctcctggaacaccgacgcataggtatgctttccggagaccatgtgccggaacagccgctgcctgccggcagatctcgcctcctccggcgcctgctgcttctgcttcccgcgctcctcctcgatcttctgaccgatcttcttgagtgtcccgatcagctgtgcacccgtgaccggcttcaccagataatccgtgattccgatgtcgattgcctcttttgcatactggaactcgtcatacccgctcaggagtatgatcttggtctccggcagctcgtgcttcacgagacggctcagctccagtccatccatgaacggcatcttaatgtccgtgatcagaatatccggtctcgtcttctggatgatcggataggcgagctccccgtcgcccgcgtcaccgacaaattcaaagccttccccctgccagtcgatgttgttctttatgccctcccgcataacgatctcatcttccgccaaaaaaacctttaacatatgaaattcccctcaatacattttcctgtaaaaaccattgtaaattcattttatcacacctgcgaacaaaaaacacagaagattttggctgtccgggatgcctatcaccggattctgctcgatgcagtcgataccctcgtgcagaaatgtccccccgcatacgcaggacttccggcgctcagggaacgcatctatttaggtatccagcttctggaaagctttgcgcacacccagctggcgacttccctctgcagtcagtttgatatggaatccatgcagacactctgcctccggattgcagtggagctgctgacaccgccgcatcagacgggatccgatacggcagtgtcatgttcacactaatcttatgaaaacgccctgcggtcttaagcttccgtgctccaatccgttcgcgaacaggcagtcctccggctccggcagtccccgctcccctgtccgcaccggttcctccccggcgttaatgcagacctccagcgttttttgtccttcttttttcttataataatgtaacaatctggaatcctctctgacatcccacatcacgttcccgctccttgtctgcggatactgcctgcgcatcgcaatcagctgctttacctgtccggtcagttccgcaaagctgcccgcatcgatctcctcccacggcatgcacttccggttcgcctttgttccgcctccgtccataccgatctcggtgccgtagtagatgcccggcgcgccctgcatggtgaacagaactgtaagctgtgccagaaacatatccgcattgccgtggcatctctccatcagacgatccgtatcatgggaatctaacagattaaacagcacgcggttcacctgctcgtagtacatgctgtagcactggttgatgccatgcataaaatccgtaccactctgtgtcttatctgcccagaagttattcacgcacgccagaaacggatagttcatcgtcgaatcatactcgtcgccgagcagccacgggaaagaatcgtgccagatctcgccgagcaggaaaagctttggattgcactttttcaattccagacgcagatgttttaaaaatgcatgtgaaatctcattgccgacatcaaaacggattccgtcaaccttccagtcacatacccagtgctttgcaatgccggtcagatactccatcacgtccggctcactggtatcaaatttgggcatattgtcgacaaacgcaaatgagaaataatccccctgctttgtcgcatgggtctgctcattgatcggccagcggttcacgcaaaaccagtggtagtagctggactgcggtcccttttccagcacatcctgccagagcgcgcactttgccccgcaatgattaaataccgcatcgatcatcacacgaagtcccagcgcatgcgcctccgcaatcaacgccttcagttcttcctccgtgccgatatccggctccacgctgtggtagtcgatcgtgtcgtaccggtggttggaatccgaccacagaatcgggtttaagtagatgcctccgacgccgaggtctgcaatataggcaaggcggctgcggattcccgccagatcacccccgtaaaactccttccaggttgcatcctcctgacaagcccattcccggcaggaatgacgcttttctcccggattttttctgcagaaacgatccgggaaaatctgataccacacgatattctccgcccagtccggcaccttcataatgtccgcccggttcatccacggatagataaaacgctggatcatccggtccgctggaaagcgctctgccgctttcacaaatccatcctcatacaggcagacgctctccccgccgccggtgatctcaaaatggtacttgactctgcggtacaccggtgtgaggacggcactatatacatttctgtgcgccagttcccgctccagttccatcggcacccgctcgccctgccagttctgctcgttctcggcaatcccggcggaatacgggtcgcccgcccagaggatcacctcgtccacatcttttcctgcctgaatacttatttttaaatgtctctcatcaagcggatagcagtctaaaaaatacgcccgatgtgtaatttctgccagattcatagttttcccccctgtacaaatttgctgcagatctcctgtcagctactccgggaactccggatttctattctacgcacagtatatctctgcgaggggaatttttctcacactatcaatcgcgtaacctgtacaaaacaatcattttttctttcacttctatcacagcatccggccggaaagcagttcgcttccctcttcgtaatccaggttctcatatgccgcatgcagttctgtcaacagttcccgttcctccgctgtcagatgggcacgcgcaaaccgggaaagtccctgctcaatcccgtttaaatcacacgcatcaaaagcttccctaagctgcgccagaatctgctgcttttcctccggtatgtcctctgccgtggctgcgccttccccctgtatctcctgcggcagattctttaattcatcctcgacactctctaacgtgtgccggatcgtctccaaaaactctgtcatatgcttttccatgtaccggatattttctgtctttgccgccatttccatgatttctgcgctctcgcttaacgcctgtctgccgatctgctggctggcacccttgattccgtgcactttcgttccgaaaagctccagctgctccggcacatagcccggcagttctgctgcaagcgagcccgtctcctgcaaaaacgtctgcaagagacggcggtatgccccatggttcatctgcgcgtgaagcaggaaatccctgcgctctgcgacaggcagataagtctcaatcactttctttagctctgacacatcgatcggcttgtccagatacgccgtaaattccggtctgcgattccgatgctttaactccgcggtaatatcagcagtcataagtaccattgggatatcgcaaaactggcggatctccttcgccgcttcatcgccatttttttccggcatcctctgatccagaaaaatcagctgatactccttccgcgctgccgcctccacagcctcctttccgttgcgcacaacatccagtgtaaaccgccacggcgctgcgagttcctggaaaatctcctgattgatccgcatatcatccgcgagcagaacatgtgcccccggatagatccatgtcggctggatccgctccgtatagaccactgactcgcgcagcagactgtccgtcgtatagcacaccgcatcatgcagggtgcttccgcacaccttctgccggatttccacggtaatcgtggttcccctggtgccgttgctctcggcgcggacactgcctcccatacggtttgcaagttcctttacaatgctaagtcccagtccgtttcccgactgtccgctctctgccgcatagctcacatacgaatcaaatccctgccgcagctgttcgcttgtcattccggtgccggtgtccgacaccctgcagcggaccatcacatccgaggaatcccggattgcctcacaggtaatcacacagcggatctcgccctcctctgtgaacttgaccgcatttgcgagcagattctgcaaaatttcccggacgcgcatggcatccccatacattttctccgggaattctccctgtatacaggcctcaaaccacaccctcttcgactgcagattgatgacacacatgtgtgccacctcctcgagcacctgatccagccggtagcactccgccatcagctcgaactttcctgcctcaattctggaatagtcaagaatcgcattcacctgttccacaaggctgttcccagctcccttgatgtgaagcaggagtgcacggtcacttgccgtgagttccttgcggctacttaaaatatccgtgattccgatgatggcgtgcagcgggcttttcaggtcatggctcatctgcgcgaggaaatcacttttccgcgccgtctgcatctctgcttttccctttaatgcctgcatcagctgcgtctcttttttcgggctggtaatatcccaggcaccgagaatatatccacgaagcctccctgaatagtacaccggcgtacactgacactgataatactgtccgttcttctcgatctcccggctcttttttccctcctgtatggacttcgccagctcctccgcctcctgcatgtatccgcggtgcctgcggctgtctctctcatacaactgcatcggacccgcaaacagacttctgccgctgcggttcgcatcaacgcaataaaaattggtatccagcagtaccactgccgtatccgagtcatcgtacagccgctcgcgcagaagctcgcccgtatccatcagctgatccgtctggatcagataatgaaccgcaccgcagacaccggttgtagctgccagcatcagaagattgcccggaatagtaaaaaacttttccgcgcccatcgctgctgcattcacgagcagcacaatatagagcagattggcaatctgatgctcatgcatggtcagggaacggcgcagataggcgtaggtccccattgcaacgatcgccgctgtacatccgattaagtaaattctgaaataaatgtgatagatttccggctgccggtagcgcataaaaacaatcacattcagcgcgagcagcacacaaaacataatccactgcaccccgtaggggatatggattttcagaaaatccatgatatagataagaatcagataaagcacctgaattaagagcatgtccttcaaacgcccgaacagttctgtctgtccggtgagcgtaaggacaacctgatagaaattatatacaccgatcagtccgaccagcagcggcagcagcctgtgctgtctggaatatgcaccggaagtggcatattcctgcagtacatacagcgtataacaaagacatattatctgaaccaataatatcattcaatctcactccgccccatcagaatcctcttgatctctgtcttgacaaagaccggcttgtacggtcttacaatgtaacctgccgcgtccagattccggcacagcgtgaccgtctgtctgtcgcagagcgccgtgacgaacaggatcggcaccgtgtgatccgtcatctccataatgcgtttggccgtctcgataccgtccatctccggcatatcgatatccatcagcaccagatccggcgccggatgttttttcagatacagcaatgcctggtaaccggatttcatcaggatgacatcatataccggctctaaaatgccacgcagcatctgcagattcgtcttcatatcgtccacaaccatgatccggcagcgtaccggcggccgtatcatctcgttgcgctccttttctgcctcttccgtggagaagccggattccgtcttcatacgcaatgtaatatggtagttcgcttcgttggacagatccaacagttccccgtccatcagacgcactacgggtcttaaattatgtacgccaaaattctcatagatgatggcttctcttccatcggaaagcgtaaccatcgttcccttcgggtagagcggcacatactttagaagtgtctccactacctcgcggtcaaacatgatgccacagccgcccatcagatactctgtcgcctcgtacggtgcgtatggctccttgtacgggcgcctggacgtaagtgcatcatagacatccgccacgtgcagaatcctggtaaacatcgtctgctgcgcgccttccagcccgtccgggtatccgcttccgtccacattttcatggtgatgcagcacggcctccttgatatgcgcagaaatatcccaccgctcactgataatctggtacgacagtgttgcgtgggatttcataatgagatattcttcctgtgtcagacgtcccggcttgtttaagatctcatccgggatctgcagctttccgaggtcatgaagcaatgccgcagtcacaagatgccccagctccacttcactcatccccatacccattccaatgacgccgcagtataccgccacgttcacagaatgtgcgtaagtgtaatcgtcgtagcttcttaagtccgtaagatcaagagacacatttccgcaggataaaatctcctccaccatgcgtctggcaatcagcttacatccgtcaatgtcgcaggcacggatgcgctcctgtccctcctgccttaactgcggcgtaatcacactctcaatcgtgatgccctctgaaagtttatcttctatatatacaccgtcgaatccgtaagcttccagtttttccagatagctctccgtcaattcgcaatggcagccaatcagcgttcttccgacggaatcataaaggtcggctgcaagaaccatgcccggttctgcctccttgagtggtacataacgcataacattcctcctacctttcactgtaccaagccgacctcataaagtcaatgaaacttttgaccttattttctagaattcgacagaaaccacctcgtaatcctgatcctcaaccgccttctttaagacctcatccgccacgtcgctgctaagcgtcacaaccgcgtttcctgcctcgtggctgactacagcctcctgcacgccttctaccgcttcgagtgccttcttgactctcgcctcacagtgtccacacatcataccgttaatcttcattgtctttttcattgtctcattctcctttttttgatttgtttctgatttcttctccaaagcgtcatccggctccttcgccgcagctgcggcggtctgccctgtcaccgcatttttgatcctgcggtcttttccggcgtcatacatccggaacagattcaggcgcagcgcgttggtcacaacacagaagctggataagctcatggctgccgcaccgaacatcgggtttaactgccagccggacagcggaatccacacgcctgccgcaagaggaatgccgataatattgtagaaaaatgcccagaacagattttcatgaatattgcgcagggttgcgcggctcaagcggattgccgcaggcacatccgacaggcggctcttcatcagcacgacatccgcggcatcaatggcaatatccgttccggcgccgatcgccattccgatatccgcccttgtaagcgccggcgcatcattgattccatcgccgaccatgaccactttgccctttttctgcagttctcttaccacctgctccttgccgtccggaagcacgccggcgatcacctcgtccacgcctgcctcttttccgatcgcctgcgccgtccgctcattgtcgccggtcagcatcaccacatagattcccatgttctgcagttctgccaccgcacgcgggctgtcctccttgatgacatccgccacggcgattacgccgagcagcttctcatcctttgcaaaaaacagcggcgtcttgccctgcatggcgagctgctctgcctgccgcttcatggcatcggacaccttcacgtgctgctcgataaagatgagattgccgccgtaaagccgtcttccatcccgcacaccggtcagaccattgcccggaagcgccatgaaatcggtcagcatatcttctaggccgtccgctccgccagatgctccgtctgccgcagacgccctcttcccgccggactgctcctttgccccggactgctccttcacataggcaagaaccgcttttgcaagcggatgctcactcttctgctccagaatccctgccgcatgcagcagctcctccgccggaacgccttccgccggaaggacatccgtaacccgcggctctccgctcgtgatggttccggtcttatcgagcgctacaatctgcatttttccggtctcctccagagagactgccgtcttgaacataataccgttcttagcacccatgccgtttccgaccatgatggctaccggagtggcaagtccgagcgcacacgggcagctgatgaccagaacagagatcgctctcgccagcgcaaagccgaccggctttccggcaagcagccacacaatcagtgtcacgatcgcaattccaatgaccgtcggtacaaatacgccggagactttgtcggcaatcttggcaatcggcgccttggtcgccgcggcatcgctgaccatctggatgatctgggataaggttgtatcctcgccgactctcatcgcctcgcattttaaaaagccggactggttcacggtcgccgcggagacttcatctcctggcgccttgtccaccggtatgctctcgccggtcagcgccgcctcattcacggcactgctgccctcgaggatgataccgtccacgggtatgttctcccccgggcgcaccacgaagacgtctccctttttgacctgcgcgaccggaacctcctgttccacaccgtcacgcacgatggtggcagtcttcggtgccaggctcatcaggctcttgagcgcatcggtcgtcttgccttttgaacgcgcctccagcatttttccgaccgtgatcagcgtcaaaatcatcgccgccgattcaaagtagaactcgtgcatgtagctcatgaccccgtccatatcgccgcgcacctgtgcatcggtcattgcaaagagcgcgtaggtactgtagccgaacgctgccgttgcccccagcgctaccagtgtgtccatattcggcgcccggtgccagagactcttgaatccgctgataaagaacttctggttgatgaccatgatcaccaccgtcagcaagagctgtaccagccccatcgccacatggtttccttcaaagaacgccggcagcggccatccccacatcatatgtcccatggaaaaatacatcagcactgccagaaagcctaccgaagtcaccagtctcttttttaaaagaggcgtctcccggtcctttaacatctcttcctgcggcatcgcctccgccgctcccgcggtttccgcgccgccccgcttcttctcggcagcgccgtatccggcgttctcaaccgcccggatgatctcctgcggcgccgcggttccctcgacacccatggaattcgtcagaagactcaccgagcaggatgtcacacccggcaccttcgacactgctttttccacgcgcgcgctgcacgccgcacagctcattcccgtcactgtatattgcttcatcttcctccctctcccatctatttcatcaatttctggagcaccgtcaccagttcgtcgacagtctcctccctgccctcgcggatatcattcgtcacgcaggtcttgatatggttggcgagaagcaccttgttaaaactgttgagcgccgcattcacagccgccacctgcaccagaatatccgtacagtaggcatcccgctccaccattcccttaattccgcgaatctgtccctcgatgcggttcaagcggtgaatcatatccttatattctttctctgaccgttcctttgtcttatgggaacagcagcattccttttcctctgccatacgcttagccctctttcttactgtttacccgcaagtctgtttctattcctcatttgcaggctcattatataccccctatgggtatattgcaagtgttttattgtattatttttttcattttacagaacaaagtttcctattgcacacaaaaaaagatcccggcctgtccaaccggaccagccaggatctttttggaaactgccgtcatgcgtcagtctcttttatttatccgcaaaccttctccagaatctctgtaagtgcacttccactgctggtatggcttctcaccacatccgcattgcagcgctccgcctctgccaccgcacaccgtaccatcttatgtgatacggtgttggtgaagagaatgatcagatccggtgatccgatctggttcccgagctttgccggcatctgtgtaaataccttcgctttacagttatgttccttacagatctttttatactggcagaccatgcggtcatgtccgcctacaatcacaacactcatgactacaccgccgcaagctgcctgccgagatcggtgcaggcagccacagcctcatcgtccggtgcctccttacagatcacgccttcgccgttcaatacattcgcgcctgcggatgacatgcggtctacccagtcacgcatccactgtccgtctccccagccataggaaccgaacagaccgatggtcttgcctgccgcaaatccttccacctcggttacgaaaggctccatctcgccctcctcaagaacctcagcccccattgccgggcatccgagtgcaaatgcctttgcgttctttaattcatctgtagagacgctgcttacgtccaccactgcggcttccttacctgctgctgtgattccggcgccgactgcctctgccatcgcctgtgtatttcctgactgtgaccagtatactacataaatcttatccaatgcttttccctcctgctgtatttctgtattttactatgtaggttagccttaactaactttagctatactatactaaatcagaaggatttcgtcaagtgcagtaaatgaaatatttttctcattagaaaaactgctattccacctcatccgcgaacttcgtcaggtagcgctggttctcctcaaattcgcaggtactcgcattgtcaagcaccttgcgcccgtacaaaacgcgctttttttccacagggagcgacagtgtcgccgtgccgttctccgtctcgtaggagacttcgtcaatccccgtctcaccaagtgcccgatatgcgccatacagcgtgtgatccctgtatccgttcaccatctcccagtagagagcatacttttcactggttagtcggtacaaatccaatgtatcatataattcatgatacccgcgatctatgtactccctttcgcaccagtccagatgataggcatcgccggaatattttccctcatccacagcggtatcaatcaaagcccacaatatcgagaacacgaaaaacagcgcaatcacacatccggctgccttgactgccagcgttgacatatttacctcgtagtttccagtctcatccgaaaatttccagagtatttttatatttttaatcttcctcataatcccagccttttctctcaaagatccggcgtatcagttcgtccatctcctccgagtcgcgctccatccccatcagatccgccagttcctcctccgtcatttccagagtaccaagcagcgccgctgacacgtcctgtttcatgtcatcataatattctttgttttcttcatactccagcccgcggtaggaaaaatccgtctccatttcaagaatatccttcccgtccagaagcacatatttcacccagtttggatgcatctgctgcccggcgggccagtctaacacctcctggatgcggaacagatctctcataaatgcctgatcgtcgtcatacagccggacgcgctccgtatatttttcaaattcctcctgcccatacacctcataggaatgcagataatcgtaaagtccggtataatcctctgccgcaagcagttcttccgcctcctgtacagacgcccgattccgctggcaggtaatgtgaatgtcctccagaccaactccaatcgcgagcaccaaaatcgtaatcgctgtcactgccacaacaaccagcagaattacattcatcactttatccgccacatacagcggcatggaatggatgatctttgctttggcgagcagtgcctcctttctcgccagattttcctcgtttctccacttttctccaagcgggtttggctccccgcagtagggacatttcagttctttcgccggataatcatatccgcattttttacatatcatcttcgcacacgccctctcttttattcggccagatgggcaaatgccctcttctgcatctcctgctccagattgctctgattcgcttcatctgcaagatcatatcctgtcatcacttcccggatctcttcctttgtcagcgcataatgctcctctaaataagtataacaatattcccggtaataagtgaccgcttccttctcttcgtacttgtaatcagcatcttcactctcctgacagatgcaaagagcatctgtgatatacttcacatcatccagctcttccgctcttccctcccggataagctgttccagatactgcccgtccggggttatgatgtaatttgcggtatagtcttcgagcttctccaccagccggtatttgcgaaaagcctgatcatatagttcattatgcttttccagatatgtgcagattccactgtagtcctgctgctgatacatcttctccagtttttcctgcattgcctgctccctgctgccggaagcagccgcgcgaatgcgtatgccaataaacgccgcagcactgagcaaaagtcctgccacgatcgcaacgatcaaaatcttcgcggtcagggacatcccggtcttcgccatccgctgcggcttctcctcccactgccgtttctcgcgtttcagctcattgacggcatcctcatgcatctgtacggaccttccaaaattatcgccaccgcaatatggacagcgcggctcgtcatcttcgtaagacgcaccgcagttattacatacgatcatcgtttctccctccggtgcctccgcagaaatccgctccctgaggcaccctgtgttattctttgtctattatatcagttttttgctgtataggaagcattttcctatgagccgaaaaagcggggcagtcgcttgaagcgggcagccccttttgagcgagaagtaataggaaacgaagcacatcctaccgatttctgatggaatacatctggaaattcggttcaaaaaatgtgtgcatttctaaccagccgaatgtttgcatcttcgatgatccgtgtctttccaagtttggagcactccgcgggtgtgtccgcaacccacagacaatgagcggattcccgtgtgtcccttgcggcaccagacaacaggtggcataaatgccacctttatgtcgaacagaacataaccacgcgaagccgatgtttgagccatcatctgccatgacttcaatagcagatgacggcgagtttcggttcgcgcggttttatattgtctgtgaagcagtgctgctagggacactagggaatccgctcattgtctgcggtttgtcggacacattccgtggattgtcaaaacgtggaagaaacacggaatccgatgcaaaaatccgacaagaagaaatgcacacatttttttcaacgaatgttccatctgcatttccatcagaaatcgaagagtatgatcttttgccatattccttatcgcatcaaaaaggggcagtctgcttcaagcgacagtccctctttttcgttcataggttctataatttttatttctactccgtctttaatgcgcgcatggaatttaagatcgcaatgacagatactccgacatctgcaaacactgcttcccacatgttcgccacaccaaatgcaccgagaaccagcacgatcgctttgaccgccagtgcaaagacgatgttctgctttacaatgccgagtgtctttctggaaatccgcacgatcgacgcaatcttccggatatcgtcgtccatcagaaccacatctgccgcctcaatcgccgcgtcagatcccatgcttcccatcgcaataccgatgtccgctctggtgagcaccggcgcatcgttgataccgtcaccgacgaatgccagcttttctttctcgttctcttcttttaacaggcgctccacctgtgacactttatcctgcggaagcagttctgcatgcacctcgtcgatgccgagttccgcagcgattccctctgccgcttcttttctgtcgccggtcagcatgacacatttcttcacacccactttcttcatggaggcaatcgcctcttttgctccgtcctttaccgtatcggcaatcacaatgcttccgaggaattttccttctcttgccacatagacaacggttccgatgttcttgcacggctcatagaaaattgctttttccttcatcagcttctcattgccgatgagcacatttcttccgtcgattctgacactgattccgtgtccagccacttcctcggcatctgtgatacggttcatgtcaagttcttttccataggcttcccggatggatgccgcaatcgggtgattcgagtatccctcgccgagcgccgcaatctctaaaagttcctctttgcttccctcggtcggcagaatctcggaaaccttgaattcgccctttgtcagcgtacccgtcttgtcaaagacaatcgttgtcatttcagctacagcttcgagataattgcttccctttacaagtacgcccaccttcgacgctgcaccgattccgccaaagaatcccagcggcacagagatcacaagtgcgcacgggcaggagataacaaggaaaatgcaggctctctgaatccagtcgctccatcctccgccgagaatgagcggcggcagaattgccagaatcaccgcaccgatcgtgacaaccggtgtatagtattttgcaaaacgcgtgataaagttttccacgcgtgcctttttgctgctcgcgttttccacaagttccagaatctttgcaacggtggagtcatcgaactccttggtcgtctgtactttcagcgtaccgcttccgttgacacagccgctgatgatctcatctccggctgccgccttgcgcggaaccgattctccggtcagcgccgctgtatcaatgaaggactccccttccagcacaatgccgtccagcggaatacgctcgcccggttttaccacgatcatgctgccgacctccacatcatccgggtcgacctgcgtcagttttccgtccacctcaatgttggcatactccggacagatgtccatcatcgctgagatcgactgtctggacttgccgaccgcatatccctggaacagctcacccacctggtaaaacagcataacggcaaccgcttccgagtattccttcacgccaaacgcgccaaacgtcgccaccatcatcaggaagttttcatcaaacacctgtccgtggctgatattccgcaccgctttatatacaatgtcatatccgatgaccaggtaaggcaccagatagatgacaaataatatccatgtattgattccttccaatgcccccgtatgctccgccaccatcagggctgcgaacaggacaaaggatatgatgatccgaaccagcatccgtttctgtttcttcgtcataccacacacctcgcttttgattttcataaacatataaacatttgtttatatgtattcctttttctaagcctgcgcgccttccggcacacaggctttcatagaattgtctttcgttctctgtcaggcacacgcccgtgttattacattaagatcttgcagtccggctctacttttgcgcagacggaaacgacttctttcatgatgtcgtcgaacttgtcatcctctgcatctaccgtcatcttctgtgtcatgaagctgacatttgcatcattgacgcccggaatctttttgattgcctcttccatttttgctgcgcagtttgcacaatccagatcctctaatttgaattttttcttcatcgtcttatccttcctttctttttctttcttattcctaatatgttttcctgttgtacatatcctgttctttgcatcacataccgcccgctactcctcgatatgctctctgccctgggcgatgatcgtcctcacatgcccgtccgccagtgaataaaacacggactttccttctcttctgctgcgcaccagcttcgcctgctttaaaatcttaagctgatgtgagatggccggctgcgtcatgtgcagtgcttctgccaaatcgcacacacacacctccgcttcaaacagcacgaacagaattcttattcttgtagaatccccaaaaaccttgaacagttccgccagatcatataattcctcttcctccggcatctgatcgctcacaatcttcagacgatcctgatgaatctccacactctcgcaacattccagttctgcttcagacaacttctcaccctctttccttcaaacatatgaacaactgtttatatgtttataatatgctctgccatacactttgtcaagcatcatttttacaacttctggaaaaagatcaaataaaagaaggctgtcggcaaacgacctcgattcgtctgccagacagcctccttagcaatgtgtatgctttgtatgtggttggctagttagttttatctaactgcatttactatagcacaatccgtcttctatagcaatactgcttattgaaaactattctcatttgctaattcttcttagcttctgccttcgccagaaaacgctcattgtcgatgataaatctctcgtgcgttccctcgccgatcactccggctgcatcgtatgcctttacctcaaatacaagccgctttctgtccacctcaaccagctttgtctcgcaggtcacctccatgccgaccggtgtggctgccacatgttttacattcatcagcgtaccgaccgttcctgctccctcttccagttcatccgccacacttttgtatgccgtattctccatcagggcaatcattgccggtgtcgcaaataccggaagcgtaccgcttcccatcgcctgcgctgtcttttcttctgttactgtaatggtctgtgttcctgtaattcctgcttccatttgtagattcatcctttcttctgcttttgctataaaattctgttttctactatatttatatcatattatcacattatgatctatcatgcccatttttctttcgcgaacggttaaagtatgcgaaagcaaaattgatgtcttttcccatataacaaaaagtcccggcgtacatcctaactaatgtgctccggaacttcctgttactattttgtactattcatatgacttcgccatgatacttctcacatgatgtccattcagatagccacatgccagaagtcctgactggatgatctgattccacttgctgctggagagctccacaatcgtgttgtcgtcaaattcgatcgtacatgcattttccatctcgcagccctgatcgcaggtaatgcggtacatattctttctgctgatggctccgatctcctctagcgtattcaccatgcggtagacggtcgccgtaccgatcttgtcatccaatctggatgccttgtagtagatttccttacagcaggagcaatcctcctccagtataatatccagaagcatcaggcgctgtttggtaatgcggcagccgcgctcttttaacttctgtatgatattttccttctgcatctgggttctcagatatcttctgtcctgttccacttaagaacaatgtcctccgcagtttttacaatcgccgccgcactgcagggattttccgttctttttgtcatgaatcatgctgcgcacgatcaggcacacaacgattaccaaaattgctcctacaacaaatgttcccatatcgatcccccgctttctgccgaattactttgcctttacagcactctttacgtttacgttcaaagtctcgctctccttgtacggacggaacagcagataaatgaatccgatcacacaaaggaatgctacgactgtaccgaatccaaaatgtccggttgtgatcagtgtaccgatctgatagatgcacatggaaacaatgtaagccagaccacactgatatccgattgcaaaccagaaccactttgtattgttcatctctctcttgattgctcccatagctgcgaagcacggtgcgcataagaggttaaataccagatagccgtatgctgcgattggtgtcataacgcttgccaggttgccccagaactctgcaccatcttctgctacttctgcgaaaccgaacagcataccgaatgttgcaacgacgttctcttttgcgatcagaccgctgactgctgcaactgccatcttccagccgttgccgccctgtgtccatccaagcggtgtgaagatccatgcgattgcggaaccgatctttgcaagaacacactcagcctgtgctgcctcaagtgccgcaccttccagatcgccgaaatcaagcattccgaaggatccgtctgcccatccgaagttcattaagaaccacaggatgatggtagataatgtgatgatggtacctgccttcttgatgaaggaccatccacgctcccacatgctgcggagaacgttgccgacggttggccagtggtatgccggaagctccataacgaacggtgccggatcaccagcgaacatctttgtcttctttaagataataccggagcatacgattgctgcaactcctacaaaatatgcgctccatgcaacccatcctgcattgtcaaagaatgcacctgcgatcaatgcgatgatcggaagctttgcaccacacggaataaaggtggttgtcataactgtcattttacggtcacggtcattctcaatcgttctggaagccatgacacccggcacaccacatccgctgccgattaacatcgggatgaaagatttaccggagagaccgaacttgcggaagatacggtccatgataaatgcaacacgtgccatatatccacaggactctaagaatgccaggaataagaaaagcacaagcatctgcggtacgaagccaagtacggcgccgacaccggagataataccgtctacgataagacctgtcagccatgctgcacaacctgcattctcaagcagtgactgtgcgcccggaataatccactcgccgaacagggtatcgttggtccagtcggtcaggatggctccgactgtagtaacagatacatagtaaactaagaacatgactacggcgaagatcgggattgcagcccagcgattggttactacacggtcgatcttatccgatgtggacagcttctggctgttcttcggctttgtcacgcactcgccgatgatggaagaaatatatacataacgctcattggtaatgatactctcggtatcatcatcaaatgcatcctccagcttcttgatctcgtaagacacatccggaatgctcttcatctgctcgccgatcttgtcatcgcgctctaagagcttgatagcaaagaatctcttctgcgcctcatctacacttgatccaagctttgcttccacttcatggatcacatcttcaacctctttcgagaattcatgtaccggagttaccacacccttctgctgtgcaagtgccactgccttttctgcggccttcgtgatgccggttcccttcaatgcggagatctcaacaacctcacatccaagcttctggctgagcttgtcgatatgtaccttctcaccggtcttctctaagatatcaaccatgttgacagccatgataaccggaataccaagctccatgatctgtgtggagaggtaaaggttacgctcgatgttcgtgccatccacgatattgatgatcgcatccgggcgctcaccgatcaggtaatttcttgctaccacttcctccagtgtatacggagataaggaatagatacccggtaagtccatgatggtgacatccttatgtcccttcagcttaccttccttcttctcgactgtaacacccggccagttacctacgaactggttggaacccgtaagcgcgttaaacagtgttgtcttaccgcagttcgggttacctgctaatgcaattttaactgccattttctgctcctcttttcccgcagcgatttgtctgcgttatctttcttttatcattttctccgattttgattagtctgtgctaacctatcatcaaaaaaaattactcgacttcgatcatttccgcatcagccttacgcagggacaactcatatcctctgaccgtgacctctaccggatctccaagcggtgcaacctttcttacatagatatccacacccttggtgatacccatatccatgatacgtctcttgaccggaccctctcctgtcagcttcttcaccttgacagtctgcccgcaggcaacttcctttaatgtcttcatactctgctccttctctgtatagttcatcatagcattgcctatgtctataccataatcttgttcgccatatcttttccaatggcaactctggaatccttgacattgacgatcatgttgccgcctgtctgggaaatgactgtcaccgtaccaccggtcacgaacccgagattctccaaaaactttctggtttcttccttaccgccgacttttttgatgatattcggctctccctcttttaccatagataacggcatcatttcatcctcttccctcgttcttgttgttgataatcattttcacttctattgcactggttagtataatctaacgtcagttagttgtcaataacattattgaaaaattttatcaataattatggtattggaaatatttgttagatcttacattttttattcttttgaaagcgggactgtatatcattttactatatttatctttattacgaatacgaaaaaaacgcttaggctgtgaatcctaagcgtttttttcgtattcgtaaattattttaaatctcacttccatttgtttcaatcacatgcttataccaatagaagctatccttcttgtaacgattataagtaccttttccatagtcgtccgcatctacatatacaaatccatatcgttttgtcatctcagaagttgtggaacttacgagatcaatccatccccaataagtaacaccaaatacatccacaccatcctttatggcttcttttatctgctttaaatgcgcctctacaaattcgatacgtccctgatcgtgaatctgatgattgctgtccatactttcatacataccgatcccaaactcagctataaatattggaagtccatagcgtgtataaagctgatttaatgcaattctcaatccaaccggatcaatggaccagccccagtctgtcatcttcagataaggattattccggctctgatcaggaagcagccccgtaaacttcataggttcgccctgatactcagaaatattggacatataataactgaatgacaggaaatccgcttttcctttcttcaatgtttcaatatcttccggcgagtagtttctttttatgtttttctgctcgaaataccggtccagataatacggaaccacacccttgcattgaatatcatagaaataatagttgaggttcatatcaaatatctgctgcagagtatcttccggtctcacagttttcggatagtacacatgcttccataccatatttcccgcaagagcttcaggcgcaatctcatgtacaagaatcactgctttcgcactggccagaagcatattatgtacaacctcaaacgtaagctgttcttcgtctaatccctttaacgaatgatcacgcatagctcccgagcaggtagaaagactctgaagactcatattgatttcattaaacgtcaaccagtattttacttttttatgatatctttctacgatagtccggacatatttttcaaacaatgtaatcgtttctcttgactcaaagccattcagcttttcgcagactggcagtgggaaatcgtaatgtaacatagtgaccaacggctcaataccatatttgtgacactcatcaaaaaccttgtcatagaatgccagtccctcttcgttaggtttttcttcaaatcccgtcgggaaaatccgtgaccacgatatggacatacgaaacactgaaaatcccatttccgccatcaatgcaatatcttctttataatgatggtaaaaatcatttccccatcttttcgggaatatataggtatcttcatgcgcttttgcctcttgcagggatgcgtaagtctgctcgaaggtagcctcatccgcccgccgctcatttggtgctacatatttcaggaaatcggtatttgcaagccctctgccgccttcattataggcgccctcgatctgattggctgccgtcgctcctccccaaaggaaaccctttttgaaacttttctctcccatgttacttttccccctttttcatatttttcaggcactgatacagaatagaaatcatatactgttcgctttcaaccgtcatcagtgtatcctgcgcatgggaaaataacaccgtcataggaacgctgtctccctccgcttcattctggaggacagaggtctgcgccttatgcgcctctaccaattccgcagaagctttctttagaagctcctccactccgtccaaatccagagccgataatttggttcctgctttcctaatataatcccgggcatctcccgcatgcataatgacattcatcgctacctgaactaatttttcgctatccatttttctcctcttttcttaaagtatttacttcctgttcactctccagttcctgtttttcatacaccttgaaaaacggaagatatatcaaataagtcagtacaaataataccgcccaaagaataataccacggaaatcgttgtttaccataaaggtggaaataggctgtggcaggaagttcatcatcatggcaactgccggaatagacaccagtcccagtttaaatacaatataggtaatcgtaggaacaacaaaggatactgtcatatatccaagcatcataaccggatttaaaacaaccggcagaccatacataaccggctcgttgatattaaaaatagaagaagcaatcgccgcttttccaatggtactgattttctttgacctggaacggatcatcaaaatgttcagtggaagtgtacatcccaatcctcccagacaacaccagcccatgaaaaccaattcatcggtagcaatatagatcggagcctggcctgctgccacagcagccgcatttgctgcaatattagtcagatacaacgcacatacgatgggccaaaccgtccacgccgagagtccacagcaataacacaatgccataatcatatagaaaagcaggaatcccagataagtatttccgattgccgcaagcggactgaacactttttccaacagtgaaaataaatccacgttctgtccaatgatgatacatactaaaatcaaaacaaaaatgatcaggatagactcaaaccatacaaccactaccgacggaagagaactgtccttcttaaacagaccatgtttaaagtaagcagaaaacagccagccaatcaccagccccatgaccattgctactgtcatgcctcccgtcccaacatagccggagtttattacgagatttccatccacatactgaggatttgccagtgcaatcaatgcagatacagacgcaaatcccgttatcattttttgcttctggagcttcttgctttccataatcgtgtaaggaatcaaaaacgccataaaaatggaaatcagcccaaaggaaaaagaattgatcaggctcagatccggaagccatggagcaaagttccgaaacgtattaaccagacttgccaatgaaccaaccataatcataggcagaattatcgtaaaacacacctgaagcgcatgcatatacgggttctgcataaacttctgcattttctgtgaaaatgggcctgccagccaatcctgtaatttcatataaaatttcatctgtactcctccttctcaaatcagatttttcgcaagctcgaaacattttgttccatccagtgtggcaaatgcataattgtcaatgatcgcatattttttcccatgttcctcacaggtttcacgaatcatctcctcattacatttcatctgaggcgctgccagtaccacatcaaagtcatcaatgacctccggcagttctgtataactgtaggcttccgtgtctacatcatacccctgggcttttcctgcttttcctgtccgcgatgcaatcattccgctggatacaccgtttccacaaataaataaaatcctcattacattatccccttcctctgttatatttttgataaattcattatccattattttcaaacttatatctatcctccgagcttcctacccactaggaaaggaatggattgatatagataatctcttatattataataaataaaattaaatttataaaatacaaaaagctgctggtttttaatatattggcacctttcacagaaaggcagattataataatgaataaccttcaaaagctgcttacagttttaaaacaatcagatacaccgctttcgtcacggcaattgagttctttgctttctgtttccgaccgttccgtccgtaactatatcaaggaactcagaaacgccggtgaacaaattaccgcaaatgaaaacggctatctctggatcggaataaagaacgatgagcctgacagccctggtaacaaatcgcaggctttatttgcattcgccactccggaggagcgtattaattacattattgaaaagctaatactggccaaatccggccttgatttatacgatctggctgactctatttatatcagctattccaccattgaaaaagatatgatccgggtaaaaaagaaactcgcccttttcaatctgagtattcaccgccaaaacggaacaatcgatattgtcggtgaagaacatcataaacgagctctcttttcccattatcttacctcgaatctggattctaccatagatctgactttggagtcattctgtaagattttgaatatttctccagattctttgcgggcaattgtccatgaagccttgcagaccgaaaacctttatgcctccgattacgctttcaaaagcattattattcatgtcattatcaatatgacccgtatcaaaatcagggaatgtctattagaaaagccactttacgacagcgcgacaattcacactgccgaatatcgtgccgccagccggatctttgaccagatctcgcgcttatgccccatacagtttaacgaaaatgaactgcagcagctggcattcattatcatgacaaaaacaagtgcaatcaacatcaataatgtcattgacctgccccggattgtggacagcgcacttattcagtttgtcaatgaaattataaaacaggtaaaaaccatttactatattgatttatatgacacggattttattaattttttcactgtccatctctccaatgcactatttcgatgcaggcacaatgtttccatccggactcccttgtcagatgagatttttattcagaatccgttaatttacgaaatcgccgtttttattgcacaagaaattaaaactacttttggttatgagttaaataaagatgagataacttttatatctcttcatgtaggtgctgttcttgggaaaaaaatggatgaacatcccgaaataaaggcagttctggtagtaaataattattataactattacaataagcattctctggaatccattactcaaaaattatccggaaaatgcaaaattgcggaggttactaacactctggatgacgttaatcctgcttactacgatctgattatcgatgccacgaatcaggttctgccacaggccaatctcagagtcatacaaacaaatacaattattacagagcatgattttaaaaaaatacaatctgtctgtaacgaacttctggctgaaaaaaaacgcagaatattccacgataaactaattagttttatggatccgcaattatttgaaaaaaatcattacgaaaattctgtggaagatatgatacgctatatggcagaaaaactggttgctctgggtattgctccggaagcttttactgactctgttctggaacgggaggctgttacccccaccagttttgacaacaaagtggcaatcccacattccatcgtctgctctacccaaaaaaatattggatttgtaatcgttaacgaaaaacctcttcgctggggaacctttgatgttcaaattattatgatgatcggcgtcaaccatcagcagcgtatggattttaaatatgtctattctaatttactggagcattttgagaacagcactaccgtagaaaagcttatccacgcatcagattttcataattttattgacatactgacctcctgatcctaatttttatctgtcctctaatctggaaataaacagactgccaaacatatatttctcagtcaaaaaaataaagtgtgtaagttttgttaataccaacaacttacacactttattttatgttcttagcaaactccgcccttccgggacggagtttttcatttcagatctctgttttatttctcagcacgtgcgattgcaaccttgaaatccttggtatctgcaaagatctcgttcttgtacggattcttcttctgctcgattgcgcgcttgatgattacgcttaagcagatgacatttgcaaccaatgcaatgattgccatgaatccctgtaccttggtgttcggtgctacgctggtcagatccattgtcgttaaggaaaacgcatccagagactcaaagccctctacgttagagtagagtaccggaagtacagagaaacgtcccttgatctggaacatcggaaccacctgtgcgaacatacaccaggttgccagcgtattggcacggttctgaatccagccgcccttgttccaaagtgcatttgcgaatgtcggcgcaagaagcagagccagaccgcaataccaggaatgcgtcggcaggttattgtatgtataggtaaagttccaaagatcatatgccacgataaaccataccgtcatatccggccataacatatcctgatgattcttgtccttggatgcataaattccccaccagcctgtcatacagaagatgttgaggatacctgcgataccattgacccagttccaccagccaccgttcagccatacatcctcgatggaataccaccagccattgactgcctgtgcgcctttgattgcggactcaaaatcagaagcaactgcaatcatgatgttgattgcaacgattacaaacggccaaaccttgaaccaatcggtcttaccgatccactgcttgtactttaagaacatgaaaccgatgcatccaaatgctgctgcatataactttgcataatggaaccagccacccatatatacataggtatcattggttgcaccccagccaccgtttgcggcgctgatctgaatagcgataaagtatacagtaagaattgcaagaactcctacaaaaataccataaccgccaagttttgtgcggcgctcaatctcatttaagattacaagtcctgcaaatacgagaacccatcccaggagctgccacatgctgttaatctggaataacataactttttcctcctttgtcttattaaaaatatgatactccctcggaaccggcgcaccaggtatctggtatgaccagtccacaaatgaattttaatactttttttagaaaattacaagtatttttacaattattaacaaaatctggtatgaccaatattcagaattgcctgttatcccctgccggcacgcattttctgccggttcatgctatcttacgcctcctcatccaccttgattcccttcagatccgcttcaagcactttcatgctgctcttgatgtcgcccaggttctgatccacactcttcttcagatctgcgctgtccgccagatccaccatgtccgtcatctgaatgtccgggctatcattctggcgcttgatgcgctccgcctcttccactgcttcatcggtttcctcgatcatcgcgcgctcaatcgcgcgctccagcttcatctcatccagcttttcctcgcgcttttccttctccttcatggcttcgtcggctttttccttcgcctcgtccatcttctcatcctgctggtcttttacctcctgcacaagcattccgataatctcgtcgtttgccgcatccatgatgtcatccgcagctccctgtgcgtcaaccatcgcatgcgtcttcaagcgctccagcttgatacgggagacgttctgtttctccgcagtcatgccgtagtcggctccccggatctccctcttgtgacccgccgcataattgttcagttccatcgcctgcttctgatacccggtcagcggctttttgtggatctctgccagtctgtcatattcttcgtccgtcagcccttcatccagaacgccgttcttataatcctgttctttttccagaaggagcagatcctgctgttcctgggaatccgcatccacgccgcactgctcccgcaatgcttccttttgctgattcgtctcatcgattgcagccagtgctccctttttgcggttctccagctccgcgtagctgtcccggtggctctgtatggtgtcatctaccgaccggtcatttttccacgcattttccacgaccttccacgcctgcttcctcgcttcctcccggcgttttgccactgaatcttccccgagttttgtcgcgccgccgaacaccgcattttttaccgtccgcgcactctgtccatcctttgtccctatctggacgctgttgttaaaacctgccgcattaactgtcagtttcatactcattttccccccgtatcaaaccagaatacgtctccgtgtgttactgctgctcctccgtctgtgtcagcgcgatcagctcctgtgagcgtccggcgatcgttaaaagatgctgcatattttcttgctccgccgcaagcgtctcgttcgcatgtgccgatacctcctccgacactgccgagatcgtctgcacggaatcagcaatctcctgatttgccgcctcaagctgtgaaacgctctccgtcaatctcgccacattatcgcggatcgcataggtatgttcctcaatcgtaccaaagcttgccgacgcattcccagacatttccttttcctcattgattccgtcgatcatctcacggatgactgtcacaacctccgtgatggaaccggacacgttgccgatcagctgtgtgatgttggtcgttgcactcttggtctgagttgcaagctccgagatctcggatgccacgaccgcaaacccttttcctgcctctcctgcgcgtgccgcctcaatacttgcatttaacgccagcagactggtctgggacgtcacaccgttgataagctctacaattgtattcatctcactgatatactgattcagcgtctcgagcttatccgcggcattggcgctgtttcgcacagatacttcaacctctcccaccagggtatccatatccgcttttcccttttccagcacagaaagcgtcttttccatgcgctcggtaatatccgatgcaaccgtgctgacaagtcctactttctctccaatcgtctccgtctgtgccagctgtctctgcactgcctccgccgtgtccgtcgcgccgatggttacctgtcccatcgcgtccttggtcgtctccgatgccgactgcagctgctccacttttgcatggatctcattgattccgcgtctcatcacatccgcattccgggagacatccccgagaaccttttcggtctcgccctgcgcatcctttacctgctgcagcttctccctgctgttcgtctcggaagtcgccgctgcgatataggaatacgcgcagaacaaaagtaccgccagaatctggatcacgccggaactcatatcacggaaaccgaatctgccggttgtcgctccaagaatcacaaccagaaggttctctatcacaaccccgatattgaccttgagggcatacgccttgtcattgtatacggaaatcacaacaatcatcggaaatacatacaaaaacagcatgttgtttgtcgtcgtaaacaaaatgaccgtgtacatcacagcgaatccctgcgccaccaggtgcttgatcgccgggctttccttgtccctgctccagaaaaaaagctccatcagaggcggtcccatcgccagcacaacaaccagcagagagtacagcagtcccctgctgcccaccagaagctgtgcgataaacgtaattgtaatcatcgacgcctccaccagatggcagatcatagccgtccggttgcagcgcgccatatcagataacgttcttttgtccatttgtcattcctccgtacaccttgacaccattcttttactctaaagtatcatttttttcgccctgtcgcaatatttgtaataaaaactcgtccaatttttaacattttttgaaaattggacgaatccaactctcttttctgtcacatgcggacgcgctcacgcagctgcagcagcagctttttttccaggcggcttacctgcacctgactcatcgacagcagttctgccacctcgcactgtgtctttccctcgtagtatctgagttgcagcagacggcgctcacgctcgccgacggtctccaacagctgttccaccagaatgtggtttaggaccgcctccttctccggctcctcccgctccgcgctctgtcctccgcttccctccatctgatcgatcagcagcagctcctccccgtcgcgctcatagaccggctggtagatggacgccacctcccggtttgcctcaagcgccagcacgatctcctcgcgctccagcccggcggcttccgccagttcctccatcgtcggctctctccccagttccctggtaagcatttctcccgccctgcggattttatagccgttctcctttaaggttctgctgacttttaccataccgtcatcccgcagaaaacgcctgatctccccggtaatcatcggtaccgcgtaggtggaaaaggcaagctgcagcgatacgtcaaatttgtcgatagccttcatcagcccgatgcagccgatctggaacagttcctccctgtcatgtcctctgtgttcaaaacgtctcgtcaccgcgtgcaccaggcccaagttttctgccaccagccggttccttgcgtccttgtcccccgcgtgagcctgtatgatctgttccgtccaaagctccataacgttcagccttcctgcacgccaatgtattttttcatgcgcacgctggttccttttccgggcgcagactgaacctgaacttcatccataaacgcttccatgaatgcaaatcccatcccggagcgctccagttccggctttgtggtgtagaacggttccattgcccgcgccacatcctcaatccccctgcccgtatcacagacgatgatctccacttcccgtcccatgatcctgcatgtcatatgtaccttttcctccggattgtcatacccgtgaatgattgcattggtcaccgcctccgacacggccgtcttgacatccgagagttcatccatcgtcggattcagctctgtgataaacgcagccaccgccattctggcaaatccctcattgacggaacgcgcatcaaaacttaattccacttcattcttactatgcattgtgattctccccttcccgctctttctgctgcttaggtacgcttgtccgtatcagcgtgtgaagtccggacaccttaaaaatcttaaggattctgccgcttaaatgttccgcatacacctcaccgccaaaatatcccatcttccggctccgcccgataatcaccccgattccggagctgtccatgaactccgttcccgcaaaatcaaacacgagcgtcttcacctgaccggtctcaataaagaaatccgcctcctgtttcaggcggtctgcctcatgatgatcgagttccctcgggacatacacccgcaggcagtttttttcctgttcgcaatatctttccatcctttttcctccctttcttttctttatggcatttttgtataataggaacaaagtttcctatgaaacaaaaaagacgccggtacggactgctccgttcgacgtcttttgtatcataattcttttgtcttatcactgttgtatctgtttgcgcagtaccctgcttcttcctgtccccgcttattcttcggtgttcagatacctctgtgcattggcagcgcgctcggttcccggatacagatccgcaaacttctgataataggtcttggcattgtccatgtcgtcattcctgcggtaagactgcgcaaggtagtacagcgcattgccgttgtcgtaggtttcatcgagttcgatcaccttgaggtaatcctcgattgcctgtgtaaactcctgcgcattgtaagcatctgttgcttccttatatacggcgctgatatactccgcgtttacctgtgcattgatcgtatcgtacacagtcatggagtcatccgaaagataatcggtattgacgttgccgagtgccgtccccgccttctcgatgtcaccgtcggtgtacgccacatacgcctgcagaagctgctcgtaagtgttgacctttccggcgctgctctgctcctcgttcttcgcatccgtgatctgtgatgtgagatcttcgatctgcgcttctaaggaactgatgctctgattcttggatgccacggcattgttggcgtcaagaacctccgctttcgcctgattctggatctccctgcgcactcccggcacaatcagaaagcaggtgatcgccgcaccgattgcaattccgatcaccatattgatgatcgttccgattgcggaattgtccttgagatagcgcggctggatgatggtctcattgccgctctgataggagatcagatcctcgttcttctgctttttcgggttattctcacgcaatccggcgttgacttcttttaaatagcgcagcgtcgtggtgttgttggcgtcaatttttcccgcattccgaagcgacttcttggcaagttcgtacttcttctcctgaatgtagaggagcgccagcagctgatgaccgcttaccagcttcggatttaaggacagcactttcttgagctggatgatcgccagatcccggctgtcctgtctgcagtacagcagcgcctggttatattttttgatcgtctggttgatcgtatccagccttgacggattgttctggatctcatttaaataccggcttgcggcgttgtccctcggctggtaattcttgctgatgacccactccgtcaacgcttcgaccacctcgcccgtctcgaagtagaccagtccgagcaggttgcgcgcatcgatattcatcttataaaaacgaaggctggtcctaagactctctatcgcgccggacaggtcccgcactgccgccttctctaacgcatcattatagtaggcattggacgccataatgatctttttgtatattttaacattggctccgcagttctggcagatatcgcccttgcccagcttcgccccgcaattataacattccatggaaaacctcactttatcaatcctgaccctgcctgcttctacatgccgcgcttcatatcctgcaggatctcctgcaatacgtccgtcatatccgtgagttcatgattatagatagcctgctccgcctcttccacttccaggctcggcttaaaattctttaattcttcttcaaaattgatcactgttatcacctctgtcatcaatataaaaacaccactatattattcactttctcattataatatagtggtgctaataatcaagctatttttgacgcagaaacttctgctattcgacagcagcactgcacggtcttgttccgatcttgtccggtaatttgtaaaattccactccggttgccatatttttcaaggcaagcttcaactcgtccatattgatgatcacgccgggataaatctcctggatcaccgagacacatgcgcctctggaactctctgcgagaatacggagcttccgcacttcctcctcgtcgctggcaagcattgcagaatccttgatcttaatccgaagcagcgacgtccggcgcggatcgttcgtgtagctgacgccacgctccttggagagaatctcgaacttctccaatccttcctcgatcttcgccagttcctccctcgtcatctcgatcttcttctccatgacacgcaggcggctatacacatcaattccggcaccgacaaagatctcggtgcgcttctcggcatcattgccaagcgaggttgcaatcagtccgcggatcgcctgtaccttaccgccgataatactgccctttcttccggtcagacgtatctgcccatggcagatcaccgaacaatccatcagcacatccgcctgcagatcaccctcacacagaatgttcgtgaactcaaaaaacttcgcagtaatcgcgcccttcgtcttcacagacgccttgttgccgccgagcataccgcctcttaggatgatgtccttgccggcttccagcatgcacgcttcggcgacaccgtcgatcgtgattgatccggttgcccggatgttgacgccgctctccacattcccgtgaatgacaatatctccgcggaagtcgatattaccctctgccagctctgcattccccgagacttcatgtaccggaagaaccacaatccggtcattctgcatctcgatcttaccgtccatggaagccgtataagtcacctcatcgtccatacgatcgaaacctttgccctttaacggcatctgttctcttccgtgcttggcaggcaccagcctgcccttgaccgacattccatcctcgccagacacagcagggtgatacacggcaatcacctgaccggcagtcacagactcgatcgaatgtaccgaccagtaatccacagaaccgtccggcagaagcttcggcttgccgtcaaagttcgtgtcgaacttgtattcgtagtaaccgtccgttccatccaccggcttcttcccctgcgcgaccagaagctctgcattgtatgtatgcccctccagcatatcggaaatccgctgctcatctatgcctgtggtgattcctctcgctgccatctcctgccggatctgggcgtccgtataccctgttccctgttccggctccgggagcagcatataggcctccatctcatcaaatgttatgcgtataataggtttctgttgtgtaagttccgccatagtccgccgctccccattctgtgtaaatcccacctgctactgtcaatccatctacattctatcatactagtccgatggtactttttcaagtacatctttttgcgtttccggtacaatacgcagggtttctctaactcttttctagcggttcatctgtgcgagccgttcctcgacctgtgccatcatctgctcgtagcccgcgagcttctctttttcctcctgaacctttgcctccggagccttgcttaagaatttttcattggaaagcattcctctggaacgggcgagttctttggtcagacgctctttttcttttaagaggcgttccttctccttctcaaaatcaaccagatcctcaagcggcagatacagtgttgctcccggaattacgacagataccgcatcgtcctcgattccgttcttgtctgcctgtacactcacatcgcttgcgcctgccagattctgatatgcctctcttgtcttctcaaatgtctcacgcagtgcggcatcgtctgccacaatgaaaatctttgcttttcttgaaggcggcacatccatctccgtacgcacgttgcggacaccttttaccagatccttgcagtgctctaacatctcttcctctgccgggaaattccagtctgcgcggtactccggccattttgccagcatgatcgtctcctctttgggatgcagtgtgcagaaaatctcctccgtgataaacggcataaacggatgcagcagctttaacgcctctgtgagcaccgtctttaatgtccagaacgccgcatttgctgaaaccggatcctgctctttgttgtaggtgcgcgtcttggtaatctcaatgtaccagtcacagaactcatcccagatgaagtcgtaaaccttctgcactgcgattcccatctcgtacttgtccatgttctcggtcacgtccttggcaagtgtattcacctttgagagaatccacttgtccgccggctgtaactcatccgcggacggctcggttatcgcagccccctccagattcatcatgataaaacgggatgcattccagactttgttggcaaagtttctggatgactcgactctctcccagtagaaacgcatgtcattgcccggcgcatttccggtaattaacgtcagacggagcgcatctgcaccgtacttgtcgatgacctcaagcggatcaataccgttgccgagcgatttgctcatcttgcgtccctgggaatcgcgcaccagtccgtggaacagtaccgtgtggaacggcgcttttcccatctgctcgtaacccgagaagatcatgcggatgacccagaagaaaataatgtcgtaacctgttaccagcacatcggtcgggaagaagtagtccagatcctcagtcttcttgggccagcccagtgtcgagaacggccacagtgcggaggagaaccaggtatcgagcgtatccggatcctgctccatgtgaccgcatccgcacttcgggcacttctggggcgcactctttgccacaaccatctcaccacagtccggacagtagtaagccgggatgcggtgtccccaccagagctgtctggagatgcaccagtcgcggatgttgtccgtccagttaaaataggtcttctccatgcgcttcggcagcagctggatatctccattcttcactgcctccactgccggtttgatcagctcatccatctttacaaaccactgctgcttcaccatcggctctaccgtcgtaccgcagcggtcgtgtgttcctacattatgagagtgcggctccacctttaccagaagtccctgctccttcaagtcgtccaccagtgcctttctgcattcgtagcggtccatcccctcgtattttcctgcgaaatggttcatcgtcgcatcgtcgttaatgacggtgatctcctctaagttgtggcgctttccaacctcaaagtcgttcgggtcatgtgccggtgtaatcttcacgcagccggttccgaactccttgtcgacatatgggtctgcgatgaccggaatctcacggtctgtcatcggaagctttaacatttttccaacgatgtccttgtagcgctcatcgtccggattgacagcgactgcggtatcaccgaacagcgtctccggtctggttgttgcgatctcaacgaatctgccttcctcgccgactaccggatagttgatgtgccagaaaaatccgtcctgctcctcatgctctacctcggcatcggaaatggaggtcttgcagaccgggcaccagttgacaatgcgggagcccttgtagatcagtcctttttcatataacttcacaaatacctcaagcactgcgtcagagcagcccttgtccatggtaaaacgctctctctgccagtctgcggaggaacccatcttctttaactggttgatgatgcggctgccgtactcgtccttccactcatagcatttctcgagaaacccttcgcgtcccagatcgtgcttgtcaattccctgctttttcaggttctcaatgacctttacctcagtcgcaatggaggcgtggtcggttcccggctgccacaatgcattgtacccctgcattctcttgtaacggatcaaaatatcctgcatggtgttgtcgagcgcatgtcccatatgaagctgtccggtaatatttggcggaggcatcacgatggtaaacggtttcttgctacggtccacttccgcatgaaaatagccgttgtcctcccattttttgtaaagtcttccctcgatccccttcggatcatatgtcttggcaagttctttgctgcaattctggcacattgtcctctctccttttctttcctaattacataaaaacgccctttgtatccgtaaggatacaaagggcgacttatcgcggtaccacctttgttcaccagctgtatacagccggtcttcgctccggtcagatgctctctaaccagcggttcgttaacgggaaccgggcgtgaacacttgctgccgtacatcttctgtaccgctttctgggtgttccggttcaaaagctaccttccacgcatctccttccaagaaaccttgcagccgatgggtctctctctctgcggcgagtctgcatgtactcctctttctctctaccttttacatactgttaatgatacgtgcagcgtcccgttttgtcaagaaatttttagttcagactcttcaccagcgcctcatagacaaagcgcttcgcctcttccctgcttaccgccatcttctctcctttttccagatcgaccaggtatcctgcaaacgctgtcatctgcgccacgaacgccagcttctgcaagtacggattcgtctccccgatcgtgccttccgacacgccctggcacatcagggactccacaatcctatccgccagatggcagcccagagcctgctgtctcttttcacattccctgcgcatggactcagagacctcatacgaaccagttccgatccgtaccagaagacagaacgcctgtcgcttcgcgaacacctcttccatataagtaagaatctgtacaaattttcctgcaaaatctccctcacctttggtgatttccagtacgtgcgcaagccgcatctccacatcgtagaggaccgcattcgcaatgatctcctccttggaggaaaaatactcgtacgctgttcctttgccaatccccgcctgtgccgtgatgtccgacaccttcatgcggttgatatcccagccatcggttaccatggcaagcaccgcctcgtacagcagccgcactttctccggcagtgccccgttttcatatctcccattcattataattcttcctccaccatatttttctccctgttgaacgcgtcatagatacacggaaccacaaacagggtcagaagcgtaccgtaaatcaggcctccctcggtcacaatcgccatcggctgcatcatttccgaaccgtcaccgagtccgagcgccatcgtggacatcgacaggatcgtcgtgagcgctgtcattaagatcgggcgcagacgcgtctttgctgaatttaagagcgcctcttttttcgtcatgccgcccctgcggagctggttgatgtaatccaccataacgataccgttgttgacgataattcctgcaagcatgacgaatccgatcattgcgacaacactgatctcatttccggtgaaaaacagggcaaacagacctccggtaaacgccagcggaatcgtgaacatgatgatgaacggagacaggaatgactggaactgtgccaccatgatcagatagataaatacgaccgccagaatcagcatcaggtacaactgctgcatggcatctgctatcatctcatcctcacccgtcatctcaattgagtatccttccggcagatctattttattcagttctttcatcagtgcgtttgcgacaagcgtgacgttgtgtgtgtcatccacacctgctgtgacgctgatatagcgcgtctgggaatccctggacactgcgtttaagctgctgccagcctcaaacgtcgcaatctcggtaagtggaatctcctttaccgtatccccggtatccccggtatcttctgtgtcttcgatatccttggcatcccctgtatccttggtatcctccgacagtttttcgtccgtctctttctcctcatcgctacctgtgccgcttagctgcgccatcttatcctcgtaggaaaacgtgagattcttaatatcatcgagcgacacattcgcctgctcctcgctccttacatacacctcgtaatcctgcacgccggcagagatcgccgtcaccgcggtctgggacgccaattttgcatagaccagctggaatacctgcgctgttgtcatgccgtattccgctgccttttccttgtcgacatgaatcgtgtaggactgcgtcgtattatccagcccgtcatccacatccaccgttccttcctgtgcttccaccacaccggccactttccctgccagttcctggagggtgccaaggtcacttcccttgatctgcaccgtaataccgcttccgaggaaggaactcatatccgacgccgaattgtccgtgtcaacctgacagtccatatctttggtcagctccgcaatctgcgctgtaatctctcccgtcgtgacggaggaatcctcctccagaagcagatacatggtcacactgtcgctgctgcctcccatggacatcagagcgctgtctcctccggcgatcgctccgatcgtctccacgccatcaatgcctgcaattttctctgtcacctcatctgcgcgctcacagagctcctcaaacgtcagtttttcgtcgtctttcgccgccacagtcacggtcaactgatcggtttccatattcatatccatgaaggaaaatcctctggaatacgcggcaagcgcactcgtcacaagcaggacagtcacaccgatgaacacgaccggtttgaacctgagtgccagttccaaaagcttcgcatatccctgctgcactttttcaaagaaggcgtgccgcacctctttgggatttttaagtagtcccgccgccatcatcggcacgaacgtcagcgccacgatgaggctggctgtcaatgtaaacgtaattgtgagtgcgatgtccacaaacagctgcctcgtgattccctctgtgaacacaatcggaacgaacacacacaccgtcgttaaggtcgatgcaataatggctccggtcacgccgccggctccctcaaccgccgcctttttgatggaatatccctcgctccgcaggcgatagatgttctcaatgaccacgatagagttatccacaagcataccgatgccaagcgccagtcccgacaacgagataatgtttaaggaaatatttgaaaaatacatcaacaccaccgcaaaaataacactgagcgggatggagcatgcaatcacgagcgtcggccggatgtcttttaaaaacagaatcagcacgatgacggacagcagcgcgcccacgatcatattttccaataccgactgcacaatgatatcgatataaattccctgattcatcaagatcgccgtgtgaagtgcgggattatctgcctccatcgcctttaatttctgctggatccgctttgtcacatccccggtcgagtacccggtctgtttttcaatggaaagcatgattgcggggtttccgtttaccttggaataagactcaccggcgttgttcaccagttccactgccgccacatcgctaaggcagaccggcccgattccgtccagaccaagatcaatcaaaaccacctgctttaattcgtccacggaatccagcttatctcccacacgcaccatgtagcggttctcgccttccccgacatagcctgccggcatggaaaaattctgtgccgcgagcaggttaccgagcatgtcgaccgtgagaatctgattcagatccgcagattcctttgcgctatcctttgccgcatccagctggctctgtccctgcgccagctgattctttgcatcggcaagctgcgctgtcgcctcgctcagctgcaggattccctcaatctggttcttcgtcagctgcgcggaggcttcatccagcgcaattttacctgcgtccacctgtttttgcgcctcctgcatggtcgcaattcccgtattgatctcggcaagcttctgcgtcatatctgcgattgcatagggcagatcatcgagtgtctgtactttgatgccaaggctctccagctgctgtccccatgcggcgatcgattcattgattgttgcaagctgtgcatttgcctgctgctcgatctgtgcgctgcctcccgcaatcgcctcctgctgttccggtgtcagcatattcttcagcgcttccagctgctgtctggctgcaattccatcattataaagctgctgcagtgccggaattgccttctccatgatcttttttgcctcagtcatcatggtcatattcgtctttaattctgatgcgccgacatacgcctgaatctttccattttcaatctgattggctgcggcactgacctggtttgccagttcgctcttgccactctccagctttttctcgccattttccagctctgcggatgcatcatccagttccttctgcgcatctgcaaactgttcctcgatcttttcctgaatcttatcattcagagcatcgattttgtcctgatccatggtcacctgcacggattcctcaagcacgccggtagcgcttaccgaagccacaccctccacgctctcgagtgccggtgaaaattcattttccacataggaggacacctctgactcatccatgccttccacatccgccgacgccaccatgaccggcatcatatccgggtcgatctgcataatcatcggctttccgacgctgtctgaaaaacttccctccagctggtccagcttctgctggatctcaatcagaatggaatccatgttggcgctctgctcgtattccagaataaccatggaatagttgtcgtacgatacggagctcacgtttttgatgctggatgtcgtcgccatggaggcttcaaccggtgccgtcacatccgtctcaacctcctccgggctcgcgcccacatccgttgtaattaccagcgcatagggcaggttcatatccggcagcagatcagtcgtcattctggtaaatgacaccactcccagaacgatcaccaggattacacccacaatgacagtgtacggtctttttacactaaattttgaaatcacatctgtatcctctctttgactttgtattccgtccgaccagtcggtcggcttttgacattttttatgctgcgcgagaatctttcgattctccgcagcatatctgcgtttgtctattctgctgtcttacgatacttattcttcctcatcgtcgtcatccgcaattgccgccgctgttccggctaccgaagaagccaccacaaccacgaccacaattacaaccagcagcaataagatccccataaagatcaaaaaacccgtctctgtcattctccttctcctcgtctttctgtcagcagatgccgcacatcccgccgcacctcttccggcataatctcactcctgatgcaagtatagcatatttacacccgcatgaaaagtcctttatccggcctgttttgtgaagaacttctgtgtgaattccgccctgctgcaaggttttccgaacagaaacccctgtatataatccggctctgtctgttttgcctttgtaagttcgccctctgtctcgattccctcaacgcatacgtgaagccccaggctgtgggacatctccacgatatgatttaaaagccggtactcatattcacggttcagcgcttttaatgtgaacgaccggtcaatcttaatatatgcaggctttaaatcgcttaaacaacgcaggttggaatatcctgtgccaaaatcatccagtgccagcaatacaccgtattctttgagtccgttccagactttgtcaaagcgctcattctcctccagataaccgctctctgtcagctcgatgcagacactcgacggcttgactccgaactcatcaacaatcctgcgcacatccgtgagaacacggctctttaacacctgcacataggacaggttaacattcaccttgaactccggaagaatcttctgccattccctgcatgcatccagcgcctggcgcagcacccacctgccgaccggaataatcagaccggattcttcgagaatcgggataaattcgccgggcgataccatcccaccctccggtgaatggaagcggagcagcgtctccgccccggtcagttcaccgtttgcagcatttaccaacggctggaaatatgcctcaaatccctcaaatccattatttaccgcatgatgcagctgccgcagcagtgtgcggcttttcagataatcttcgtattcctcctcctcaaatacatagcagctgttttttccgcgctccttcgcctcgctgagtgcaaactccgaaagcttcatggcattttcaaaggaattgtccacatcgccgttcttcacgatacctccggacaccgtatacaccgctttgtactggttctgctcaataaatgcgtagatggatttcttgatctcatggaaaagatcttcggcctgctgcacactgccgccggaaaaatccacaactgcgaactcatccgccacaatatggaacaggctctgttccgggcctatattttcctcaatacactgtgccgttcttcttaaaatataatctccgtattcgttgccgtggctctcgttgatgttcttgaaatcatcgatgccgattctgagcaaaaatccctgtggcagctttggactgcggctctcataaaaaatcttcagactatattctcccaacaggccgctgacattgtccgccttctgttttgccccgatctcattgatgcagcccacaaggtatctgggtgatccatcctccggatcgctcaatactctgcccctgcagttgatccagatcgtttcatgattcttccccatccagcgatagtgcagattgtggaatactttcctgcccgtggagagaagctccagctctaccagcagcaaatcaagatcatccggatatacaacctgtctgtgcatttccactacattgtgaaaatgatctgccggcagacaaaaacgcttcaccgcattcggtgaaatctggtaataatcttccttaaaatcacacacatacaagtaatcatccatacaagggcttaaaagccctaccatatcaaccatttgttccgtcgtaaaatgcgccacttccgccttcatcttagcacccccagatcccgcatctatcgtactttagtcttactccatactacataattttctgaaaaaagtcaatcacagggcagaatatctgcacaacggataccgggatgttgacgatgtctccacaaaataaggctgtcacgcgaacggacggctatgtcatatattacactgaaaaaatcggaaaggacaacgttccagatcaaacccggagcgtggacattcggagcgcaaaatacggaatttctaattctgccgtgtttgccatctgcgatgatccgtgtctttccaagttttgaacactccacgaggagatgttcgcaagccgcagacaattttagaactttcgtgtgtgccttgtggcaccgctgaataaaacataaccgcgcgaagccgatgtctgaattggcatctgccatgttttcaatagcagatgccaacgagtttcggttcgcgcagttttatattgtctatgaagcggtgccactaggcacgctaggaagttcgctcattgtctgcagcttatcggacacctcctgtggattgtcaaaacgtggcaaagacacagaatgagatgaaaaacacggcagaaaagaatttcacgtattttgctccaacgaatgttcacgcccgggttcatccggaacttgagtcttcccgtcttttaacagttgcagcttatcacaatgccatcgttccgtgtgacagccacattttttaacccttcacacttccgagggcaacgccctgcacaatgtgtttggagaggatcagatatacgacgataaccgggaatatggagaacgcgatcatgacgtacacctgccccatatcgaacttcagccagtctgccgcacgaagctgcgcgatcaggattgggagggttttcttcttgtcatcgtgtaagatcaatgccggtgtaaagtaattgttccagctgcttacgaatgtgaagatcgcctgaaccgcaatcgccggtttcatcagtggaagtacgatctgattaaaggtatggaactcgccggagccgtcgatacgcgccgcctcgatgagggacagcggcagggcgctttccatgtactgtttcatgtagaaaaatgtaaccggtgctgcgatcgtcggcacaatcagaggaataaaggaatcctccagatgcatctttccaaccagctgtacgaatccaagcgccgttacctgtgtcgggatcatcatgatcatcaggatgaacggatagatgaactttttcagtccgaaatcatatgcatgaatcgcgtaagccgtcatggttgaaaagtagaccgaaaccagtgcgcttaagcctgctacgataatactgtttaacataccgttccataccggaagtgttcccgcgagcagattcttccagttctccagaagatgcgagctcggtgccagtgtgaatccggactgcagctgtccgtttgatctcgttgcattcacaaacaggatgtagaaccagaacagacagaaaaacgaaataatcgtcaataccacatatgcaatggctcttcttgtatgaatattcattcctttatgtacttttcttgtttccatacagctcacccctttctcttgtcattgccggtaatcttaaatactacaagacttaatacaccggtaataaagaacaatacaactgacagcgcacccgccataccatagttcttactgtacaggtgcttattcaagaacatgatcagcgtcatggaggaacgcatcggatctccggttccgtttgtcaaaatctgcggcacatcgaacagctggagaccaccgatcaaagaagttacaagtacatatacaaggatcgggcgcagcagcggcagtgtaatcttgaagaacacctgcatggaagtcgccccgtctacctcggcagcctcaaagagtgaggtatcgattcccatcattcctgccatgagaaggattgtcgtattgccgaaccacatcaagcaattcatgaatgcaaccagtcctctcgtgcttccaacattggaaaggaatttgtaaggtgtatcgataaagccaatctgcatgagcagtgagttgataggaccgctgtcggaaaacaatgtgaagaacaacatggcaaatgcagatgccataatcaggttcggcagatacatcactgtcttaaagaaccgctgtccttttaatttcaggctcacatccgagaaccatgcgcccaaaagcagtgacaggaagatctgcggaataaaacacataatccacatcaccatggtattcttggcataaacccagatgtcaccgtctgaaaacagctttttatagtttgcaagtccgacaaaattcggtccgatctgtgtcaggcccgacagataattctcaaagaaactgttgtaaatggttgttaccatcggaatcaactggaaaatcacatacacgataataaacggaagtaaaaagatatagccccatttattataccgaacggcttttgacttctttttcatagcatttgcccccttcttcattcattgtatacagagctcacagcagcccttccttttttttgcagacctgctgtcagctctgcatttccagagaaatcacctgtattttggcatagaatgagccacacccgccttcctgatggccggcaggcgtggctcctgtcattctatccatagcatctttacttcttcatctgctgatgctttctgcaccgatgcttatatcctctcaatcactgagattacagttccacgattagtgtgtcagctccggatatttctcctctactgccttgtagaacagatccagtgcctcatcctcggttgcattgccctcgaagtaattcttcattgcgtgctggaactcctcgttgcagccctggtcgtatgcggaaaggttgcttaagtcaaggctgtcaacacctgcgcagtacatagccagtggattctgtccgcctaataccttgctggagtagctggtatcctgtgccatagcttccatggttggcttattgtttacgaaatcatcatctgcaacaacgatatccttcataaggtctgcgtttgttgtcatctgaagcatgatatcttttacaagacctgggttatctgttccatttgctgcgcagatccatgatccgccccagtagaagccttccggtccctgtgttgcgccccatccgccgaggtttgcgatacttccctcgtcctcagctgccatggagaagtttactaaccaagccggtccaaagtagcagaatacctttccttccggatagaagcctttcttccagtcatcgctccaaagatctgctgtgccagtctcgcctgcatcaacaagttccttggaatcgtcaacccacttcatgatgttatcatcaatattgatcttaccatcaactacccacttggaagttacgttgttggagtatacacggtaggaatcatttgcggaagatgtgatcttgtaacctgcagcctttaatgtctttgctgtctcattgaatgtatcccaatcctttacatactcctgtacgtctgccggatcatcggagccaagcacttccttagcagcttcacggttgtagaataatacgcccgggcagccctgccaggtaaggccttttaatttgccgttggaatcagtaacaatatcctttgtgtactgatactggtctgcaatatctgcatctgtgatgccaagatctgctacgtccatggtgtaatcggtatctacatattttaatgcgtaatcagcctctacgaggaacagatcgatcttgtcatcagctgctgcatctgcctgctttaataaggtagcatccaggttgttctggtatgcgttgtcatcactcggtgtgatgttccattttacggtcacatcgccgatggttcctgtggttccgtctacgatggtgtagcccggataatgatcttccagtctggacttgaactcttcattccagcagtagatgttgaggactttgccttcatcggatgctgttgcatctgtagctgtctctgtgcctgcatctgctgcaggtgctgcctctgttgcaggagttgatgctgtgttgtctgttgtcgtcgtgtctgctgtgtcggatgatccacatcctgctgccatggatgctaccatggatgcacataagagtgcgctaatgattttcttcttcatagaaaaccctcctccttaagatgtctggctttcgccattggtttgggaaaccttttcctgcgccccgctgttatttctgcaaaatttttcctacggattgccctggtactaagcttccttctataacgactctctcaacgagagttgttcgcggtttttcaattgtgccaatcaatcgcttggctgcttcgcttccaatcagctctgtgttctgacggattgtggtaagtttgggatgcagcagctgtgagatgcgtgttccatcgtaacctgccacggagatatctctcggaatccgaagtcccatctcaatgatgacattccttccgccgattaaggcggtgtcatccgggtagatgatgcaggtcggcacatcgggaagatttaaaatctctctggtctgccttgctgcttccttcgtctcaagataatcggccgtccggatatattcatccggcacctccagtcctaattcatccatcgtccggtaaaaacttgccagccggtccttggtaacataggaattctcctgaccgtggatatatgcaattttccggtgcccctgctggtaaatatacttcacaaggtcttccatgccctgaatgttgttggagcttaccgccgtacagttatgatgtacatagtcgatggttaccaccggcagatcgctgttcatcagttccagaacgtccggatcattgtaatcggcacagacgattgcgactccttcaaagttccggtatctgcagtgttcatagtaggacatcttgcggttctcaaaacaggtattgataaatgtgatatcgtaaccctgcttctctgcctgaactttaagaccgttgagcacacccgagaaatattcatgggtaagaccgctgcccgcttcttcctcaaaaaggactcctatattataggaacggttggtcttaagtgctctcgctgccgcgttgggaaaatacccgagtgcttctgctgtcttcttgatccgatgcttcgtctcttcgctgacatccttctggtcgttgagtgccttgcttaccgttgcagtggagacaccgcatttctcagctatcgtttttaatgataccattgtgtcctccacactttcgaaacatcacttaatcgttttcgtacttttactatatgccatcttttgcaaaaatgcaatacatatttgtcatttcggcgagtttaacacttttttcgctgattttttgtgcatttttgcgtgttctatttctttttcttctattataagttgtattttccctgtcattcttatacgttttcgttttttatccctatatttcggttttcagctcctttgtgtctttcttctatattttacccgcttttttgttcaatctgctgtattcactgtatttatacgtatttcgattgatttttttattttcacaggttatacttttagttagaaattgtttacttaatcgttttcgcaattatttcagtttgaacaattcacttacctattttcgttgcaaatgtttcggaaatgcgtatgcttacatgatatgaatggaggtaagcccatgaaatttggctatttcgatgatgcgaagaaagaatacgtcatcacttctccgcggacaccgcttccgtggatcaattatctgggatcaaaggatttcttttccctgatctccaacacctgcggcggctacagtttttataaagacgcaaagcttctgcgcctgaccagataccgctataacaatgtcccgttcgacagcaacggccattactactatattaaggaaggcgatacgatctggaatccgggatggatgcccacaaagaccgagctggattcctatgagtgccatcacggcatgggatattccaccttccgcagttccaagaatgatctctccgcagagctgactgcttttgttccggtcgacgacagctgcgagatcaacaagctcacgctcaccaacaacggcagcgcgccaaagacgttctccgttttctcctacgtggaattctgtctctggaacgccatggatgacatgacgaatttccagcgcaatttttccaccggtgaggtagaggtccacggttccgcgatctaccacaagacggaataccgcgagcgccgcaatcactatgcgctctatgcggtcaacgctccgatcgcaggttttgacaccgaccgtgattccttcctcggcgcatacggagagaattccgctcccgaggtggttgtcaccggtgcttccaaggattccatggcaagcggctgggctccggtcggctcgcatcacctttccgtgtcgctggcaccgggcgaatctaaaactttcgtgttcgttctcgcctacattgagaaccccatcgaccaaaaatgggtcggacgcccggaggacggcgtgatcaaccgcgcaccggcagaagccctgatggcgcgctacgacaccaccgagaaggcggatgccgcacttgccgcattaaaggaatactgggacgaactgctctcccacttcaccatctcttcctccgaggagaagctcgaccgcatggtgaacgtatggcaccagtatcagtgtatggttaccttcaacatgagccgttccgcttcctattttgagtccggcatcggacgcggcatgggatttcgtgattcctgtcaggatctgctcggtttcgttcatctgatcccggatcgtgccagggagcgcatcctcgacatcgccgcaacgcagtttgaggacggaagcgcataccatcagtaccagccgctcaccaagaagggcaactccgacatcggaagcggtttcaacgatgatccgctgtggctgatcgcaggtactgctgcctacatcaaggagaccggcgactacacgatcttagatgagatgacgccatacgacagtgatccttccaaggcaacagacttcatggagcacctgcgccgctccttccactacacgatggagcacctcggtccgcacggtctgccgttaatcggccgcgctgactggaatgactgtctgaatctgaactgcttctccaccgaaccgggagaatcgttccagacgttcggtccgtctgaaggtccgaatgccgagtccgtctttatcgccggcatgttcgtgcgctacggaaaagactatgcggcaatctgccgccacagaggcatggatgacgaggcagcggttgctgagaaagcgatcgccgatatggagaaaacagttcttgacgccggatgggacggcgaatggttcctgcgcgcctatgaccattacaagaacaaagtcggttccaaggagtgtgaggagggcaagattttcattgagccgcagggcttctgcgtcatggcggagattggtctcaaggagggcaactgcttaaaggcaatgcagtctgtcgagaagtatctcgacaccaagtatggcatcgtcctgctgcagccggcttaccacagatatcacgtagaacttggcgagatttcttcctatccgccgggatacaaggaaaatgcaggtatcttctgccacaacaatccgtggatctcaatcgctgagacggtcgtcggacgcggcagccgtgcatggcaggtatacaccagaacctgtcctgcctacatcgaggacatcagcgaaatccaccgcaccgagccgtatgtctactcacagatgatcgcgggcaaggatgccaggaatttcggggaggccaagaacagctggctgaccggaacggctgcatggacgttccttgacgtctcccagtatattctgggtatccgcccggattatgacggactggtgatcgatccgtgtattccgtcctctctggatggctttaccgccagaagagatttccgcggtacgacttaccatgtgactgtcaagaacccgaaccatgtggagaagggcgtcatttccatgatcgtcgacggcaaggatgtcgatgtatccagcatctccggcggcatgattccgatcgcactcgcggacggaaagaaggacgtgaatgtcgaggttgtaatgggataacccgctgaggcttttgtcacaaagaattgtcgcaataagcatagatctctttgggttgataagtaatattataagaaacacacttgcggatttcgtgtggaaatgcagatggaatattcgttagagaaaaatgtgagtatttcttccggtcgaatgtttgcatcagattccgtgtctcttccacgtttggacaatccgacgggtgcatgtccgacacaccggagacaataggcggactttctggtgtccctaatggcacctcttcacagacaatataaaaccgcgcgaaccgaactcgccggcatctgctattgaaaatagggcagatgccgactcagacagcggcttcgcgcggttatgttttgttcgacataaaggtggcatttgtgccatctgttgtctggtgcccataagggacacacacaaaagtcctacaaattgtcttccgggatgcggacatgacccgcggagtgctccaaacttggaaagacacggatcatcgaagatgcaaacatccggctggttagaaatgccacattttttgatccgaatttccacctgcatttccatctgaaatcccacggtgtgatcttataatattacttatcacacaaaagtgactatgcttattgtgacagtttctttaaaaaaagcctcatgcggtcttcccatggaagaaccgcgtgaggctttttcacatattcgctatcacttagatcgctgtcacaactccgttttcgctgtcaagctctacataagcgctggactttaatacctccagtgcgttcttcgcgccgatcagtaccggaatatccaggctgagtcctgcaatcgccgcatggcagctgtcgctgtccgcctccacgatgagaccggatgcctgacgcatctgctccatcatgcggttgttggtatcggctgcaacgatgatgtctccctctttgaagttcgcaagatcttcctcgctgtggcagacgcacaggtttgctgcaatcttcttacctgcaattccttttccctttaccagaatatgtccggctacctgtaccttgatgaggttggtcgttccggatacgccgagcggtacgccggcagtcagaacaaccacgtcgcccttgctgatcagacctgccgtctctgcagtgtcaaccgcatagtcaaacagttcttccgccttattcttctgctcaagaagcagcggtgcaacgccccaggaaagtccgagctgacggtatactttctccgtcaggcacgcgccgatgatcggagagtacgggcggtacttggagatcatgcgcgccgtgcgtccggacttggatactgccagaatcgccgccgcgttgaggtctcccgccatcgtacaggttgcatgggaaatcgcgttcgtcacatccgggctgctcatattcttacggtccttgaaacgctgcagatagttgatatcgcactcggtgcgaactgcaatgcggaccatcgtcttcaatgcctcgatcggatactggccggcagccgtctcaccggaaagcatgatcgcactcgttccgtcatagattgcgttggcaacgtctgtcgcctccgcgcgggtcggacgcggatgtttcatcatggaatccaacatctgggtcgccgtgataaccacttttccggcaccgctgactttcttgataatcatcttctgaatgacaggaacgtcctcaagcggaatctctacacccatgtcgccacgggcaaccatgataccgtcggagacgcggatgatctcatcgatgttctgcacaccctgcatgttctcgatcttcgcgatgatatggatgtcctcgccgcctttttcctcaagaatcttgcggattgcaagcacgtcatccgcgcagcgcacgaaggatgctgcaataaaatcatagtcgttctccactgcaaatacgatgtcaccatagtctttctcgctgatgtacggcatggaaagctccacattcggaacgttcacaccttttttattggaaaccataccgccgttcataacggtacagacaatatccatcggcatttttccctctgcgtctgcctttgcacaggatactttctggatcttcttgacttccagaccgatcagtccgtcatcgatcagaatggtatctcctggcttcacatcgtccggcagttccttgtatgtgatcgccacacggctctcatcacccacgatgtcctccgtcgtcagagtaaatgtctgtccgttcttcagctccaccttgccgcttgcaaactctttcagacggatctccggtccctttgtatccagcagagccgcgacaggacgcttcatctccccgcgcagcttgcgaagcatcgtaagtcttccaaactgctcctcgtgtcctccatgtgaaaagttaaagcgcgccacattcatgccttcctcgatcaggctgcgcatcacattctcatcatccgtcgacggtcctaacgtacatacaatttttgtctttcttaacataatattcctctctttattattctgtcactttattttgtaatcatggtgcccatgcccggagttacctggcttccatccacgtgaagctttgtaatcaatacggagcggatcgccgaatcgccgataaagtcgatcgcagcctgaatcttcggctgcatatccccctcgccgaactgtccctgctccatatatttctttgcttccgccactgtcatggaactcagcgggcgctcattctctgtgccgtagtccaggcacacattgtctacgcttgtcagtatcacgagcatatctgcctccagaagttctgcgagctttccggctgccagatctttctcgatcaccgcacttgctccctttaaatgattgtcctgagaaagaaccgggataccgcctcctccacaggcaacaacgatctgatccgcatctgtcagcgcgcggatcgcatccacctccacaatatcgaccggcttcggcgctgccacgatacggcggtagccgtctgccaccttcgtcacatggttgcccttcttctcctctgcttctgcctcttcctccgtcatcacacggccgatgatcttgcttggcttatagaatgcctcatcgtacggatcaaccaccacctgtgtcaggatcgtggatacggtcttgtagatacctctgttcagaagctctgcacgaatcgcattctgcagatcatatccgatatatccctgactcatcgccgagcagacagacatcggcgtcgccgtatattccggatacagacgacagaactcattcatcgcagtgtgaatcatgccgacctgcgggccgttgctgtgcgtgatgaccacctgatagtcctcacggataaaatcagcgaccgcctttgccgtgcgcttcgtagcttccttctgctccggcagtgtcgttcccagtgcgtcatgtcccagtgcaataacgatcttctttttcttcatttttatcatcctccaacgcttttatgcgcgcatttgtaatcccttttccctgtatacaccaaaaaattttaccagttttattttatcacgaaccctctgtcatgcgcaatgggcaacttgtcacggaagcgttaaagtttgccgcaccagaacgcaaaaagcgggaaccgcacacacgtttttcgtatgtgcgattcccgccctgtgttttctaatctcccgtttttccggctggaattcaccggaattcgtcctgcccaaacttctgcccggctcctactcgtcctgcggcaggacaagcgaatcgatcaattcccagatctcctctctaccctgcttggtctccgccgagaacggtatgatcatcgttcccggctgcacgccgagtccttcacggattgccttgacatttttctgaatctggcttcgcttgatcttgtccagcttcgtcgcaatgatgatcggggcaaatccctgatacaccatccactcatacatcatcctgtcgttggcagacggatcatgccggatatcaatcaggagaaaaacagccttcagacgtttggaggtgtgaagatagttctcgatcattttcccccactttgccttcacttcctcggatgccttggcgtaaccgtaacccggaagatccaccagatacatggcgtcgttgatattgtagaaattgatcgtctgtgtcttgcccggctgtgcggaggtacgcgccagcgccttccggttcatcagcgcattgatcagcgatgattttccgacgttcgactttcccgcaaatgccacttcgttgtaggccgtatccggtatcttgctcgtaattccgcagacaatttcaagatttacatttttgatgaccatgttctactccttcttttcgcaaaaagcgacgcgaagcacctgctccatcgtctctacatagacgatctccagtccctttttgatctcacctgatatttcctcgacatccttctcgttcttcttcggcacacagaccgtacggacgccggcgtttttggctgcgagcagcttttccttcaagccgccgatcggcagcaccctgccgcggagcgtgatctctcccgtcatcgcaacatccgcccgcaccggtgtcccagtaattgccgagagcatcgccgtcgccatcgtaatgccggcagacggtccatccttcggaaccgcaccttccgggatgtggatgtgaatatcatttttctggaaaaattccgccggaatgtcatactgtccgccgaccgaccggatatagctgattcccgtctgtgccgactctttcatgacatcgcccagctgaccggtcagctggaattcccccttgcccggcatcacgttgacctcgatctccagcgtatctccgcccacgctcgtccatgcaagtccgcgcacgatcccgatctcatcggtctcaccgcgcatatcctggctgtatttttccttgccgagatacttctcaagattgcgcaccgtcacatcgaccgtgctgctttttccttcgtagatctcgcgcgccgccttgcgcgcaatctccccgatcctgcgctctaacccgcggactcccgcctctctggtataaccgcttatgatcttcgcgaaggctccgtcgctgactttgaactgatcttccttcaagccgttgcgctccgtctgctttgccagcagatgttctctcgcaatgtgaagcttctcgttctccgtgtagcttgtcacctcaatgagttccatacgatccagaagcggtcttggaatcccctgcatggagttcgccgtcgcaataaaaagcacctccgagaggtcgatcgggagctccacatagtgatcccggaacttatgattctgttccgaatccagcacctcaagcaacgccgaggcagtgtctcccttatagtcactgctcatcttgtcgatctcgtccagaagcatcagcggattcttcacaccggcgctgcgcagaccgttcacaaggcgtcccggcatggctccgacgtaagtcttccgatgtccccggatctccgcctcatcgcgcacaccgccgaggcagatccgcacgtatttcttatccagcgcacgcgccacagagcgcgcaatgcttgtcttgccggttcccggaggtcccaccagacagatgatcgggctttctcccttgctcgtcagattgcgcaccgcgagaaactccaacatacgctccttgactttctccagaccgtagtgatcttcctccagaatccgctctgcgtttgcaaggtctttgttgtcctcggacgctttattccacggaagctccagcagcgtctcgatataaccgcgggtcaccgcgctctccgatgaattcgcgctgatgctcttgaagcggtcaatctccttcttgatgcggtttttcacttcctggtcggcatccagcgcatccagtgctttctggtactcgtccgcatccgattccgtattgtcctcgccgagttcctcccggatgagcttcatctgctcgcgcagtatgtattccttctggttcttatccacgcgctctttgactttgctctggaattcattctggatggcagtgatttcaatctcttttaaaaggagcgccatcaatacctcatagcgctccgtaagtgtcattgcctccagaatcttctgcttttcttcgtaagaaaccggcagattattcgcaacctgatccatcagcttcggcagatcctgtatggtaccgatctggcgcagcaattcttttccggcacgcggatttaccgtctgataccggctgtatgtctcctgtacactgcgcaccatcgcagctttggcctcttccgaaagcccctcctccggcagcacgcacggcgccacctctgccagaagatacggatccgtctgtgcaaaagccgaaagttcagctcgctcgataccctcaaccagaattcttacgatattgttttgtaatttgattacctgctttacttctgcgatcacaccgatatggtatacatcgtccgctcccggttcttcctgttcgacatccttctgcgccgacaggaaaatcttctgggaatccaccatgcactgttcgatcgcacggatggaccggtcacggctgatgtcaaaatgcgcaatcattcccggaagaatgaccatcccgcgaagcgcaaccgcaggtatttttaagatttctgtatccaacatatcctctatttttcttctatggtctttaatttctgctcctcaatggaaagcttctcctccaccagatccttggtgatctcacactcggtgatgctctcatccgacggaatatggtacatcagatccagcgtcacagcctccataatcgcgcgcagtcctcgcgctcccgtcttgcgctcgagcgccttgtcagcgatcgcctccagtgcgtccgcgtcaaatgcaagcttcacgccatccagctcaaacagcttctcgtactgtctggtcagcgcattcttcggctcttttaagatgcggatcagggcgtcgcggtctaacatatccaaagataccgtcaccggcacacggccgatgaactccgggatcagaccgaacttcacaaaatcctgcggcagtgcatgctttaacacgtcgccgatattgtactcattctttgacttgatgtccgcgttgaaaccgattgccttctgatccatacgcgtctcaatgatcttctcaagtccgtcaaatgctcctccgcagatgaacagaatgttcgtcgtatcgatctggatcagttcttgctgcggatgctttctgcctccctgcggcggtaccgatgcaatcgttccctcaaggatcttaagcagcgcctgctgtacaccctcgccggatacatctctcgtgatagacacgttctcggacttcttggagatcttatcgatctcatcgatatagatgataccgtgctgtgcacgctcaatgttgtaatctgccgcctgaataatcttcaagaggatattctctacatcctcaccgacataacctgcctctgtcaacgtcgtggcatctgcaatcgcaaacggcacatttaagacacgcgccagcgtctgcgccagcagcgtcttaccggaaccggtcgggccaagcatcagaatgttgctcttctgcagttccacgcccagatcgtcccctgccataattctcttgtaatggttatatactgcaacggaaagaacctttttcgcctgatcctgtccgatcacataatcgtccagaaacgcttttaattcttccggttttaaaaggttgatctgctccgtctcttctgcggtgccggcctcttcctcgttctcaaactcttcctcaataatctctgcacagatgtccacacactcatcacagatatatgcccctttcggtcctgcgatcagcttgcgcacctgtccctgagattttccgcaaaaggagcagcggatctcatcgtcacttcttcctgccatttttaactattctccatgttctatcttacttcctgccaaaatcaggtcttatttgctttcttccttcttggtgtccttgcggatgatgacatcgtcgatcagtccgtacgcctttgcctcctcggcagacatgtagtaatcgcgctcggtatcggcagcaaccacatcgtacggcttgccggtgttggcagcgagaatctcatttaactttttcttggtctttaaaatgttctccgctgcgatctggatctctgtcgcctgtcctttggctccgccggacggctgatggatcatgacctccgcattcggaagcgcatagcgcttgccctttgttcctcccgcgagcaggaatgcacccatgcttgctgcaagtccgatgcagatggtggacacatcacacttgatgtactgcattgtatcgtaaatcgccatacccgctgtcaccataccgcccggggagttgatgtaaagctggatatccttgttcggatcttcggactccaaaaacagaagctgtgccacaacaaggcttgccgttgtctcattgacttcctctccaaggaaaataatacgatcttttaacaggcgggaataaatatcataattgcgttctccgcggctggtctgctctacgacgtaaggtactaaactcatattcgatcctccattttatacttttttaataattacttataagcttaaacagaccggcccaatagagccagtctgtctgttttgcaataagaactgacaggggaattactcctctgttccctctttctcttctgcttctttttctttcttggattttgctttcgctctctccttcacgttctccatgatcaggtctactgccttggtcactgcaaggtctctcttcatggattccttctcgttgtcgccgatgtactctttgagcttgtcagcttccataccgtactgtgctgccatcttctcaatctcagcatcaagctcttcatcggtaatctcaatcttctcatcctttgcaatctgctctaataccaggctgctcttgatgcgtgtctcagcttccgggcgaacctgctcttttaacttgtcgagtgtcagaccggagaactgcatgtactgctccatggaaagaccgctctgtgccagtctctgagcaaattcattgaccatgttctcacactgtgtctcgatcattgcctccggaatctccatggtggacttgtcaatgatcttctggattgcctcgtcctccttggtcttcttagcctcgttctccttctctacctcaaggtgcttcttaacgtcagccttgtactcctctaaggtatcgaactcggatacatcctgtgcgaactcatcgttcagttccggaagctccttgcactttacttcgtggatcttaaccttgaacattgcaggctttccggcaagatctgctgcctgatacttctcagggaaggttacgtttacttctacttcgtcgccggcattcttgcctacgagctgatcctcgaacgtatcgataaaggaatgggaaccgatctcaagcggatgattctcacccttgccgccctcaaatgcaacgccatcaacaaatccctcgaagtcgatcactgcggtatcgccgtttgcgatcggtctgtctgtaacggtaacagttcttgcgttgttatttctctctttctctactgctgcctctacctcttcgtcggatacggaggtatcaatcttggttacctgaacaccaagatacttgccaagctttacttccggtcttacagcaacctctgctgtgaagatgaaaggcttgccggactcgatctgtaccacgtcgatggtcggtctggatacgatgtcaataccgctctcctctactgctgcaggatagttctcctggatcagggtgtttgctgcgtcctcatagaacactgcctcgccgtacatcttctcgatcatctttctcggaactttacctttacggaaaccaggcatgctgatcttgcctttttctttcaggtaagcagcctggattgctttctctacttcttcggcagccacttcaatggtaagctttgccatattcttttctaagttttctacctgtacactcattgtaactatcttcctccttaatatatatgaaatatcatgtacatcttccgtccatcgcatgacattcgtcacgccagtcgcctgcagcccctttttcaagggtttctgcctgtctttcggaaaaaagggcgtactacgactatcacagtcatttaaggattataacatacaagaccggaaaatactagcttttttttgatttctttgcggttttcccgccaaaaacacgccctagagctccacaccgcggtgttctacagatgtagagaacacaatcagcgtctttgtccgtccaaaatactgcaattccccgataaaacggtcgagttccatcgtattttcaaacaaaacctccagcagcatggaatagtcgccggtcacacagttacactcaatcacgtttttttcacggtacacccttccgcctctctcattcggctttgtactgcttttttctcacggggttctttttccgttccacgctccgcagctgcttcttccgcgcggtctcttcccgtcgcttcgcatgcgccgcctccgccagaagcttcttatagttaagcagccggcgttccggcagtcttccgtcccgcactgcctcctgcaccgcacaccccgtctctttttcatgtctgcagtctctgaatctgcaatgctgcgccaattcctcaatatccgaaaatgtcgtatccatcccgcattttgcatcccctacgccaagtacgcgcattcccggtgtatctatgacacgggagccatccggcagaaggatcatctgccggtaagtcgtcgtatggcgtcctttggaatcatcctcccggatcgcgccggtatccataaccgtctccccacacagcgcattcacaaacgtggatttgccgacaccggatgatcccagcagcactaccgtttttcccgcacccagatagtgttgcacgtgttccatcccttcgcccgttaccgcacttaccgcacacactgcaactcccggcgcctgcctctccacaagatttacataatattccggttcctcgcagagatcttttttcgccagtatgacaaccggcgtcgccccgctctcccacgcggctgtcagataacggtccagccggttctggttaaaatcatgattcatcgacatgaccagaaacacatagtcaaagtttgccgccaccgcctggcgctccatgccgggcgtcggattttcccggtaaaacacgctcgttctgggaagcgtctcaaggatcagtgcatccccgcaccggtttgtctgaatacgcacccggtcacccactgtcggaaatgcctccccgcccttgtcctgataatacacaccggtctttaacctggcattgagctttgtatctgacgtttcctgttccacaagaatctcataacgttctctgtgtaccgctgtgatcagtgccttcgctttcgtattttctgttttatttcctgtatgttccatccgttttcctctttcctctcaattttccattcactgtttctttccattcctacaatctccattctgtttttctccatttttacattcctcctttattaaaagaatctcgcttgcgagattctccgcgcgcgagcggttcgcaaagcgatattttccttaccgcgagctgcgcatcctcgcggagcgttttttatttcataggaaagttccactttcacacatgaatgtatcacggtatttcctatgaaattaaaaagcattcctgccacattcctgcatagcaatgcttctgccttcattcattctgttttttgtgccggattgccgtttccagattgtaaaaagcaatcgacggcttgcaacacccatttttcaataagcaattgccgccttgcaacatccatttttcaacaagcattgccggcttccagtctccgggttttccaacataatcgcagatttataccaggcgcttcaccataaagtgatcgtccgcatagctgccgtcccgataccggacactgtgcggctgcgttccccagatctcaaacccgaggctctcgtacagtcggatggcaggtgtgtttgtgctcaccacttcaagttctgcctgctcatatccgcactgcttcgccaccgtaagcaccgtctttagcatttccctgccgattccgagcccgcagtatttctgatagagggcaatcgcaacactgcagcgatgcgcatagcgctcataatttcccagagacatcagggaacagtttccgacatgttctccagcaacggttccgatcaacatcagttcccgcggttcttttacgattccttctataaaatgttcctcctgctccggtgtaagactgatctcatccggctcacgtatcagaaatggcgtctccccggcagtcactttcagataccggatcagatcatttgcatccgtcactgctgcactgcgcagaatacagcttcgcccgtcccgacaggtaatttctcttggttcataaatcataattgggtctcctccctgtgatctgtatcactccggcactttatttttccacattttcttccgtgatcgtcaaaaagtcgatctgcacggtatcgctgccgccgcaaaccccggcaaaaacagttttctctgacacgatgcgtcatgatagtcccggcttttccgctttttgtgcatccaccggaatcggtttttcctcttttatgcatccaccggaacctacttttcctcttttgtgcatccaccggaacatgcttttccggtgtcagaccttacctggctgcgtttgcatgtattacgcatcctttagatcgattcctgcttcccgcagatttcttcgcaattccggcatatcctgatgataaacgcatccccgcattcccaggcgtatccccgcttcaatgtttgccggcgagtcgtccacaaaatagctttcctgcggctcaatcttcattttccggaagaaatccacatacgcttcgcgttccggcttcagatatccacactcacacgaaatccagatgccgtccatataccctacagacggaatattttttgaaaatgcccggaaacggtgtgatgtatttgacatcaaaaacaaatggtacccctgttccttcaactctcccagaagcgcctccatcggcggattcggctcctgcttcatccgaaactccctcacgaaacgctccacaagctcccactcactctgcggaattctcttgcaaatggaacgtaccgcttcctcatcggtcattgttcctctgtccatgcaaatccactccaccgatgcacaaacctgatttttcaacaatgctgcctgcgcttcatcctctgtatatgtcccgatgtaatcgctcagcttatattttgtcagaacatttcccatatcaaatacgatatttttcattttatctccatattccgttgacctgctgcgtcacattgttccggcgcatgcgcgtactcttatctttctatgtcgatccggcgcatgcgcgcactcttatctttctatattgatctggcacatgcgcgtacttttatctttctatgttgatctggcacatgcgcattgcgtcgagcgctgtctcgtggcttttcggcgttacccctgcacagcaggatgcatccacgataatcggtgtctccggcaaaaatgctttcaataacaatgcatttgagatcacacaaatgtccgtgcagagtccaaccagcgtaatgtcctcgatctgctcttttctgttctcctcctgcagcaactcgccaagcttctccgaaccgaatgtcaccttatcaatcgcctccgcctcccggagcgcctctagctgcggacagatctcccagcctttcgtgctcttgatgcagtgcggcaccggaagatgttttccctcctgtgtctctaaataccgctctccatgtgtatcccgcgtaaaaatcacttttcccggaaactcgcggattttctgctccacccgtgggacaatggcgaccgcctccggtgttccaagcgctccatcgataaaatcattctgcatgtccaccacaatcaatattttctgcatcttttctcctccttctgaaacttcgcgggtctcacggcctctttttcctctctcagacccgcagggcacctctttttcacgaatttcttctgttttttcactctccgcgggtctcacgagctcttttttctttcctagacccgttttttctcttttttcgggtctcacgggctctttttcccctctcagacccgcagggcacctctttttcacgaatttcttctgttttttcgctcttcgcgggtctcacggtctcttttttctcttctagacccgcagggtgaacctttctaactcggctgcagaccaggtctactcgtccaactcagttgcagaccaagtctacctttccagcccaaccgcacccgcagccgcaacgcctcatcttccaattttttattccagccccgcgaactgcgccatgtaaagatcgtaataagcaccttttttcttcatcagctctgccggacttccctgctctaagatgccgccctggtcgatgacaaaaatacggtctgcattctggatggtcgaaaggcggtgtgcaatcacgaaactggttctgccggacagcagtgcctcaattcccttttgcacaagaatctcggtgtgtgtatcaatactggacgttgcctcatccagaatcagaatcttcggcatcgagatcatcgtccgcgcaaatgcaatcagctggcgctgtccgatcgaaagtcccgctccgtgctcctttaactccgtgtcataccctttttccatcttcataatgaactcgtgcgcattgaccgccttcgccgcagcgatcatctcctcatccgtagcgtcaagctttccatataaaatattttcacgcacagtgccgtggaaaataaaattgtcctgtgtcatgacacccatctgccgccgcaggctttcgatggaaatcttcgtgagatcgtagccatccaccgaaataacaccgtcctcaatatcatagaatcggctgatcagattcacgatcgtcgtcttgcctgcgcctgtcggtccgacaagcgcaatcgtctctcccggctccactacaaaactcacgtcggaaagcacctttgtctccgccggcgttcccttatcgtatgtaaagctgacatgggaaaattccactcttccctgtacttctggcaattccgtaacgtctgccgcatccacgatatctgcctttgtatccagaatatcaaaaattcgctccgccgccgtcaagtttgtcaccagattattgtaaaaattactcagattcataatcgggttccagaacatattgatgtacgtgccgaatgcaaccagaagtccgactgaaaccttttcaaaaccgagaaagcggacgccgaccagatagagcatcatcgcgccgattccccaacagaaatcaatcaccggtccgaacatatccgcatagcgcaccgcgtccacgaacgactgctgatgctcatcggtcagatttccgaaaatctctcttgtctcctcctcggcgccaaaactctgcaccacattcattcccgcaatgtcctcatgcacataggcattgaggttggatgattttttgcggaaaatctgccagcgcttatgcgaggcagtctgcacaaaccaaatgccgccgatcatcagcggaatcgtgctgagtgatgcaagtgccagacgccagtcctttatcagcatgatcaccacaacaccgatgaccgtgatcagttccggaatcaatgttgtcaccacatttaccagcacatcccgcagcgaattcacatcgccgatgattctcgccagaatctttccggtcggtctgctgtcaaaaaaagaaaacgacagcgtctgaatgtgttcgtacagatcctgacggatgcgcagcagaatcttgttcgataccaccgccatcacgtacatacggatcttcaccataatgataaaaataatattcagtcccagcgcaaacagaccgagtcccatcagacctttcatatctttatttgcaatataatggtcgatcgcctcctcgatcagaagcggattgaccagtgaaatggcaaccgtcacagccatgcagagcagcacgccgatcaggattgctttgtattccagtagataggagaacaaccttcggaaaatcttctttttgtcagtgttctccataaattcatcttcacgataggaattaactgccatgaactctcatccccttttcctctataataaacattttcattcgctgcgcccgctcgggcggcttcgcctccctcgctgtacggcattcgccgcatccctgccgttcgcctgccctcagcagcacgctgctggtgtcggctctcctgcaggggcgctgctcattgctaacgcaccatactgtgccatgtaggtgtcgtagtacaagcctttctttgcgagaagctcctcgtgtgtcccgcgctccgcaatctttccgtctgcaagataaataatctcatccgcatgacgcaccgccgagatgcggtgtgcaatgataatctttgtcgtatcgcgcagagcgtttaacgtctgctggatctcatgctccgtctccatatcaagcgccgaggtcgagtcgtcaagcaccagaatcgggctgtgctttgccagcgcgcgcgcaatgctgatccgctgcttctgtccgcccgaaagtccgacaccgcgctccccgatgacagtctcgtactgttcatccatcttctcaatgaacccgcgtgctttggcatcctctgccgcgaggcgcaccgcctccatctgaagttccttgcgctgtcccatcttgatgttctcctcgatcgtatccgagaaaaggaacacatcctgcaaaacaaccgcgatgttgctgcggagctgatgcacatccatctttcgcacatccacaccgtcaatcttcaccgcgccgtccgtcacatcgtaaaaccgctggagcagattgacgatggaggattttccggagccggtcgcccccatgataccgagcgtctttcctgccggaacggtaacattgatgtcctgcagaatcttctgcccgtccatgacaaagcccgcgtggtcaaaacagatctctccccggatttcgtcaagcacctttggatgctcgtcgtttttgatcttcggctgctccgcataaatcttgcggatcttcttataagatgccaccgcggacgacacatcgttcgtcagccagcccagcatctccatcggccaggtacagttcctgctgtactccacaaacgccaccagcgcacccagtgtcatctcaccgttcatgacaaaaataccgcccaggattgtggaacaaaccggaagcacctttcccacaaacgaaaacagcgggtaatactttgtcagtacctttgcctgtgaaacattcagttcgtaataccggttgttgtgggataaaaatttttcaatctcatgcttttcccttgcaaacgccttgactgtgcgcacacctgcaagattctcctccgccacggttgtcagcacggcattttcctcactgatgtcctcgtaaatcttgtcgagcttgcgctccatgatgatcgcgaccgtaccgcacaggatcattgtggcaagcggcacgaacgccagcttccagttgagcgaaaacatgcagtacagtaccatggacacatgaatgataacctcgatgacaagcatgcccacatagcccatcgcattccagattttatccacgtcatccttgacacgcgccatcagttctcccgtgttcgtgtcctcaaaatatcccatggacagcgactggatatggtcgaacagatccttgcgcattgccgatccgatcttggatgccagcacgtcgaacgtgaactccttgcagtagccgaaaatgctcctgccgattcccacgatcacgattccaaccagaagtttcgtcaaaagctccagttttccgcctatgatgacatcatccacaatctgctgtgtgatcttcggatacagcatatccagaacgatcgccgtcaccatcgaaaataccgcaaacagatacccataccaatagcgtacgatataggtgtataactttttcattccctaatctcctccttcttgtcagttccccggtgtcaccttcctgtaaaacaaaaaagcgaggggacatcctgttacggattctcctcgcttttgcgtaaaaaaatccgtggcatctttcgatcaccacggtctatcatcaggaatggtattgtcacattttcacgccatccgcatcttctcatacggcatgtgcattacttctgaccgttactccccaccgaggcaatcatatgattctgctttttcacttccacgacgttacttgtaattctactcataatgcttacctctctttccttaaaatttagattacatgttgtcttacaaaaaccagtatacgcatacctctttttaaatgtcaagaaaattctcataatttaccattataatatttgatttcgtgcaaataataggattaggaattacagtaattcattattgtactcctaaatcacaccggaagatgttccgggaaaacagacgacaatatggagggaaaaaccatgagtggatctagcaattctaattccggcacaaaccagatggcagtgccgcaggcaaaagaggcaatgaaccgttttaagcaggaagttgcaagtgagatcggtgtaccgttaaaggacggctacaacggcgacttgacttccgcacaggccggaagcatcggcggcgagatggtcaagaaaatgatcatgaagcaggaagagcagatgtccggcaaataaaccggctgcttctgccgattgcacaaaaacgggactgtcgctttcagcagacagtcccgtttggcgtgagaagaaataggacgagggaatcatgcccttcgatttcagatggaaatgcggatggaatattctttgtgaaaaattgagagcatttctttctgccagatatttgcatcggattccgtgtctcttccacgtttggacaatccgacggggacatgtccggcacaccaaagacaatgggcggactttctagccgccctaactgtactccctcatagacactataaaaccgcgcgaaccgaaactcgccgtcatctgctattaaaaacaaggcagataacggctcagacatcggcttcgcgcggttatgttttattgcgacataaggatggctgatttatgccatccgttgtttggtactggcaagcgcggcacaaaagtcctacaaattgtcttcggggtgcggacatgacccgtggagtgttccaaacttggaaagacacggatcatcgcggatgcaaatatccagctggttagaaatgccgcatttttgaacagaatttccatctgcattccatctgaaatcgcgaggcatgatcttcttgtcctattacttatcattccattacgcatcacgccaaatgggactgcccgtttcacgcggcagctcctttttgtgctcttttatttttcgtgcatccagacgcgcatctggtttaaaccgcggttgccccatgcaaaataagggatcgcacgaagcgtaaccgcttcttccttcggcggttcctcggtatagagttcctccgacggcacaagccggatccccgccacatcgagcagtgtgagaccggaaagcttgccttccgtgcatacgagagcctttgcatccagttctttttttaccgcaagcgcctgcagataggctccgttgtcagcgccctcaaagcagtagaccacaggtccgcgcatcagcgccacgcatccgacgtcctcgcgcacatgcgtactcgcataaattttgcgcaccggcagtggaaaatgaagttccacctgatcgtcgcttccccattttctgctgatatacaaatagccatcacggatttctccggcagtatcaaacgcctccccgttgaccgtcacgcgcaggtctttcacataagccgggatatgaatggcaagtgtaaagagttcgtcgatcttcgcggacacatggtaggtcacgcttccctcccacgggtatgcgctctccacgcggatgtccgccttgccgagcgccgcctcctgtcccagaaacagatgggagtacaccgccgtctcgtcctcatcccacgcatattttccaagggaggttaccatgcggaccaggttcggcggacagcatgcgcacgcataccagcccggacgctccggaatcacatgtttgtaaccgaaaatctcgccggacacacccggattgacctccagaggattgacgtagaaaaaccgctttccgtcgagctgcataccgctgatgatgccattgtagagcgcccgctccatcacatcggcatatcttccgttcttctccgtctttaacatatttctcgcaaaaaagaccagaccgatcgacgcacaggtctccgcatagttcatatcgttcggcagttcatactcttttgtgaatgcctcgccctccacggtcgagccgatgcctccggtgatgaacatctttttctgcgtcatattctcccagagccgtctgcacgctgcaaacaacttctcatcgtgatcctccgccgcaagatctgccatcgccgtgtacatatatacggcgcgcacactgtgtcccacagcctcatcctgctcgtagattgtcgcatggctctggttgtactttgtgtcgtccgggatcatattgccaaaatgcgtccagcccctgcgctcggtctcctccttaaagaagttcggattctttccacgctcctcgaggaaatagcgcgccatgtccttgtaggcttcctttccggtcgcatggtacatgcgcatcagaccgatctccacctcctggtgtcccggaatgcccggaatcttatcctctccgaaccggttcatgatatgctgcgccatccgctccatcacgccgagcagcttgtcttttccggtcgcctcgtaatacgccactgccgcctccatcatatggcctgcgcagtagagttcatggcactctaacagattctgccagcggtgctccggctccttgatcgtgaaaaatgtattcagataaccgtccggctgctgtgcctttgcgataatgtcaatgatgtcgtccgcgcgctgttccaacgccgcatccggcttgatcacgagcgagtacgccacaccttccagccattttgccacatcgctgtcctggaataccatcccgtagaactcaccttccatcagtcctgccgcaatgcggaaattatccagcgcatggctcttctccacgccttcttctttatcgtttaataccctctcctgaaacggtatcacagtatctgtgatcttttcctgcataccgctccagaacgggtctttgatccgaatttgctgtaatgcaatctctttgctcatctcttttcccccatcagttccgatattcacgggtcatttccaattctctggcgagatcctccggcgtcctgtacttgcggaataccttctcgagcacatagtttttcaccagtgcaaacactcccggaaacagtacaatcaggcactgtgtatcgttgcacatcagaacaaacagcacaaacacagctactaaaagcgccgaccatcccagatttgccaccaccatcacaagcgtcttcttcatggactcccgtatggttccctcaaacctcgccatatacgccgtcaggtaaaactcccacgccagcgccatggcagaaagtacaataaaaaaataatacagcgcaccaagcgccgagccctgtgccagaaactgtctggtcaccacaaggtccgccgcaagaaacgctgccagtattccccacagcagccatgctcctgtggtctgtttcaaatccgttttcagagccgtgcaatattcccggaatgcatagccctgtccatgtacaatgcttttattgaccgcatggtacaccgccgctgtggcggctcccatggtaacgaccggaatgctgcatacaatccacagcgcgccgagaatcaggcagtccgccagtcctcccagtatgcggaaaacgttgttgttgtaatcaaaaaactgattcatatgccctccattccggtctaagccattcggttattttttcagacggatgcttaccacgctgcatgccggaatctgtacccgtatgccgtccgccgtcttctcgtaatctgcaaatgcctgctccgtcaccacttccggtgcctcaaacgtgttgtgtgcattcatcgttcctgccacaacactcgcctcgcatacgccgtatgcagcgccgtcgtccgtcagctggatggtcacattctccgcagcttccagtgaattgttggtcagtgtcaccgtgatcacgccgtccgcgttctccgatacagactcaatcaccttcggcagttcgttcttgcctgctcctacggttccagcaccgatcagatcgcttctgagaagagttgctccctgatgatgacgatacatatggaatacatgataggtcggtgtcttgatcatcttctcgccgtcggtcagcatgacagactggagtacattgatgagctgtgcgatgcatgccatcttcacacggtcggaatgtttgttgaagatgttgagtgtcatacctgccacaagtgcatcacgcatggtgttctgctgatacaaaaatcccgggttggttcccggctctacgtccgtccagattccccactcgtcaacgatcagaccgatcttcttgtccggatcatactcatccataatcgcaccgtggcggttgatgagttcgtccatgaaataacctctctttaaggtctggtagaaaatctcctccgtgaagtctgttgcgcttcccttcttattccagtcatcctccacctcaggaagtgtataataatgaagggaaagaccatccatcattccatggaaacgcggctcgcagtgatcaaagcaggtctccatcacctttttcgtccactcgtaatcatccacgttcggtccgcagcagatctttgcgatcgggtcatttccagcatagtttctcacatatgtctggtatctgcggtactcatctgcataatgctgcgggcgcatatttccgccgcatccccagttctcattgccgacaccgaagtaatcgatcttccacggctcctcatgaccgttctgcttgcgcaggtctgccatcggggatacgccgttgaacgtaatgtactctacccactcgctcatctcacgaaccgtaccgcttccgaggttgccgttgacataggtcttgcaaccaagctgacggcacagttcaaagaactcgtgtgttccgaagctgttgtcctcgacaacgccgccccagtgtgtattgatcattttctttctggatgctttcggtccgataccgtccatccagtgatattcgtcagcaaagcatccgcccggccagcgcagcaccggaatcttcatttcttttaatgcttccaccacatcggtgcgcattccgttgacattcgggatatcggaatcctctccgacataaagtccctcataaatacatcttcccagatgctccgagaaatgtccatagatttccggagcaatcgtgctcattttcttgtcgttattgatgactaattttgccatagtaacctcccgttatgtatcagtccctttcgagtttttgctgtcattgattcacatcagccctttacagctccggctgtcattccttcgatgatgtacttctggaagatcaggaaaatcaccaggatcggcaggattccgaacatggaaccggcgatcagcacatcatagttgtttccgtacggcgtcagcaatgtatttaatccgatcggaagggtgaacttttctgctcccttcagtaccagaagcggccacaggatcgcattccagcttcccattgcctgcagaattcccatggaggcgaatgccggcttcgtcagcggaagaatgatttttgtcgcaataccgtactctgtcgcaccgtcaatacgcgccgcatccagaagttctctcggaagtcccgacagatactgccggaagaagaaaatcgtcgatgcgttacatagtccgatgataattactccggtgtaggtatcgatcagatgcagtgcaataatttccttatataaaggaagcatcagaatctcaaacggtaccatcattgtcgcaattacaaggaagaagaggaaattcttcagcttgaaattgtacattgtcagtccatatgccacaaagtagcagatgaacaatgtcagaacgaccgacacgatcgtaataaccagagagttcttataccacataaaatatttctgactgtccgcatttccggaaaacaggtacttatagttatccagattcatcgtacggatatcgagatcgatcgacaatccacggcggatcagctctgttcctggtctgaaagaggcaagcagacctgcgaataccgggaagataataatcaggcttaagactgcgaaaaatcctgtgccgagaactgttcccactgtccgttttgtcttgccgctcttcgggcccttatcgccctttctgttcttctcatctgccatgttatttctcctcattcttaaatgttccatttgcaatcaactgaacgatattgatagcaagtgcgatcactaacagcaccacgccgaccgcgcatgcatagcccatatcatttttctcgattccacgcttatacaggtatccaacgatggtgagtccgatgttgttcggtgagttgttgcccgcccataacatgtaggattccaggaacattgccagtccggcatagatggaaatcgtgagcacgtagaccgtcgtcggcttcaaaagaggaagcgtcacatagcggaacttctgccatgcagatgcaccgtcaatctcagatgcctcatagagggaggagtcgatcgccttcagtcctgaaaggaagtagagcatattaacacccgtccatctccaacatgcgactaccagaagagccgtcatacctgaccatcccattttcagccatttataggtgccaagacccagtgctgcggtaataatattcatctgtcctgtcgaatattccgtgaacatcagtcgaaataatgtaccggaaataaccacggaggtcaatgccggcatatagagaattgccttccacacaccttttgcttttaccagacggctgtccatcagcactgcaaaaagcatcgggaaaggaatcaaaagcaccaacgtaaacagcatgtattttgtactgttccagattgccgtgtggaatacattatccttcaacaacttctggtaattggcaagacccacccactctgatttgattgctccgatgtcctgaaaactcattgtcacggatgtgatcaacggatagatccagaaaaacgcaaagcttaaaataaaaggtatgacaaaaatatatggcgctactttttccgaatacaagaacttttttaacttcaactcaacaccctctccttcttatgaaaacagggatgccagaggagaaccctccagacatccccattcccaaaacttatgtcctactgctcaagatcgactgcatcctgtaactcctggagagcatcagatacatccatgccgtcctcaagtacctcatttaatgttgtgttgcatacatactcgttgattgtcgggctgatcgctacaacagagatcttaccgatgttgtccataccgatggaattcaatacatcgtacggatagtttctgaagtatgcgttgtactggttgctgtcgtcatgtgcgaaagcatcatctgtccagcatgcggtgttgcatacgtcgaatcctaatgtatcccagatattcttctcaccttcgtcagacatctttgcccagcaaaggaactcagctgcaagatctgtgttcgcagactgctgtgttacaacggtacctgtaccaccgataccaacggagcacttctgacctgcctcaaataccgggcacttagcaatgtaccagttgccgctctcctcaggcatatagtttgtaaaacggctcatgtaccataatgccttcgggaaagatacgatgttgtgatccagaatgttctggaaaccagcctcaaggtctacatgtccatccggagaaacctctgcgaagccgctgtctaaccaggactgctgcatctctaacattttctgaacggagtcaagctgaacgtttgccggatcatcgaatccaccggtccagtcatcaccgtactcagccattgccagccataaccagtctgtaccgcctgtatctacggatgtgaagtatttgccttcctcaccgattgctgccacatactcatcaccgagtgcctgatagtcatcccatgtaacaacggaatcaatcttagcggttacctcatcctcggaaattcccatagcctcagccatagctgccacgttgtagtacattacggttgcacctacatggtacggagcgccataataatgtccgtcctctcctgcgtaggtatccatacgtgctttaaccatggtctccatgtacggagctgcgtagtcatccaacggaaccagccactggtcaagacctgcaaccacgttcgggaactgtccaacctctacatcacagatgtccggtgcaccggttcctgcctgaagtgcggtaagaagctttgtgtgcatatcgctgtacggatatgtcgtacatgtgatctcgatcgtctgatccggatgctcctcgttccaaacctcagccatcttgccgtaatgctgtccgtgaagctctacgaatgtccacatctcaagatgtgttccgttcggatcaccgaatgtgttggtaacaacatctgactctgcggattctgttgcatcctctacagcgtcctcggctgctgcctctgtgccatcccctgttgtgcttcctgaatttgaagcagtggttcctgaatcagaacttccacatcctgcaaacagggatgtgaccattgctgcgcacatcagtgcactgaatactttccttctcatataattcttgccctcctccttgaattataggataataaaataagttgctaagatgatctgaaattcacataagatctcgtcataagctgggctcattagctatttcgacaatttctttgtttgatttcatttatcttatgtagataatatacaatgcattgtctgtggtgtcaatatttattttatgtttttccaaagtatttttgcttttcgctaaattatacaaaattatgaccgatcagtcgcatgataccgttctcattttgtgcaatatgacacattgttttgtttttatttaaatatttttaatttcatccttaatagttgacacttttctataacaattctataatagaaaactaataaagaacaccttaactatttgagtttttacaggaggatactcaggaaatgattcatattacttccttagacgatggtctggagacatttaaggctctcgggtctgacacacgtatccagattcttaacattttacttgaaaacgagcagatgagcatgaaccagcttgcgacagagttgaatatcagcaacggtgctctcaccggtcacatcaagaagctggaagagtgcggtctgatcaacatctccaacgaatctgccggacacggcaatcagaaaatgtgttccgtgacgcaggaccgcatcattgtggacatcaagaaaccgattgattataagaatgtatttgagactgaaatcaaggtcggacagttttccagacatcaggtatggccgacctgcggcatcgccaccagtgaatccgtgatcggcgagttcgacgatatccggtactttaatcatccggatcgttttaccgccaacattctctggttcaccaaaggctatgtcgagtataccataccgaacctgatcccgtccaaccagcggatcacgcagctttccatctcggcagagctgagttcggaggctcccggcatcgacaacaactggccgtcggatatcagtttttacatcaatgacacaaaaatcggcatgtggacgtcccctggcgacttcggcgatgtgcacggtatgttcaccccgcagtggtggccgcagaactggaatcagtacggtctgttaaagctgttagtcatcaatgattacggcacctacatcgacggtcttaagatctccgatgtcagcacactctcgcttcacctggactacagcagcgacatccatctgcgcctcgcggtcgaaaatgactccgagcatgtcggcggcatcacgctctatgggaaatctttcggaaactacgatcaggatatccgtgtcgccatcaattatgcgccgcttgtcgctgcgcagccgtagcgggggatttcttccgggcagttgtatagatagacattagctctgaaacggttgcggatgcagctgcgtgaggtattctttaaagcaaaatgcgagtatttcttccgtgccgcgtccggcatcaaattccgtgtctttgccacgctttgacaatccacaggtgtgtccggcaacccgcagacaatgagcggactttttagtggcgctaatgccacttcttcacagacaatataaaaccgcgcgaaccgaaactcgttggcatctgctattgaaaataaggcagatgccaattcaaacatcggcttcgcgcggttatgttttgttcatcagtggcaataagcgccacacaaaagtcctaaaattgtctgccggcttgcggacacatcctgcggagtgttcaaagcttggaaagacacagatcatcaaggatgccggacgcggtatggttagaaataccggattttgtgatcagaatacctcccgcagctgcatccgcaacctctttcgttcttttgttctccatacaactgtccgggatcatgtctctcccactacggctgtgcgtcgactaccgcttcttcgggctgcggatacagctgcggcactaccacttcttcttcgggcaccgtgacacggctgcggctgcgcgcagctccacatagcagccgcacgccatacaggttccggcattcagcttctcacaatcctgacagaccgcaagtctgctctcgtagacttcctctgtaacccggtccgccgctttgatcgcagcgcggtatttttcaatcatttccatactgtcccccgcctcgatcatatcccgaagcagacagcgcgtacacactctcgtctccatatctcatgcccacatttctgaatttttaccggcaatcctgctcgtcgaacccgaacaccggtcggccgtcctgccatctgatcttcataagcattgcatgacggttcggattgtacagcgggttgcccacaatctccgtctccgttctcgcatggtagaccataatgtcatctcctgcctcatccttcgtgaaggaattatgtcccgggccgtagattcccgctttttcactggatgtaagtaccggatagcgctcttttttccaagagagcggatctaacagatctgcgtctgcatccgccgtcatcatacccatgcagtaatgcacgccggtatcgctggcggaatacgtcataaatactttgccgtccttctgaatgaccgccggtccctcatttacccagaagccgtggcgctcccagtcgtaatccggcgttgtcagaagaacctgcacggaatccagcgtgtagccgttcttcattctggcgatgtaaagattggaaatctgcctgccgactcccactttttccgcccagatgtaataccagcttccgtttacctcgaagacggtcgcatccagggaaaatgcctcaaacgagaattcgtctccatctgcacgggtcatcttgcctttttccacccacggatcatgtaccgggtcatcaccctggcattccagcacatacgggcggatcgcccagatgtcgtccttatcgccgccggcatagtagagataccattttccaaagagataatgcagttccggcgcccagatatggatgctctgcggtccgctctcgtgcttgtgccacacctcatgctcttcggcatccgccagatccgcaagatgtgcggcacggcgcagaacaatcctgtcgtattccggcaccgatgcggtaaaatagtaggttccgtccgtgtgacagtacacataaggatctgccctctgcagaatccacggctcattatatttcaattgtttctccatctttttctccttataaagatccggctgagcccttgccggacgctttgcttttttattctgttttattctggtttattccgcgatatatttcacaccccagacactctggtttccgcccacggcagaaaatgtcatcacatcggtgcctgcctcgtctttcatctggcagaacacgccgctgtagtcctctccgtcaatcgtaatgtgcatatagtacgttccgtcaacagcttcccaggttcccgctgcctctcttccgacgactgtaccgtcagcattcagatacaggatcaccgggttggcaatgtcattgctgatattggttccctgattgatcacaaaatatcttccgaccacggcatccgtctcataaccggtaccgctcaccgtctctccctgtgtctgatacggcagttcgcacggccatccgtcctcgttcatcagcatctgatgtacgcgcggcgaatgattttccgtgccgttgttaaaacgggtatggtagaccagatactgtctgccgtcctcatcgatgaatgcagagttatgtccggtcgccatgtacgcgcgctctaaggacggaagcttgtaattgccggtcagcttcagaccgtaaagctgatgatccacatccgcggtcgggtattccccgttcatatccacataatcgccgtccacggtcttggaacggaacacgcgcacctgatagccgccgctgcttgtgagcgtaccgtaagatacatacaggtaatagtaatccgtcgcctcgtcatagaggatgtacggtccctcgatggatttgtgtccgcctccgagcaggcgttttccgtagtaggcatccacattgtgttcctcgtccgcctctggatgaatcacctgtccggtcgccggatccagctccagcaggaaaatgccgccgctccaggaaccatagaccatccacatgcggtcgtcggcatcataaaataccgtcgggtcgatcgcatttggatattcctcaaagttataactgttgtttctcacataattctttaacgcatattcctcatccacataatccagcacatccgttcctgtaattgtatccttgtcaaaaccggaatagataagcgctccctgccactcgtaaggcccctcgatcgtctccgatgtcccgtagcacagattcgatgcattccaggtggatgtcgtgcaatagtacatgtaatacagtccggtcttcttgttatagattacatctggcgcccagacatgtgttttcttatcatctgtctgaatcaggctgttcttgctgccagcgtaggcaaacgcctcgtctgccacaccatagatctggccgtagaccggattcgtcttgttgtatccgtccgcaatggactcccagtgcagcagatcttcactttttgctgcagacatatgggaaccgaagatataataagttccgtcttcctcatagattgacggatcgtgtaccgccaccccggaggaaacgtccccggtctgaatcccgtcgtagctcaccgtaaaattgtaatcggtattctccggcgtctcagactccgtcacattctctgccacctctgtcgttccacaggcagcaagtccggcggtcattgccgccacaagcagaacagaaatggttctccttccatttcgcataaaaaaacctcccatgatcttcattgcccagctttagctacaatatatcagataacaggaggtaatacaatatttatttttatttttgttaaagtattttacattttatcaaagtttaattcaaataaaaggttgccgccttcttatcgcttccgtcggtgagcaccagtttgccgtcctgcagcgtcagatattgtcccggcatgagcacgctctcaaaggaaactcccttcttgtcggacaatccctccatcgtgtggaatgtctgcgcctgcgccgtctcctccgcggcatccacatcctgtgccagcacaacggtgccgtctgtctgtgctgtcaggtacagtcccgacttgttctcggactggatggacacgtaatattcgttggatgcatccgcctttccgtcacagagcacccatttctcatccgtcgacagatctccgagtccggttccgaccttgacatttttcatcggataatccacatccgccgatgaattgacgaatccctcgtgcgagagcatcgccccgtcgcccgtcgcggactgtaacgtcactgcggtaccggcaagtcccgccgtcgtctcctcgaagtaatcgatgctgccgtcgtcattgaaatgcagctccgtgatgcatgcgcttctgcggtaaccgttgcctcccggcagcgagccgttgtgatagacaaaatacgtcttgcctttaaaatcaaagaccgccatatggttcgtgttcgaggtcgaagtcgggtacattatgacattgccgaatgtccagtcaccgctggttaaatccggcgctgtcgcatatgccatgcattctctccacccgtacgcgtaaaacagataataatctccgtagtagttgccctgttcatccgatctgcggtacagccacggcgcctcggtgtaattctcaatgccgcccttctgatacatgatgtccgcatcgtcaaacgaagtaccgctggtaatctccccgtctccgttcatatccttgactgaaatcatatcctcattgagctcgcacatgaaaaacatgccgttgccccacgccagataccggtgctcctcaccgttttcatccgtctccacccacgccgtcggatcaatgtcattgaaggtggaaagctgcggcttcgtcacagaaccgcgcacaagcggttctccgatatcgacaaacgtgcccgtcggactgtccgccaccgccacaccgatcgactgcttgccggatttatcccagctgcagtagtacagataatacttgtcgttgtatttcatgacctgacttgcccaagccgatacatcatccttcgcccagtccacggtatccatcgtcatgacggttccctcagacttccagttcaccagatccgtggaggaataacacagatattccggtatctcataaacggaattcgccacctgttcgtccgtcgacgcgtcgtgtcccgtgtacagatacacggtatctccgtccaccagcaccgatggatctccgccataaatccgctctccgccgtcatccgtttttacaatcggattgctgctctccgtcctggcaagcgccacctcttttgcctcgccgcagccagtcagacctgccgccataaccagcgatgccgccactattccataaccatacatccccgggtttttccgtgcactctgccgcttccagctcccccgccatcttttcgtcgtcctgtctgtaaacatttccttctccttttaccgatctcagacgttctctgcaccgagccccgttttcacctgcagattaccatttacctgtaacgcttccatcgtacgacttgtatggtcatgtacacaagttgtattttatggagttgccgctttccgtgtcctgcccctttagcgataagtaatattataaaaagtacctgatacagatttcggatggaactgcatctggaacattcgttggagaaaaatgtgtgtatttcttccagccggatgactgcatctgattccgtgtctcttccacgtttggacacctggtgggcgcatgtccgacacaccggagacaatgggcggactttctggcagcactaactgtgctccctcatagacaatattaaaccgcgcgaaccgaaactcgttggcatctgctattaaaaatagggcagatgccaattcagacatcggcttcgcgcggttatgttctattgcgggagcacaggtaagtgctgcacaaaagtcctacgaattgtctcgcggggtgcggacatgccccactggagtgatccaaacttggaaagacacggatcatcgcagatgcagccaccggctggttagaaatgccacattttttgaacagaatgttccataggcattccacccgaaatcgtaacggtgtgcttctcataatattatttatatattacttatcgctaaaaggagcaatacacggaaagcggcagccccataaaacacgccgcatggagaacgctgtcagacgcctgttattgcaccacgtgatataccagtccgtccttgatgtgctccactgccgcatcatccgcaaaatagcggacaatctcgagcgcaaacggaattgcagttcccattccgcggcttgtgatgatgtttccgtccacaaccacggcgtcctcactcgttgccgcacccgtcagcttttcctcaaaccccggatggcaggttgcgcgtctgccctccagaataccagcagctccgaggacgctcggtgccgcgcagatggctgccaccagttttccctcgcccgcaaacttcttaatcacttcgtttaccgtcgcatggtcgagcagatgcagggttcccggcattccgcccggcagcacgatcccgtcaagtgcgtcataatccacttcctccgccacagcgtccgtcaaaaaggtcacgccgtgggaactggtcacttctctttttccgttcacagagatcatcgtaatgtccatcttcgcgcggcgcacaatatccaccacggtcagtccctcgatctcctcacatccgtctgccataaaaattccaattttactcatcgcaattctcctcttttctttttcttcgctttcgctatgctacgcagtgcacgctcgaaacgctgctcattcctcgctgtcgggctttcgctatgttacgcaatgcacgctcgaaatgctgctcattgcttattcacatggtaccacactttgcaaaaacgtgctatgatagaatcaatacacaatcaatgcatcagcatgtctgccgccagccggaacactccctgcggcagccggaaaggaattcacatggaaatcgaacgcaagtatctcgtcaagatcctgccggaccacttggagcagtacccctgcaggcagattgagcagggctatctgagcacgaacccggtcgtgcgcatccggcgcagcaatgaccgctatattctgacttacaagggaaaaggactcatggtccgtgaggaatataatcttcccctgaacgaagagtccttcacccatttaaaagaaaaaattgacggtcttctgattcagaagcgccgctatctgattccgctcggggaaaaatataccattgagctggatgtatttgagggagcgcttgccccgctcgtgctcgcggaagtcgagtttgagactgaggaggaagcgaatacgtttgtcccgcccgagtggttcggcgaggacgtcacgttctccacaaaatatcacaacagcaccttaagccagcgcaccttttcttcctgaaccggggcatcagcccaggcgccccgcctcctttaacaggcggtacaaagtcggatccagatggaactcctccatcatgcgctccacctcgccgaggtaccgcttgcggacggcggcaggcacgatcgctctcgccgcatcggatccgccttttttcactgcgcggatcagaaggttcttcggcgtatgggcaaagtctacaaattccagcacctgcgtcttatagccgcagcactcaagcagattcgcgcggattgcgtccgtggcaagtgccgcaaagcgctccttaataattccgtagcgcgtcatcagtcccagatcctccgactggatctgtccgtttaattcatgctggcagcacggcacggaaagaatcatgcgcgcgttccacatgatggcgttgtacagtgcataatccgtcgcagtgtcgcaggcgtgaagcgtcaccaccatatccaccggcgcatccgtgcggtatccgttaatgtctcccacctcaaaatgcagattctcatagccgtactttttcgcggcggcattgcagttcttaatcacgtccgctttcaggtcaagccctgcaatctgcacgtttcttttctgaatctccgtaaaatagtaatatagcacgaatgtcaggtaagattttccacagccaaaatcaatgatgtgaagtgtttctgatgtatcgtccccgaccgcatcaccgaccatctccaaaaaacggttgatctgccggaacttgtcatacatcgtgcgcacgacctttccttcgggtgtaaacactcccatatccacaagcggtgcaatcggcgttccttcctccagaatgtactgctttttgcggttgtggctcccgcttgcctttgccgtcgtctgtgcattctttttcgtcttgtaggttacttttccctttttagaacacaggtacatatgctctgcggcatcatcccaggcattgacctgcagatactgccccacggccgttttccctagatattccgccagcttctcgggcggtatgttctcgtgaaatacctgtttttccgtgtaggctgccgcctggtaataggattccttgcgctcaatgacaatccggcggtaagggatctccccacccgccggtttgctgataatgattttatatggtttggcctgcgcaatcgcagataatttttccatctgttcttccatgtactctcctgctctcgtatctggtcagcgcatccgctgcgtctcgtagcgctgctttgtgcggatgcaggctttcaactgctcatagcggtccgccaccggtccctccggaatcacaacatccagcacaaccgccatgctgttgatgagatggtcgtccacctcatcccgcatcgacaccagaatattatatttttcctccagcgtatcagcgtcaaaaaactgcatcagcttcggattcacctcatcggaaagcgactgctccatctggcttacccggatctgatccgtcagctcttctgcctccgtctcctgcacctcgtccgcaaacgatgccgtcgcctgtgcctgcttccgcgcctcagcccgctccatgcgtccgctgccagcgcccgcaagttcgctccggtccacgcgttcaaaacgataggtctgcgccgcatccggatatttttcacgatcaacctcgctcacaaacatggcgagcggtctcgcatatacctgataatctccgtagagagcctgataaatgaccagtttttctccggtctccgaatgtgttgccactgcgatgacctgataaagtctgtttttaaagtgacgatagatctccccgctctgcgggattctcactctttccattcctgtaaccttccttctgtccctctttgctgtcctgccgtatctttatgcacccatatccagctcataaccgttcagcattgccactccctccgcgataaaatcgcgctcaaacggcagatttgcctgataacccataatcatcagatcctccacctcatgcatcagttcactggcactgtcaatatcgatcgcgttgacgagttcgtgtgctcccgccatcatctgctgctccagttcatccccatcgttctcgctcacattctctgtggcacgttttaatatgtcattctccgcctgattaggctgcggtctgcggcagcctgccatggcagccccgcctgcactctgcgtccgctgtcccggcatccggttcgggcgcacattctgccgtcctgccatctggttcgggcgcacattctgctgccctgccatctggttcggacgcatgctctgctgccctgccatctggttcggacgcacgctctgctggcgcggcatctgatccggacgcgcgttctgctgccaaggtatctgattcgggcgcacattctgctgtcctgccatctggttcggacgcacattctgctgctgccgcggcacattcggtttcacacgctgtccgctcttcccctgtaatttctttatctcacttatcaccactacaatcacgatgatccatatcagtccgcccatagcttcccccttattccaatcctcttttgttcctatcattcatgcagagtccttcgccccacttattcttattatagtgttttcttttttgtttctcaaccagaactttcctccgcggtacagttcttctacatccactctccctttttgtttcattttgttattttaaatatcatcactatccaatattgcttttattttcgccttgtggtatgattttatcagattatttttccagatatggttatttaaaataacacgcaaggaggagatttcatgaggaaattatcatctgtgattctggcggacctcgtcaccagcaagagaaaagaaaagtccatgacgcagcagtccctcgccgaggcgaccgggatcaaccgcgccctgatctcaagaattgaaaaacaggattttatcccgtccatcccgcagttagagcagctgggagaagtgctcggctttgagccggacagcgttttcgctgataccgcgcacgacaggcttccctccccgtcaccgttacgcattgcggttgccggcaccggctacgtcggtctctccattgccaccctgctcgcacagcacaaccatgtgacggcagtcgacattcttccggaaaaagtcgacctcatcaaccggcgcaaatccccgatccaggacgattatattgaaaaatatctcgccgaaaaagagcttgatctcaccgccaccttagacggcgccgcggcatacaaggacgccgattacgtcatcatcgccgcaccgaccaactacgacagcgccaggaattattttgacacctccgctgtggaggcagtgatcgaactggttctctccgtcaatccggacgcggttatggtcatcaagtcgacgatcccggtcggttacacggaatcggtacgccaaaaataccataccgcaaacatcatcttcagcccggaatttctccgcgagtcgaaggcgttatatgacaatctctacccgagccggatcatcgtctcaaccgactccgacgacgagcgccttgtggtcgcttcaaggaattttgcagcactgctgcaggagggtgccctcaaggagaatatcccgacacttttcatgggatttaccgaggcggaggccgtcaaactttttgcaaacacctatctggcgctgcgcgtgtcctatttcaatgagcttgacacctatgcggagacaaaaaatttaagcacacgggacatcatcgacggtgtatgtctcgacccgagaatcggcacgcattacaacaacccgtccttcggatacggcggttactgtctgccgaaagacaccaaacaacttctggctaattacaatgacgttccacagaacatgatgagcgcgatcgtggaaagcaaccgcacccgcaaagattttatcgccgaccgcgttctgcagatggcaggatactacaactacgcttccgccaacacctacaattccggcatggagcatccggtcaccatcggcgtctaccgcctgacgatgaaatccaactctgacaatttccggcagagcagtatccagggcgtcatgaaacgcatcaaagcaaagggggcttccgtgattatctacgaaccgacactcgaagacggaaccaccttcttcggaagcaaggtggtcaaccggcttgacgagtttaagaagattagcgacagcatcatcgccaaccgctatgattcctgtctcgatgatgtaaaagacaaagtctacacgagagatttgttccggcgggattagttttatacaaactcctgccgcatcggggtaaagatgtctaagaggatgccgtcttccaggcagacgcagccgtgctcaatatcgttgcgctttaacagtgcgtcgcccggtttgatgactcttctgacgccgtctatctcgaattcaaagctgcccgacaccacatatgtgatctgcgtatgcggatgatgatgcagggcgccgaccgctccttttttgaagtggttttccacacacatcagttcatccgtgtacgctaaaatcttgcgttccacaccctcggcgcacacctcggcatcgatcctgtcattaaagttccacacctgattttttactgttttctccattgctccatctccctttttttgtttttatctgtatgcggcatttttcccggccgtctgcgtgttctgcccgccgcattacgatccctcttttaagatttcttcgatgagtcccatgtcatccccgcagtatttttcatataccccgtacacggcattctggaaccgttttttttcctcagcggaaagctccaccactttcgtgccgttttccatggcaatgctgcgcgactgctcctcgcgctgtgtccacacctcacgctcgtagatcgccgattctctggcacattccaggataatctcccggtcttccggcgacagtttctgccaggtatacgccgagcagatctgcatttccggcactctgctgtgctcgtccaccgtatagtatttcgcgacctcatagtgccgcatcgcctcgtaggacggccagttattctcggctccgtccaccacctgccgctccaggctggcataaacatccccataggcaatcggaatcgccgtagcgccgagcgcctccaccatatcaacggcaagatccgactcctgcacacggatccgcatgcctttcagatcctccagacaggtaaccggttttacggaattataaaaatttctggctccggcatcgtaccaggacagaccgatgacatcatccgcgctgacactctccagaaacgcatccccgatctccccgtcgagcaccctccacatatggtcggaatccgtataaagatagggcatctgcagcacattcaggctcggaatatattccgcaagctgcgccagtgacacccgcgcaaaatcaataccgccgtactgcatctgtttgatgactttattctctgacccgagcaccccgaccggctgcaccagaatccggattctgccgtttgtccgctcctccacgagttctgcaaaatacttggcaccgagtgtcgtcggatagtcctccggctgattttccgcataggaaaacacatattccggttccacctctgtcttggagggatacgtgtgatttttccaggcggacagtgtgagcagtatcgtcattcctgccacaaccgccgccgcgcatatccgtctcatcgctctcccgcctcctttaatacctgcatccggtattccgtcggcgtgacgccggcaatccgtttgaatacttttgcaaaatagttggaatcgcggtagcccaccttctggctcacatcctttacattgataaggacgtcacccagcagttcttttgccctcgccacacgatactccgagagatagacaataaaattcttgtcaaaacactgcttgaaaatcttgcagaaataggcgtcggaatagttcatggcctctgccaccgtctgcagcgaaatatcatccatataattgtgttcaataaacgcctgaatattcccagcaaccgcctgcagccggattcttgagcgctccgtatccgccgtgtcctcatgacagtcccgttcggcagagatctgctctgcgcttttcttctctccggcttccctgtctgtctcctgctcctctgcaatccgcacagcttcctcaagcaccgccaccagttcctgatcctccaccggctttagcagatattccatggcgcggaccgcaatcgcacgcttggcatagttaaattcatcaaatgccgtaagaaaaataatactgcagtttttatctctctctcgaatctgctccgctgcctccagcccgttcattccgggcatttcaatatccagcagcgcaatctggcagttctcggcaaaaaactgttccaccgcctctcttccattgaccgcactcacaaccgcaagctcctccgggaaatatttctggatggttctggttacaatcattctctcaatcggttcatcatccgctatcagcactcgtttcatgtcatatcccccgtttcctctctgcatggaatatctataaaaattactgttcccgcattctttttactgtatatctcaaaatttccgtccggatacatggcagtgatccgccggtacacattgccgagaccgattccgctgtgtctggcatcgtccgtcttaaggcggctctttaactgctgcagttcctcttccgtcatcccgatcccgtcatccccgatcactatgtgcagccgcatttccttctgtctgaccacaatgcggatgcttccgccttcctccttcggggaaactccgtggataattgcattttccacaagcggctggaaggtaaatgccggaaccatgaccagttcctgttccaccttacagtttaattcataacggatccgctccccgaagcgcatctgctgcaggtacatataatctgcaaccactttcagttcctttgccagcggaacggactgttcgggtgtctttaaattgtaacggaacagggaactgagcgccagaatcatcttttcggtcgtctctgcctcctcaagctttgccattccgctgatgacatttagtgtgttgaacaaaaaatgcggattgatctggctttttaacaattccagctttatcatctccaggcgtttctccgtctccagctttcccagctcctcctcatgcagaagatcaagagtcttcctcttttcttccagcgccataatgtactcgcctgtcgcgtatttcatcttgttgaacgcatgcaccagttcccccagctcgtcctcattctgcacctgcacgtcctccgagaaaaaatcattggcggcaatgcgctgcgccgctttcacgagcgccaccaccggcgagataatggtctggttcatcaatgccgccagctccatcatgccggttacgagaataatcccagataccacaaccacaatcggcatgcatatgagcatgggcacctttttatgatagaggccgtcgccgtcctcgatcgtctcattcatcagcgtcgccgcgtattcctcgagatagtcctgcatctcgtagacctcatacaggcgcttgatatagtccggcgcattttcccccatcgcaagcatggcgtcccgcttctggcaatagacttcataacagctcttgatcgaccaggtctttgcgtagcgctgctctccaatctcagaatagcggaacggaagcttttccaccgctcttccggttcgttctatcgcaatatccagactttctctctcctcgcgattgccctttatgtatgtctcaaactggatactctcttcctcgagcgcctgtgccagttcgctcaccgctgcgttatcctgtaaaatccggttaaagtcgatcagggaaaacttgacaacccatacattaaaaagaacagagactgcaatgatgagaaatactgtcccggtaaacgtcgctattttctttttgatcgtaagtgcctgccagaactgttttatcctctttctcacgcttgtttttcccatgcctctctgttctctctataatgcggcaaaagcaaagccgtagatacacactccgtaaatacagctttgcatatttgctttatctattctgttccactttgctctgtacaaaggaccaaaacgcctcccggtcggctcccagcacacggttggtcagcatatagccgcttccggctcccgaaagcaccagcaccatccccggctgttttgtaacccgcagccggttccacggcagatgctgtctctctcctccggttgtaacgagcagccccttttcatcaaaggtaagcctgacatcctgcggtacagccgccgcctgacgcctggctttcgcatagattgtcgccggctggatgaccgggaacagtaggcatccgatcagcatcagaacctgcaggacttcccccgactgactccagaactttgccgtaagaaggatcatcgccaccgtaaataccagattacacatccccgccatggagcggtaggtctgacgcatggtaagccggaaaaaatcccatgccgtaattctgcacttatattgatattccatatgccatctcctctgtattcacaaactggctccctttacgttccaagtaacatcggaagtccgatacttaattccggtataaaggtcagaagtaataatacaacgatcatacacagatagaacgggagggttgcttttaccacgcgctccatctttacaccgctgactgcagaaccgatgaaaagaactgatccaaccggcggtgtcagaaggccgataccacagtttaataccatgatgataccgaactgtaccggatcgataccgatggaggttgcgatcggaagtaagatcggtgtcgcgatcaggatgatcggtgccatatccatgatacatcctaaaatgagcagaatcaaatccactaacagtgcaatcacgatcgggttgctcgagaatccgatgattgcctttgcagccagatccggcacatgaagtgtcgtcaggcagtaaccgaaaatactggatgtcgaaattaagatcaggacgatagacaatgtatcaatgcactgctccaggctcttccagacacccttccaggtaagacccttgtaaatatatacactgacaatcaagctgtagaatactgcgatcgcagcggactctgtcgcggtaaaccatccggctacaacgccgacaactacgattacaactgctgccaatgcccagaaagaagttccaagctgttttaacagtctcttgacactgaacttatcccccttcggataatgtctctttttcgagataatataagatccgatcattaaggagatcgcaagcagtgcgcccggcacatatcctgcaaggaaaaggcttcctaccgatacaccgccggcggacattgcatagattaccatgttatggcttggtggaaccagcagtccctcacaggaggaagtgatcgtaaccgccgtcgaaaaatcatcatcgtatccctgatctaccatcatcgggatcatgatacttccgatggaagccgtatctgcagatgcagatccggaaataccgccgaagaaataggatgcaacgatatttaccatcgccattccaccggtcatccagcctacgcaggcatcggcgagtgcaatcagcttatctgatatacctccggtgcccatcagcacgcccatcgtgatgaagaacggtacagccatcagactaaaggaactgattccctttaccatctgctgacagatcgttgtcagcggaagtccctgcgataacaggcacagaagggaagataacgctactgcatatgcaatcgggaaacgcagcagaatcatgacaagaaagcttacgagcaacactgcgattgccatactctgtacactcattatttcgtcccctcctttacaaaaatactcttaatatgattataaattgcttccagttcaaaaacgaccatcgctacgccggcaagcggaatcgggaagtacatccagaacttggacagccacggcatgctgacgtaattacccttggctccaatgcctgtcgcatagctgaatccaacggtaatcatcacgatcgccagaataaagacggcgacatctgccagaatatccaatgccttaataacatttttcggcaggtatgcgtcaaacgccgtcatacggatatgtgcatttctgcggattgcaagtgccgccgagagcactgccatgtaggacatcagggtcagtaccacttcctcgctccatgccggatcgggtacgaaggaaacatatcttccgacaacgcagacactcgtgattacgatatctgccgtgagcagcaatttgcatacaaacagtacaaacttatatgccacatcatatgccggctttattttatctaaagtctgaaaaatcttaggcattttttcctccttaaaaaagtcggggcacgggggagcagccattctccctgtgccccttgaaaacgcacttacattattgcgggttttccttctatcaaacctataagtgtcaatctttctgtcgattactgcatatcaacgatctgctgatataactctttgttattcttggttgcctcttcgatgacatccttgcaggcatcctgccacggtgtgatatcgtctacttcaataacattaacgccgtctgcctttaactcctcaaggatcttatcctctgtctcctgggagatctgacggttgtactgggaagcatactcgccggcctcggtcagcacatcctgctgctccggtgtcagggaatcccatgcttcgtctgtgataactacctggattgctcctaaggtatgtccatcaagaatgatgttcggtgctacttccgggaatgcatttgcctgatagtttgcgatcggctgttctgctgcatctaccacaccggtctgtaatgcggaatataactcacccatggcaacaacggtcgggtttgctccaagtccttccaccatacctgtcatgatcgggtcgttggatacacggatcttcatgcctgccagatcatccattccctcgatcggattgacggtgaagaaatggcggaaaccttcctcgccgtagaacagtccgcggataccggttccgttctcatgcggctcaagcaggaactcctgtgccagatcagaggttgcaaagttccagaaatgatcgcggcttacgaatgtgaacggtacggataagagactggatttctctccgccgtagcttgtgagtgcgaatgcggaaatacgtgccatatcgatggtaccgccgccgccgagcatggtgtcgagtacatcggactctgcaccgagaacaccgtttgcctgaatatcaatcgtaatacttccgccggaaagctcttctaccttctctttgaatgcggttgctgtctgtcctacaatggttccctccagcgggtttacctctgcgtataccagagtcactgccggtccgaccggctctgttcctgtggaatcaccggcctcggttgccgctgcgctatccgttgcatctgccgttgcatctgccgctgcatctgtgttctggcttgtcgtcgtgtcggcagcctctggcgctttcagtccacaggcggtcatggaaaccaccattgctgcacataacagtgcggataaaacttttttcttcatgtaaaaatcctccttcttctcctcccgccgcgcttcatccggcggctttgtttatgtcttaattataaagttctatcctcacaatggaaaccgtacatttttattaactttagcacatttttaacaattttaatagtttttttatatttatatggtcaaaatattctatttctttctgaaattctaacgatatacagatgaaatgcacaaaaagagccagtacattgactggctctaatatcttggaaatatcttacagtttattttgataattctccaactgatggaaaatgccaacaacatttacggtatccgccttcacattgaaaataataaaatagttcatctgcggcagaatcgcctcgtgataccctttcccggcaagatatacgtctttacattccgggaactgaaatggattatcctccaaccggtcatagacagcatctatacaattcagcaaatgcttcgccgcctgttcgttcttcagacggcaaagcaggtgttgcattaggttgtcaagcaattcatcggcacgctccgtaatattcaatttataagccatacctcgccctcatttcccgcactgctgctctggcatccttcacctgtcctttttctatctgtccctcagatagttctatctctctgtacatagcgatttgtcgcattgttgactcataaatctccatgctcataatgaccatatcgccataaccattttttgttacatagattggctcttctgacttgtgacacatatcggagatttccgatgtatttttcaagtctttaatgggaattatttgtggcataatatacacctcctcattgatggtctaattataccataattatgtcctttttcaacttttttattccatcaaacctgcatagccaaacgaacagaactccatttactccgcaaatgtctccgccactttcacaagcaggtcgcggatcggcagatgctgcggacattgtccctcacacttgccgcagcggatacagacatccgcactgccgccgtcagcggtatgccgccggtaactgccgcggtttgtctcattgatcccgaactgcacggtcatgttgtaatcctcaaagacatccggaatcggtatcttttggggacatccctccacgcagtagcggcacttggtgcaggcgatcgtcggcatggcggcaagctcctccaccacccgggcgatcgccgcgcgctcccgctcatcaagcggtgtgaactctctcatgtaagccgtgttgtcggtgagctgctgctcatccgacataccgctcagcaccagcatcacattttccagtgacgccgcgtagcggatcgcgtaggaagcgaagctcgcctccggtgaaagctcccttaagatctctgccggtctgccggtcatgttggcgagtgttccgccctttaccggctccatcacgatcaccggtacaccatactttttcgcaacctcatagcatttgcgtgactgcacgttctccgactcccagtcataataattgatctgaagctgcacaaactccatctccgggtgatttttcaggatctcctcgagcgcttctgccgtatcgtggaacgaaaatccgatatggcggatgcgcccttccgtcttcattctctgcacaaacgcaaagccgcccgttttctctgtctcttccacccgtgtcttgttcatggcgtgaagcagataaaagtcaaaataagtcacgccgcagcgcgccagctgtctctcaaagatctcgctgtagtcctccgtattttgcaccagccacaccggcatcttgtctgcgagaaggaaacgctctctgtcatagcgctccaccagacagcgacgcactgcctcctccgacttctgattgtggtaagggtatgccgtgtcaaaatagacaaatccctgctccatatagcggtcaatcatcctgcagaataccgcgtcgtcaatctcttcgctattgccgtttgcgacgggcaggcgcatacagccaaacccgagcttcttcggcatgatctgttttaaatcttccataacatatctccttttacatcgcgcagaactgctcaatctcttccgcaatctcagaaagtcccgttctccagaaatccttctttgtgaggtcgattcccatcattgcgcctgcctcctcgatcgtgcagcacggggttgccgaaagcattgccttatatttctcaataaaagcctccccctctttttcaaactggctgtaaagtccgagcgcaaacagattgccaaaagcatacgggaaattgtaaaagctcagtccctcgctgtaataatgtcccttgcacacccacatatacggatgcatgcattccgggtccagcccgtcgccgtacgtcttcttctgcgcgtccagcatgatctgctttaaatcgtccgccatgaggaacttattctggctctgttcaaatactgccgtctcaaacagatagcgggagtaaatgtccacgatacactgcgtctgctccttgaggtcgttctccagcagattcaaaagctcctctccggatgcctctgcccgggctgcctttccgagatgcacctcgttaaaggttgatgctgtctcggctaccggcatcgggtagtcctgattaatcggtgcgtgattctcgatctggcggttgtggaatgcatgtccgagttcatgtgcaagcgtgtcaaccgatccgaaataaccgtcgtaattggtcagaatccggctctgttttaaccacatggctcccgcgcagaaagcaccgccctcttttccttttctcgggtagaaatcgatccactcgttctcaaacgcttcccgcatcagatctgccatctccggtgtcagctttgtgaatgtatcaataagatactgcttggcctcctcaatgctgtaggtcttatctgccttgccgagcggtgcaaacagatcataccacggcaggccgttgacatgtccgagcatctcgccctttttccgcagatacttgcggaataccggcaggtattcgtcgatcgccgccatcatagcgtctaaagtctctcgtttcatgcgcgactgctctaacgtcatggcaagtggtgaagcatagcctctcttttcgctgagcatcgtcacctggttcttaatgtaattcagggaaaacgcgatggcatcctccaccttctcataagcggcaatctccgcctcataagcgctcttgcgcacggaagcctccgggctgtacgctaagttccttacttccgacagtgtaatctgctttccctgataatccacttttaccgtggaggtcagataggactgcagcttcgaccacgccgcgccgccgctcatgttcatggaggcagccatctcctccacttcatcgctgagcagatgctttgcctctttctgcttctctttcaggtaaaatgtatgctcacgcacaagcccgctctcttttgccagcgcatccacgtcccggattcccgctaaaagctttcctgccgcggcctctaacggtgctatttttgcctgaagcttcatcagcttcgcattttctgccatcactgtgccgtcctctgtattgacggactgtctcaattccacatagagcgataactgatagaaaagctgtgcgatcccgctctgcgccgcaagcaccttctctgtcctttccttttcctgcatccttccggcatctgcaagcagtgtggcgagcgcatcgatctgcgccgtaagctctgccacatcctttccatatgccggatcatcaaatcctttataaagttcgtctaacgaccattctgttgtcattattcccctcctgtaatgtttttgcttcccaggacacctttcctgtgaagcgaaaaaagtgtcccaccgcttgcatgcggcagaacacttttattatagcatggattctatttctggtaaatctgaataaaatttgtgaccacttccacaagcttttcatagctcatggacgtcgtgtccagacagaaattataatttctggcgtcattccagtctcttccggtataatagcggtaatattccgcgcggtacttgtcgattttctcaatccgtctctccgcttccttctccgagaggccgttctggttcatcactcgtgcgacgcagtccttcttcggcgcacagaaatacagtttgatgacatccggatcatcccggagtaaataatccgcacaccggccgataatcacgcaggattcctgcgctgccagctctttgatgaccttcgcctgataattgaacaggttatcatcggacacaaaatccgaattctccggcggaatcacaccacccttgtacggatttttcttcaaaattccaaacaacggagaccgcttcaaccgctcgtctgcctgtccgaaaagtgcctcgttgatgccgctggcatccgatgccattcttaaaatttccctgtcatagcagttgattccaagttgctcagccaaaagctttcccagtgttcttccaccacttccatagcttctcgcaatggtaatgactgtttttttcattccattctacctccctgcattttccgtctattctcccagatatgccttcttaatagaatcattgttcatcatttccttcgcgtcaccggagagaacaatatttccggtctcaagcacatacgcgcggtttgcgatcgcaagcgctttcttcgcattctgctccaccagaagaaccgtcgtaccgctcgctgagatctcccggatgatatggaaaatctcctccacaaaaatcggggaaagtcccatggacggctcatccatcagaatgatcttcggcttggacatcagggcgcgccccattgcaagcatctgctgctcgccgccgcttaacgttcctgcaagctggttttttcgttcttccagacgtgggaaactcttgtaaacctttgccagcgattccgcaatctcgtttttgtcttttctggtataagcgcccagcttcagattctcgtagacggaaagttccgcgaacacgcgccgtccctccggcacatgcgccattcccatcgatacgatcttatgtcccggcaccttcacgatatcctgtccctcaaaaaggatctcaccctcggatggctttaacattcccgttatcgtctgaagtgtcgtcgtcttccccgcaccgttcgctccgatcagcgcaatgacttccccttcgtttacttcaaacgagatccccttaattgcctgaatgacaccataatgtactttcagattttttacttccaacattgccatagtcgttcctccatctatctcatgtcattctccaagatatgccttgattacctgcgggtcatgaagtacatcacccgtcgcgccctccgcaagtacctgaccgaagttaagcaccgtcagcttctcacagataccggacaccagtttcatatcatgctcgatcagaaggattgtcatatcgaactcatcccgcacaaaatggatcgtttccatcagctctttcgtctcgttcgggttcatgcctgccgccggctcgtcgagcagcagcagctttggattcgttgcaagtgcacgcgcaatctcaagctttctctgctttccgtatggaagattggaggacaggaaacccgcctcgcgctccagatcaaacacttttaataattccattgccttctcatccatctccgcctcaaccttgcggtatttcggcagacgtaagattccggtcagcgtcgagtaggacatctggttgtgcagtccgatctttacattgtcaagcacgctctgatccttgaacagacggatgttctgaaatgtacgcgcaatacctgccttgttgatgtcgatcgttttctttcctgtgatatccgcaccatccaggctgatagttccctcatccggcgtatacacaccggtaagcatattaaataccgtcgtcttgccggcaccgttcggtccgatcagaccgtacaactgtcctttctcgatggaaatatgaaaatcatctaccgcacgaagtcctccgaaggagatgccaagattctttacctctaacattgccataactatactgcctccttctttgtgtttttgcggaacttctgtgccattttctgtctccattcaatgcacttcggagcccagttgaaaagcatcatgacgatcagcacgatcgagtagattaacatacggtaatcggacagtcctcttaacacctccggaagaagggtcaaaagaacggctgcaatgatggaaccacggaaattacccataccaccaagtacgacgaataccagaatcatgatggacatattgtaaccgaagttcgccggcgtcgccgtaaccgtggaaaggttgtgcgcatagagcacgccgcccgctcccgcaatcgccgcagagatcgtgaatgccatcagcttgaacttggtgatgttgatgccgacagactctgccgcaatacggttatcacggattgccatgatcgcacggccgcttctggaattgaccagattgtatacaacaaataaagaaatcagaattaagatcacgcccgctgtaaagctggagagatgcggaatctttgcgattcccttcgcaccgttaatcagccagacaccgtcatctgcgagatcaatcgcgtttccgttcgagattgcaaagtggaatccgcttccgtcttttgcgatataaagaacgttgatgatatttttgatgatctcaccaaacgccagcgtcacaatcgcaagataatcgccgcgcagacgtaagaccggaatgccgatcagaaatccgaagaatgccgccatcgcagtgcccacgagcagcgcaatgataaagagcacaatctggctgccgatcacaccttccagcatcttggtgcagaaggcactggaaaaagctcccacacacatgaagcccgcatgaccgatactcagctctccgaggtatcccacgcacagattcagaccgatcgccacgatagagtaggtgcacatgggaacgagcagtccctgcatcagcgaagaaattgctccggcagctaccatgatctgaaccacaatatataccgcaatcaccaacacaaaggtgatcagctggtcttttgtttttttattcaccgtttttaaatttaactttgccatagctgttctcccttttgcattatactttctcatgaatctgttttccaagaattccggtcggttttacaagaagcacaacaatcaaaaccgcaaatacaatcgcatccgaaagctgggaggatatgtaggcacgtcccagaatctcaataattccaaggagaattccgccgatcagtgctcccgggatcgatccgattccgccgaaaacagcagccgtaaatgctttgatacccggcatggaaccggtgtacggtgtcagcgtcggatacgcggaacagaacagcacacctgcgatcgccgcaagtccggaaccgatggcaaaggtcagggaaatcgtcgcattgacattgactcccatgagctgtgccgcatctttatcctcggataccgcaagcattgcctgtccggctttcgtcttcttaatgaacatcatcagtgcgatcataatcaccacgcatgccagcacggtgacaatggttgtgccggaaatggtcaacgcgccgtctgccagctttaaggaaggcagggacacaacggaactgaatgatttcgtatccgctccaaacagcagcaatgccgcattctgcaggaaatagctgacaccgatcgctgtgatgagcacggcaagcggcgttgctcttcgcagcggcttgtaggcaattttttcaacaacaattccgagaacggtacatacgatgatggagagaaccaccgccggaagcgggctgatcccctggtcgctcattgcaaggaacaccacatagcacccgatcataatgacatcgccatgtgcaaaattcagcattttcgcaataccatataccatggtatagccgagtgcaatgatcgcatatacgcttcccagactgattccattgatcagataggataagaaattcataacaacacctctgtctttccttgtttaatacgttaaaacgtcagcagtttcacttattataacatgttacatacctgtatacaacttaaaaccgaaaaaagaagaggttccgcgccggcgggtagtcgcccccgccaacgcgccaacctctttattggcctttcctgcctgctctgttacattgctgaataagcaccgtctttgattacgactgccttcggcgccttgctgacctcgccggttgcctgccatgtcatggaatcaccagtcagaccgtcaacgctgatctctgtcatagccgactcaagtgcactgccaatatctgccacgctcatatccggtgtcacgcctgcctgctctgccgctgctttgataatgtagattgcatcgtaagcgtctgctgcgaactggttcggtgtatccccatatgcttctttgtactttgtaacaaaggactgtgtcttctcatcatctgcatctgctgcaaacggtgtcaagagcattacgccctctgccagctctgtgttaaaattctcaacaccaagcagtccgtccagaccgtcgcatccaaagaatgtcggagcataccccatgctgtctgcctgtgtcaggatgatggatgcctctgtgtagtagatcggaaggaatacaagctctgcacctgcgctctgtgccttctgaagctgtgtggagaagtctgtcttggaatctgcggtaaacgcttcttctgcaacaacttcaagtccctgattctgggcttcttttacgaagttcgcctcgataccggaagaatatacatcggaactgtcgtagatcactgcaaccttggctgccagcttgttctcaccgatatactgtgcggatgccgtaccctggttcgggtcggtaaagcatacctgaaatacattatcattatcgattacatccgtggaagatgcggacggtgtcagttcatacatgccgtcctctgcggtcttctcaacaactgccacacagggagtcgttgtaacggtacccatcagcatctgcataccccaatcctttaaggagttgtaagcattgacggatttctcggcatcatgctggtcatcctcaaacttatatgcgatctgatatccgttgataccgcccgctgcgttaatctcatcaacagcaatctgtgctccgttcataactgctgtaccgtagatcgctgctgctccggtagtcggtccgataccgccaatcttaaatgccgcgccatctgccgctgcggctcctgcgctctctgtacctgccgctgcgccgttatctgtggtcgtaccggatgctgctccgtcggaagagcttccacagcctgccatcatacttgcagccatcgctgctgtcaacaatacactcaatgctttcttcataatattgtcctccctcaagtgcctttatcttttctgaaataatagcaaaattagagaggattcacaatgttaaaattacaccaaattcttgatttattttatcgtatgattatgcaatttgtctttttcaataaccataggttatattgcgtattccaggcggctatattgtccgttcttctgcattttttaactgtttgacgggctttcttccgtgttgtaaatatacttgcgcgtcataaaacgcaccgtctgctccgcctctgcccggcggcacagttccagaaaccggttccagaaacgctcgccgcagtaatccaccagatagctgttgcgctgcgcattctccatctcccgcaaggatccccggttctcatgtccgagataatatgcaagtgcgaagaaatccggctcctcccagcctgccgcatccttcaataccgccgccacattctcaagctcactccgaagcatgatcgctgccagcttgctccccgcctcggtctgcgccttcgccgcgtgctcctcatactccgctgccatctgttttaagctctgaatcgtggactgaaaatcgagatcgtcatcccggatggaacaatcatgatagacctggtccagatctcccatcagctcgtccaggctctttttgacttcacttaccgggctttccttcatgcactccaacagacgctcaatcgccgccctcgactgcgcaaggtggcttctcgcctcctcatactgctcccgcagggtatccccctgttccaacgccgcctggtaatcccgcagcgcctcattcacatacgccttctcgccccccgcattcagaagactcttttttaagtccttcagctccccttttagctctttggacttctttcctttcgctgttctgtcaaacaacatttccctcgctccttctcccgatctgacatttctaccctttattatataaaacccatccgtcatcttcaagccaatttcaaacgaagaggctgccgcttgaagcggcagcctccccggatagataagtaaataggataaaaagatcacaccactcgatttcgatggaatgtagctggaaatccggatcaaaaaaagcggcatttctagccagccgaatgtctgcatcttcgatgatccgtgtctttccaagtttggagcactccgcgggtcatgtccgcatcccggaagacaatttgtaggacttttgtgtgtgtcccttattggcaccagacaacagatggcataaatgccacctttatgtcgaacaaaacataaccgcgcgaagccgatgtttgaattgccatctgccatgtttttaatagcagatggcaaagagtttcggttcgcgcggttttatattgtctgtgaagaggtgccattagggacaccagaaagtccgcccattgtctccggtgtgtcggacatgcacccgtcggattgtccaaacgtggaagagacacggaatctgaggcaaacattcagccggaagaaatgcacgcatttttttcaacgaatgttccatctacacttccatcgaaatcgaaagatgtgatcttttatcctagtacatctctttcgacgtcagctgtccgcttaaggcggcagcccctcgtctatttttcatcatagagatgacattttaccttatgtccgttgccaacatccttgacctgcggctcctcgtgcttacagatctccatgcactcactgcagcgggtgtggaacttacatcctgcaggcggattggccggggaaggaatatcgcccttcaaaaggatacgttcctttctgacatccggatccggcatcggaatcgcggaaaacagcgctttcgtgtacggatgcagcgggtttccgaaaatatcggcagtctcgccggactctaccatgccgccaaggtacataacgcccacggtatcagaaatatgctctacgacagacagatcgtgagagataaacagataggtcagtcctctctccttctgcagatcgcgaagcaggttaatgatctgtgcctgaatcgacacgtccagtgcagataccggctcatcgcacacgatgaattccggattcagtgcaagcgcacgcgcgatacagattctctgtctctgaccgccggaaaactcgtgcggataacgatccttgtgatactcttgtaatccacagtccttcataaccttggtgatataatcatcaaactgctccttcggcacgagtccgtgctcacgcactgcctcaccgatgatctcaccgatcgggagacgcggagacagggatgaatacggatcctggaaaatgatctgcatctttgtgcgcagatcgcggagctgcttcttatcgtacttgctgatgtcctcgccattgaagagaatctcgccgtctgtcttctcgatcaggcgcaagatcgttcttccggtcgtggactttccacatccggactctcctacaagtcccatggtagtgccgcgcttaatgttgaaggacacgtcatcgaccgccttcacactgcctgtcgcaccgccgaagaaccctcccttaatcgggaaatactttttcagatgagacacttcaagaatattgccgctctgattggttgtctttgtcgcttcgttattgctcattcttcgtgtctccttccttgccgactgcctccgccgcacagcggtagcagcttacaaaatgtgtcggggaaatctggtacattcccggatatgctccctcacagccgtctacgcacatctcgcagcgatccttaaagtagcagtagttcggcatatcaatcgggttcggaacgcttcccggaatgctgtaaagcttctccgtatatttaccgaccaccggctttgacttcatcagtccgatggtgtacgggtgtctcggatctttgaaaatctcgcgtgccgttcctttttccacgacacgtcccgcatacataacgaccacataatctgccatctctgcaaccacacccagatcgtgtgtaatcagcatgatggagctgttgatcttatccttcagtccgcggagcagatcgaggatctgtgcctggatcgtcacatcgagcgctgttgtaggctcatcggcgataatcagacgcggattacatgcgagcgccatggcgatcatgattcgctggcgcataccgccggaaagctcgtgcggatacatccggtatacgccttccttgttggcaatgccgaccatctcaagcatctggatcgtacgtgtcttgacgtcatcctttgtcatgtccggattgtgaagtgcaataacctcatccacctgctcgccgatacgaagtaccggattcagggaggtcatcggctcctggaaaatcatggacatgtagttgccgcgcagcttctgcatcacagaagtcggggtgttgaccacattgtatacatgatcgccggtattaaagcggatctctcctcccacggtctgaccggatgggcgctgtaccagctgcattagggaaaggcttgtcacggattttccgcagccggactcacctacgataccgaccgtcttgccctgcggcacatcaaacgatacaccgtcgacagacttgaccgttccgatgtccgtgaagaaataagtctgaacgttgtcgaactcaacgcagttctccggattcttcatctttgtcacatattcctcctccggaatatgctttctgtttctttttttctcgatctcctgcgtaatcttgcggttctcccgcgcaatcgcgcgggattcttttgcggagatataatttgcgtttttcttcttattattaaatgccattcctgtcacctaccgtttcatcttcggatcgaatgcatcacgcagaccatcaccgataaagttatatgcaagtaccgtgagcaggatcaggacgcctgccggaacccacacgaataaatagttcgtcataacgtaagagtcgttgaccgcattgatgatacttccccaggaagccgccggatacttgataccaagacccaggaaactcaatgtggactcggcaagaatgacatcaccgattcccatacttgcgaatacgacaagctgcgggataacattcgggatcagatgtctgaaaatcctacggcttacgcggataccggttgcctctgccgccgtcatgaactcctgctctcgcagggacaagatctgtccgcggataatacgggcaatgctgacccagccgatgatactcatgacaatacacagcatgtagatacgtgtctttgccgaagccttgtagtaatccatgatcgaaccgaggatcagatacagcggaatcgccgggatacagtaaacgacatcaaccacacgcatcaggagggtgtccacccatccgccgaaaaatcctgcgataccacctacaatgataccgatgataagctcaatgataactacgacaaatccgatcataagggaaattcgtccgccgtacatcagacgtgccagaaggtccattccgttgccgtccgttccgcaccagtgctttacagacggtgccgcataactgtcgatgacacgcgtctcctggtaacgctggatcgtgtactgaccgttcttatccttgatcagataggtatcggtctcaccctgctcgtccgtatactcaaaggaattctccccggcagtcattgcagcctcagctgcctccttgaacgccggtgtcagcacgataccgctggagaccggattcatgctcatatccgaaacataggcatagtctgcgccctccgccgtatgaatcatggcagcgccgccctcgttttcaactgtatagttcacaccatccgcctcaacagtcttatcgccgtttgcgatcgcggtcagcaccttgctgtaaaaatcataagaaaatgttgtgccttcatcgaaagccgtcacagacttccggcaggcaataccaagctctgtcgtcgtgtacagtgtctctttcacaccggatgcatcgaacacatactccacaccgttgtaagtaaactgattctgtccggcagcctccgcagcgtcgtgctcctccgactttaatgccagcggattcatctgctgctctgccgcgtagatatggtatgtgtcgtcgtcgatcctgccaagtgccagtgtctgtccgtctctggtctcaaacaccagcgcatttttcgtcacggcaaggatcatcttggaatacacatcgctcggaagttccacgccgtccgccacgaacacctggaactcgtcaatttttgccgcaccggcgtagtccttcttcatctcttccgtgcggtagaacacctcactctgggaatacggattgaccgcacctccgacaaatgcaaacaggaacatacagacaatgataaccagtcctacgattgccagtctgttgcggaaaaaccgctttgcaaccatcattccgggggaaagtacgcggacacgctgcgcgtcatcaagcttcatattattcttctcgttctccatgttctctcctcctttctagttcacgcggacacgcgggtccacaactgcatataaaatatcggcaatcaggttgccaagtaagatcagtactgcggaaaacagcatgtagaacataacaaacggaatgtcaccctgtaataccgcctggtaagaggtatatccgatacccgggatctggaacagagtctctgttaccatggctccactgaagagtcccggcaatgtaccgccgagcagtgtgataatcgggattaagatattgcggaatgcgtggtaatgaatgacacgcttctccggcagtcccttcgcacgcgctgtgcggatgtaatccgcattcagcacttcaagcatgttggttctggtgtaacgcatcagggaaccgatgctcacgatcgtcagtgtgattaccggaagcaccagatgccatgccatatccagaatctgctgtccagaagagaggctctgatagttacgtccgacaatgccgtagaggtcgaaccagccaagctttacggaaaagacccattttaaaagtgttgcaacgaaaaagctcggaagagaaataccgaccagtgcaataacggtgatcgtataatcggttgcagaatactgctttctcgcagcggcaatacctgccggaattgcgatgatgatctccagaacaaaagatgccagtgacagtgcaaacgaataccagataacgcttgcgaatttggtcagtaccggctggttaaaataccaggaatcaccgaactgtccgtggattgcttttgctgcccagcggaaatatccctggatcacaccggtgtccagaccgtacgatgcatttaactgtgccacccattcgtcataactctttgctcccggtctctgtgacaatgtcagtgcctgctgctccacgaatgacgacggcatgcaacgcatgatcgcgtagatgatcatggagacgaagaacagtatgacaatcgagagcaatactctcttaacaacaaatttcttcatgattctttttcctttcctcgctgcttctgatgctaaaggtattttgcaaaaaggcgtcacgcatcctcttgcaaaatacctttaaatccctatgcaccatggcacaggttgtagaagaggggaacctgctcccctctccctccaccatcagccagttactctgatccttagttcatctggatcttctcaatctcgttgagatagctatagaaggttgtcagatcctgcggaatagaatccacattgacacgctgtgtactgaatacagaagcgttctgtctctgatataccggaatctctacagcgtaatctacaataaagtcaagtgcttccttataaactgccttacggtatgcctggtcagtgttggttcttccctccattaccagctcatccagctcgtcagagtagattgcatagtagtttgcgctaccgccttcgctgtgatagatctggaacatatccgggtctaaggttgcctgccatgctgcgcaccacatctctgcagtctcgctgtttaaagcatcccacatgatggttccgtcagccaggtcgttgattgtcagatcaaatccgatgctcttgagtgcctcggatgctgcggtcaggataccgaaggaaggatgatctccctttccgcttccgccgatcattacctcatagcttaacttcgcaccggccggagctgcggtcagcttgccgtctgttactgtgtaaccagctgcctcgaagaagccaagtgctgcgtcaagtgctgctgcatacttctcgtcatccgacataccgtctgtgtagatcgggttgccgtctacgtccttggagaatgcaacctcatagtctgcatcagacttctgcggtgctgcccaggaagtattggagatcggatagttgattacagatgcagcgtctccgtagtaagaatcgattaccatgtcacgatatacggaaataacggttgcgattgcttttcttaaatctttggactgctcagaagaaggatcatcgccaaccttgacattctgagagttgattccgatgtaaccataaccattgttgtcatacagagcggtggttaatacatcaccggatgcctcaccgttgctgttctcggagcagatctgcgccataacctctttggagatggacggatcagaaatatctaccgtaccctgaacaacacccggaagcttatctgcctcagcggtctccttgaactggagctccttggtagccggtgctcccttgtagtatgactcattcgcctcgagatatactgtcttgttctcgtagctcttgaaggcatacggaccagcgccgagcggagcagttgtcttctcgcggattgcagaaaggtcaccctttgtgaaaccgaactggttgttatcgtaatcgtactggctctcatcaccatagtaatgaagcggtgcaatctggatatccatggtctgaagtgccggtgcgctgacctctgtcagaacaacacgtacggtcttgtcatccagcttctggataccggagatatttgctgctgcatcaccggtctcaacaccctcggtagcgtatgcatatacatctgccggaatcagatcggaaagagcgcttcctgcggactcagcctccatagctgtgaagctccatccgtacttgtcaccgattgccataaagaagtctttcgctgttgcatctgcagcaagaccatcaaagccccactgtgctgctgcgcctgctacgtcaccctcttcgctgacgccgttctctacgcagtaatcaacgatctcctgtgcgaatgcagcaccgccgtcgtttacagcatcccagaatgcgttctgctgatcttctgtccaaaatgtgaactctgtgttatcctcgcctgctgctgcaagtaaagatgccagtgtagacataccgcttctgtactcttccataccctcgatcgggagagagtatacagatgcgcttccgtcataagtcggatcgcagaatacatagaaagagaagatgatgtcgtctgcggttaccggctctccatcggaaaacgtcagatcatcacgaagcttgaaatcatagtatacggttccgtcctcgttctctgtgatagtcagatcggttggtccgtagtaagtataatcggtaccgttgtacgaagtggtctcaccctcgataccattgtagataaactcaccggaacgatcgttgtaaaccagagaaatctgtgtcacatcaacgatgttctgatccggcacactctcagcgaagaatgggctgaacttctcgctcataccgtcatttgcgataacgagcggtgtgtcgctgccggatgcagccgtgcctgctgcctctgtgcctgctgtctcggttccagctgtctcgccgccagccttgcttccgccgcagcctgcaaatgaaccgacagtcagtgctcctgccagtaacaaagcaagagtctgtctcatttttttcataatatttcctccttataaaaatattatctatgttttaaccttataaaaggaaaaaacctactccattgtggcattcacaatcagaatgccgctgtaattgcggtcataatactttccgaagaaaaatgcaaccgccagaaacaggaaatgccctatcagatagatacattcgatccccatacggatcccaccacggtgcagcaccatgtatacaagatccagaaccgctccgattcccgtcaataccattgccccgatgcaggaacgcttcatacgaagcagcccagtctcataatgtgcccggtgcattcggagcggtgctccgatatagctgaccgcaccataaagcatgtatccaagcggaagtatcacaaacagatacggaaatacaatccatgccgtgcgggacgaatccgggtttaaaagtcccattccaagctcaatcacccacagcgcgattgtccagatgacatttaaaatgcctgtccgccgcttctgctgctcatcaaacggaagcacataaaaatctccctgataggacgttcttgtcaccagaagaccatgccggttctgctttaattcattttgataatccttttgataagggttcttgatcatcgccgcttccgcctcattgctctctgtctgtcatgcagcatagtgcaaaattaccgcgttattgtgctaaaatatttttgtgtaacaaaaaaaagtgacaatgaacctctttgtccactgaacacttcacaaaatacacttgtatgttgcacacgcacaacactttttttattatacataggaaactggttttgtcaatacttttcccgctggcacattctgcctcgtttcgcatgtttttacaatctcatttggttctatgcatatttttacactatgttttatttgttttttctactttttcttctattctgtgctgtttttctgtcatttttcattttctgatcctaatttctttatgactaaatatgcagttttcttttcccatgtttttccacgtaaaaaatcccggaacggattttactctccgttccgggatttctcttccctgtataagtatgcatcacctgcggtcatacataccagtcagttcttatgatgttatgctgtctttgttgcgtacatgaagtacttcataccgaataccgttgcgtagataccggttacgttagacttctgcatgtaaatatcattgtagtagtagatcggaactactgcccatgtatccatcagcatatcctctgcctgatgcattaagtcaacacgtgctgcaaaatctgttgtggtgcggatctgattgatcagctcatcatatgctgtccagtccggagaagaagataccggagtaccctttcctaactgcatatcgttgttaccggaatcagaggtaaagatctctaacatgttaaccgggtcgttgtaatctgcaagccatccctcacgcgcgatggtgaagttaccgctcttacgatcctcaaggaatacattccagtcctcagacttgatctcaaggttgataccaagtaatgccacatcctgctgtacggactcagcaactgcaatgtgtgctgtaccgtcgtttgttaagtatgtcatggagattgccggatctactgcgtatgtaccgtcaccgttgtctgtaaatgtgtatccagcctcttccagtaagccctttgctgtctcaagctcgccagcaccggtagctgttgcatcatagtaagaagtatctgctgtcttgaacacgccgccgttaccgtctgccataccttccggtacgaaagaatcagccgggatctgacctgtctgacctacgttctcaacgatgaactgacggtcaaccagtaagctgattgcctcacgcatcttagcagcctcttcctctgtcttgccatcgaagatcgggtcgtttacattgaagccgatgtaataggttcccaggttgtcaagaataccaaactccggattgacaccgtttaaggaaggaatctcatcgttcggtacggaatcaatgtagtcaaggtcaccgctgttgtatgcagcataggttgctgtatcatcagcgcttaacatgaagtgaagctcgtccatggttacgtttgccgcatcatagaagttcgggttctttacataaaccatgctctcgttgtggttccaggactccagtgtgtaagcaccgttgcatacgaaacctgcttcctgtgcccacttgccaggaacagtgccgtccggatcagcagcctctacggatgcctgatgtaccggatagaatgtcgggaatgccatcagatcgttaaaataagggcacgggctgacaagcttgatcacgagtgtgtaatcatccggtgtctcaactgccagtgtaccgtcatcgttgcgggcgattacatcgaacagataagcatagtctgctgctgtcttctcatcgatgacacgattccagctgtatacgaagtcagatgcctttaagtcatctccgttgctccacttggactcaatcatgtgaacggtgtactctgttccatcctcagatacttccggcatatcggatgcgagtgccgggataagattaccatccttatcataggtataaagacctgcgaaagagtttactgcaaggcagccaccgtctacggagctgtttaatgcaggatcaaggtaatccggctcacttgccaggttgatgttgagcacatttgtctcagcgtttgtggttgttgcttctgcagttgctgcagcctctgtgccagcagcggttcctgtggactcgcctgtacttgctgtggaatcagatgatccgccacaagccgtaagaccaagtgccatagaagcaaccagtaatgatgctactaatttcttcataatgaatcctccttgttttccgaaggaaaatgcgactgtcacaacaggagcagaggattttcctccaataaaatgatctatgttccacgcacctcttcggtaacgttgaaaccttacttattccagcatgcaacgaagtgtccgctgcctctgtcggaaagcggcggcatctcttttgcgcactgctctgtcgcgtatttgcatctggtgcggaacggacatccggtcggcatcttcagagggctcggtacatctccctccagcacgatacgcttgctgtgtctggctgtctccggatccggaatcggaaccgctgacagtaagctcaatgtatacggatgcatcgggttgccgtttagctcatcggcatcggcgatctccatcatttttccaaggtacataaccgcaatacggtcggaaatgtggtgaacgaccagcagatcatgcgcgataaacagatacgccacgcccagcttgtcctgcagttcctcgaacatatttaccacctgcgcctgaatggacacatccagtgcggataccggctcgtcacagacgataaacttcgggtttaccgcgagtgctcttgcaataccgatacgctgtctctgtccgccggaaaactcatgtgcataacgcatggcatgctcggcattcagtccaaccagctccatgaggttcaagattttctcacggcgctcttttttatttgcatataatttatgaacatccagcggctctccgataatgtcctcaaccgtcatacgagggttcaaggatgaatacggatcctggaataccatctgcatctgtctgcggtaaggaagcatgtccacatccactttcttgccaagcaccggcctgccgtttgcatcgacaatcagcttgccattctcatcatactgttcgccgctgtcaaaaagcaccttaccgtcgaacacaatacgtccggcagtcggctgatacagacgaagcagcgttctgccgacggttgtcttgccacatcccgactctcctaccagaccaagtgtctcgcccggcttgattgcaaatgaaatatcgtccaccgcttttagcggaatcgtcttaaatccctgatgcacaggaaaatactgttttaaatgacttacctcaagaaggttcttttcctcactcattactctgcctcctcctgtgcctcatataactctttgatgttcacccagcagcttgccagatgggtatcgctgatgcgaagttcttccggtttctcggaaagacagatcttcatcgccgcatcacaccgtggacagaatgcacagccagccggcatctgcagcaggttgatcggtgtaccgccgatcggcaccagcttttcgttcatattgtctgccttcgggatggaacgaagcagtcccttagtatactcatgtgccggacgatagaaaatatcatccgctgtaccgcgctcgcagacacgtccgccgtacatgacaagaatctcatcacacatacttgcaatgacaccgagatcatgggttaccatgataatcgccattccaagctttttctgcaggtcctgcatcagttccagaatctgtgcctgaattgtcacatcaagtgccgttgtcggctcatctgcaatcaggatatccggttcacagacaagtgccatggcgatcatgacacgctgacgcataccaccggacaactcatgcgggtactgcttcatacggctttccggctcattgacgccgaccagtgtcagcatctccaccgcgcgcgcccacgcctcttttttattcttatccgtgtgtaataatattgcctcgatcagctggcttccaacggtaaataccggatttaagctggtcatcggatcctggaaaatgatggaacatttttctccgcggaacttctgcatctgcttgctgttccatttggtaatatcctcaccgtggaatcttacctctccgccggtgatcttaccggtctccgccagaatctgcatgatggaatatgcggtaacggatttaccggaaccggactcgcctacgattccaagggtctttcccggctctaagttaaaggaaataccattgacagcctttacctcacctgcatctgtaaaaaaactggtatgaaggtcttttacttctaatatatatttattttcttcgctcatatccttatctccttaattcaatttcgagtcgaaagcatcacgaagaccatcacccagtaagttcaatgccagcacgatcaggcagatggcgattgcaggaatgaccaatctaagtgggtaggactgcatgccggctctggcgtcgttcgccagacttccgagggaagtaagcggtgcagatacaccaagaccaaggaaactcagataactttcggtaaaaattgcactcggtacctgaagcgctgtcgtaataatgataacggacagacagttcggcagaatatgtctgcgcaggattctggcattctttgtaccgatacatcttgctgccagaacgtactcgttgttcttaatggaaaggatctggcctcggatcagacgcgccatacttacccagtacagaagtccgaatacgatgaacatggagatcatgttcgttcccagcttttccagcaccgttccggtaatgagcggttttaacgtctcattaaacactaccgacagcagaatgataatcagcatgtccggcagggaataaatgatatccacaatacgcatcatgatgagatcgacttttccaccaaaatatcctgcgatggaaccgtaaagcagaccgatgatcaataccatgatcgatgccacaacgccgaccgacaggctgactctcgttccgtagattacacggataaagtagtcacggcttaagctgtctgttccgaagatgtgtgggaacaacttctcgccggtctcattcatatactttgcctcaagcttggaatattcaaacggtcctaggttcgctgcggatttgtcacgcacaccgttgaccgagataatctcggaatacttgtaaggacatatatgcggtgcgatgatgatggtcagaagaatcaataccagtacgatgatacttcccatggcaagcggattcttgcgcaggcgtctcataccatccttgaaaaatgtggtagactcacccatgacatcctgctgcttcttttcctcatctgtcgccttctcgaaatttgccttattgaatttgctcagatctacctgtgccgacagaatctgtctatgtttcaactccattacttctatccgtcctttcgtactttactcaaatgtgattcttggatcgacgaacttatatgcaatatcggtcagcaggtttgccacaaccatcagaattgcgaggaaaattgtcgttgccataatcatcgtatagtcacggttggtaatacttgttacgaaagacgatcccagtcctccgatagtaaaaatattctcaacaaccatggaacctgtcaaaatgtatgcaaccatcggtcccacgtaagtgattaccggaatcagcgcattgcgcagtgcatgtttgaaaatgactttccagcccggaacacccttcgctctcgcggtacggatgtaatcctggttcagggaatccagcatactggtctttgtcagacgtgtgatatacgccatcggataaacactcagcgcgatgatcggcagtacataattcggactcgtggacgaccataccgggaaccagccgagctttaagcagaacaccagaagaagcagtgttgcaagcacgaaggacggcatcgccgtaccaagtgttgtaaaaaatacgatcagccggtccggccagtgattacgcgtcagcgccgcaatgcttccaagtacaagcccagccacgattgccaccaatgccgccatgccgccaagctttgccgataccttaaaacgggaagaaatctcgccccagatatcacggccgctatgtaaagatacgccccagtcaccatgaagaagattattcatataaatcacatactgctccgggattggtttgtccagattatatctctcttccaggactttctgtgcctccgcactcgttgccttttccttattgaaaggaccgcccgggataatgttcatcacaaagaatgtaatggcactgacgatcaggatggatacaatcgccagcaaaactcgttttacgatatactttcccactttttttctctcctgcttcttgaaaattctttctcattttatcgctctagcattgcgttcttttatctgtctgtttctctaatgcaatgtcactttaatccgataaaatagtataagtgtattatactcgctcactatcatttgtcaaccgctaattgtatacaaaaatacatggatattacctcctttttctgtacgcccagtaaatacaagtgtttttcccacataaatactctgtccttttttttagaaatttgttatactttcttcaatcacattatctcttacagaaagaaggcagatccatcatgattcaaaatgatgatattctgaatatgaacttttataaaaaggaaaaatttaccggcagttatcagggaatgcgttacctcatccaaaaagatcaggaggaggatgccgaggacgaaaatgtaaaacatgatatttttcgcgtcaccatctggcccggtccttataattttgccagcaccgcggacgatctgaaaagttctgctgtctttccgtttacgccggagggcaaagagcaggtggtcggctggctgaacgaacagtggagtgcgcgccgcaccgaatggcccggccgttgaatcagtctctttctttatatgagcatctcgctgattcattatcactgcaccgtaacacagcaccaaaaaaagccacatacgaagtatacatcttcgtacatggcttttcttattctattcctattcacggaaacgcccgtaaaacccgaaaacttcacgccgtattctgcgctctgtctcctgctctactgcgggtaacaggagcttgaaaaggttcaagtcctgtcttccacttttctcctgctctactgcgggtaacaggacttgaacctgcacggtctcccaccagaacctaaatctggcgcgtctgccaattccgccatacccgcttatcagagaaataactgcttcccttggaaagctaccggtatattatagcgtgctggcagacagattgcaacttctttttggatttaagcctccggcttctcatagcgtgtccacactttgtccgcgccgcatacattcttcgtgccgtcctgctgaacgataatataatcgccctcaccgataaaggtacgtcctctgcggtgcttgatgtacgggcacacgatcgtaccgtcgggccgctcaatctttacgagcgaatccgtcacgatccatcccttggtcacaacatcggaaaacagttcaaaaccatcttccatcccttttcccacttcgtatttgtctacttcggactctaacggaattcttcgactcttcataggtctcctccttttccggtgatgctccctgcttaccttccttatattctgaacactttcgtccgccgcatgaaaacgcgggcgtccgtcctggcaccatattcacttctgccttcgcctacattataccatactgtccgaaaatttacatgccttttttcgtactttcgcactattcccatgaaacaacaaaaatccccgtgatgccggaatatgacatcgtggggattttcgctctatatgcctgccgtattccggcagcatttcttatttcttatttcttatttcttatctctttatgatctggcgatccgctccgcctgcgcccttcgcacaaaccggaatgcgccaatgctctcaagcgccttcgctgttgcaaagaagatgacggaatcaatcggccacataatcagattctttaatgcacgcgccggaaggatcaccatgaatgcctgtccatataacacggtgaggcacaatgtattcaggaacacattgcacaccagcatcacgataaacttggtggcaagcaccctcggcagtgtgagtttcttcttataatacatacagccgtacatgacgcctgccagcatcgtaaccagtgtcagctgcggacagaacggaccggtcggctttaagatgtatttaataatatcaagcgttccggaaaaaatgccgccaaccgtcggtccaaacaggtaggcaatgattccgttcgggatactcgaaaaaccgatgcggataaaattgccgtattcgatggagaacatgccaagaataatggcgatggctgccagcatagccatggtagtgatggttcttaccgattttaattcacggtaggaatcggtgaacaaagcgacgaattttttcataaaaaaattacctcctttgcagacctcatcgtactacaactggagataatattcttatcttcggatgcagcgggatgcgactcatgcaccgcaagaaactcttttcgtctggctgacaactccctgttcagccggcacttaacgcgcatgtgtctactctgcgaacaatatttacttgcaacggtaacagtataacataccttagcggtaatacaataggcaattctcactaagttttgttccaaagtcacaaaaagcggaaaacctttaccggttttccgctctccattccttagtgagacacgggggattcgaacccccgacaacctgattaaaagtcaggttgcgtttcctttattttcggtacttgcgcgcatgtccgtggacattttgcggacattaacagttttcgtgcagacagaaaagcatgtgtttctacttatttatatagaataaaaccgacaggatttctcccgccggtcatactcttacagtgcttccagtcccgctttccagctcatcttaccgacaattccatccgccgccagcccgtgattgctctgccaagtcttggttgccgattccgtgccgctgccgaagatgccgtccgccgccgcgccgatgatgatctgccatacctttaccgcattgcctttgctaccctttttgatcgtcttcatattgtaatcctcactttcttttgttgttgtggtgattttattggattcggtgacagtctgccctttctttttccaagtagccatgaacttctccggtgtaccatacaacctttttaactttgccggggtgctaccccaattcggcagctggaagtgcggaaagtctttcatagacttccacgcaccaccccattccagaccaatactctgcccgatctttcctaccttattaaataattcggtggaattattaaacgcgtcatcgggaacactgccatctccgtcaacatccattttcagataaaagtcaaatgcaactccccattgatgcatagaactgtatgtattgcctttggctttagtaacaatctttcccggcgttgtccttccctgtgcgtataaagcatcctgctctgctttcgttctcaaacactctccaatgccaatagtgattcctgcatctgcacattttttctgtaactgcgcaattttttcctctaaatctggatgtaatgccttaacatctctcatattctattcctcgctttctacttctgggatgccggtgatcgacattaacatggacagcacgccagccaatgcggacgctgacagaacatacttccagtccacctgtcccattgctgccgccgctccgattccggcaatcgccgcctgtgccatagtctttaccgctctgatgcccgcggctttcgcccatttctgcgtgtctactgatactctgagtacacaatttttcaacatactacttttcctcctctaagtccgcaatgcggtgattgataacttttacctgttcctcaatgaccggcacacgctgcgcaaagttgttgtgcatccttacctcacgggtaagctcgtccaacttgcagtccgtaaccgcctgcgccatctcaagtttgtggtccgtctttttctgaccactgctgaccgtcattacagtgccgatcagcgtcagtccgcctgttataagtgctgtgatgattgattccatatccttttcctctctttctttataataagtataaaccctgtcttatcagtgtttgcgccaaggttgccgaatatctgttccgtacgtcaaaccaatctttcgcactcctatatcgtctttagacagtccggttgatgccacacatagcatacaagaaataccatgacggcaattgggttgacttgtgggtaaaatagcttaagcatattttgcaccatagatatcaactcggaatatatttccttggtgcatcataacactatgggttccagcctgtgcttccgctgcagattggcatacatatatattgccccataatatttttccgtcactgctatagtattttcgcgcgacacgtccatcttgtgtaaaccgtaacccagaaaaattttcatttccggcataatgattttgtgcgagtaataattcttttgtatcataagcgttaatggtattcgcggaaagaatcaattcgacggatgtttggttggaatcaaatgtcaactttgacatattgagtgctgacctgaagctgtccatattaaacatatgtgtgtggggactacacccggcataaataccaaagttatcacgcagtaaaatgtctaaatgaatatcacacgtagtgttacttgtaagtatgcagcatccgtttaccaatgttacaaatttaacaccattttcggtgactatattccagtagtcgccttgcaaaccaataaagtatgcgccatactgtgatgcagatatttttttggcaagcaaattatttatctctgtttcggtatagtatctgccgtcatggtcacctgaactcttatgttgtgtgaaagcttggttttgtgacgagatcgcccccgttaccgttccgccacctatagaggatatgtccgtgcttccaagcatcttgtacaagtaccgcacatttttgaacatctgtgataccttagcaaaaagggacgaatgtttttcgccgcttgataattttgatacacttgtccatgctgacgctgatccgtctgccacatcactactcgtaaaagcgattgtgttctcggctgtatctccaccggttggcaccgcaccaacgttttctgctgtgagttctacattgcccctgcggaaagaatcttcttttgcgcccttaacccccgtcacaggagtacccgcaagcacatcccacttgccatccgatgttttatagatattcgcccctgcggggatcacactgccggctccctctttgaaatcgtccgtggtcgtaaactcatcggaaatattgtacatatccccggcggtcaccgcagttaatgcaggtaagctgacaaacgaaacggtacccatcggacgcaatgctcctgcaaaagattcggagatgcttttcgcctgccggtagtaatacgccgcgttatccgtgtcctctccctcccggcttccggtacctccgacggcgtaactctccgccttggttgcactcgccgccacagcttccgcttttccgacaatctccgccgctttctccgtagcaatctctgctttttctgccgcagtatcagctgactggtcggcagccgccgctttttctgtagccacctcggctgatctgcctgctgcttcctccgatgtcttggcattggcttcagatgccgctgccgcgtcctttgactccgcaactgctgtttctgatgctactgcattatccgctgatgtttttgcggcattctcgctggctttcacggctgtctctgacgccttggcattggcttcggatgctgctgccgcaaccacgcacgtctgcgcttcgtcagcatattttcctgcattttccgccatcgtctctgccatcttggcgcttgccgtggcactatccttggcggtatccgctacactgtcaatcatctcgattgcgtcgtggatggactgacgtacatcctttccatacaccgcctgcatgatgttctgtaagtatccctgtatatttgacatttagactccttcctgcgcttccagcgcgtcaactctgtcatttaagtgctgcacagctgcaatcagatccgcgatcaactctgttttgtcgagcgcataatatgtttttccatcctgatccggatactccgagcaaatcgcccaatcctcgtccccgaccgcagtcaatacctcctgcgcaatcagaccatgtcggtaatgtcccgcggcgtcatagttataaataaagcggcacggacgcagagactgtataagcgcagcgcttttttcccgatcaagggattctataccgtgtttcaaacgcttgtccgaataggattcccagccgtaggacgagatccccttaccactagaaagcatttgggcaatcgtattagcagacgtatctcgcactgatactgccgagtagctggcagtgagttccctcgtatcagccaccgaccgcaaaccgtccgttcccatttggactaaagttccctcacgtttaagctcgattaaattgtccgtgctctctgccgcttcgatatgtacatatccgcctgttattttggcagaactactctcgattgtgcccttaaaagtaccatcaacagcatacatatgaccttctgcgtctacgataaaattatcgtttatattgagcgtgccgccagtcaccttgatgttgtttgtagcaagcccgctcacatcaatcatggtatgtacattaccctgcgcgtcccgcacctgcatgacgccgttgtcattgctatagccgccaagcgtcagcgtgccgcccttgatccggtcagcgtacatcgtgcccgctgttacaaaatcagccacaatactgccatccattgtcaaggccaatccatactctccgttatatcctgtgtgcgagtatcccagtccattgatgttccaccgccacactttctgtgcagtgtcaatatctttggtgtccatgataagcaattccttgggatttcccttgtcatccatgttaagcacaatatatccattggtggcggtctgtatcagttgtgatgcattatcttttgcctgctggagtaaagcactctgctgcgggatcttttcatcgagttcgtttgtaaggcttgccatctgctgggtatacgacttttttagagtgttgcttaaagtgagtttgtttttctccggctcctgcagataggttgtcatcttctgcaccgggaaccatgcatccatgccgtaaggctccgcaagcgcattgaccgaatccccaaggtcaaacgaatctatatcactgttcatcattgagagatcaagcgcattaacctcaagtgttaataactcgtactgattttctgtaagccattcctcggcttttttcttgagattcgcgggcgtggttacatcatcccagtgcacaacctttttgatccagccgaacttctccaccgccgccggaagatacacataatctacgccgttattcacatccttgatgtcaaggtacgcatccaatccttcaaccgggcttttatcgagccgcgtgcctagcggtatcacagctgttacgatatctgcgccggaggcattgcaggcatagtccagcagattttccccaaactcgataggctgttcgcaggtcgtgccataatcctgcaaagtaaccagatccagataccgcttgccgtccgccttacgcacccgcagataaccgcccagccggtcgcataacttatcacgcatgcaggtaagcgtatcttcgtaattcgtgtagcgatatatactatcattcggatcttttaccgttaccacaccgacctcaaaccgcttcttttcctctacctgcgcgttgtggttattgataagcgcggtaaaaaactgtagtggagtctgatcctggtaccgcccctgtggctgaatagaatcatacaaaaaagctaactccccaacagcatagacctgctttaccatatcaaggctctcttccgactcgcgcacctctccataaaagatctcgcgtccatccttaaggatctgcaacatgctgcgccgattctcaatggcgttataaagcggattcggcgccggaacgtcacactcgaatgtaccagagtcattcagcgcctgctccagctttgcattagttactgcacactgtaggtctcccggataatataatgtttttccatcaagtaaaacttcataaatcataagtaaacacctcgatatctgatagacagcttaccgctgccggtaaactgcaatgttacatcatccgctccaatcttaatcgccgggaagcgatacgtgccgggaagcagcatgttatgactttttccattataggtaaccgcaaggcttgcactctcggtcactacaaactccggcaccgtcggcattccaccgccggtaaccgtaacgcttttaccattgctgaccgttattcctgccaattcgcggattattccggtctcaaaattgaacggatcccacaaccagtcatcatcactcgccgtcaagtcatacttgaaaggctctgccgtgccgctcaatgtgatcgatgccgcaatattattgcttttcttcccgtcgactcccagacggcacatataataaaatccgagatcgttatccgggattacttttactttccggccgtggatctgcatggcgatttccgtcattgctttcgcccacaggtcatagctgggttccatcagcacaaattcaaatttcaagccgctacgattctcgtaacacctctggccactcacttccgacagatcaatgctgccggacgctcccggtacggaaatcaaatttgtcttaaccgccggttgggggatgtacatggacagcatcttaaggccatattctgtcgtatgctttccatcgattgtcagtccaaactttcccatcaatcacgtcctcctcccgttaattttcccgatttcatcattcacataaggcgcaataacctttcctactggtctgccgtccatcgaaaccgtcataccgtctacggactgcctgaacactgcgcccatctgctcatagtcgatggtttctccacttacagttgatgacgccgctccgccggtcaacgcccccgccgtatttcgtaccgcatcccctggctgtgtaacggctgctcctgcaaacagctccggtcggatcacgccagcatccatcgaatctttcagcgtctcatacgggttgtaatcagccagtggtgcatccatgccctctacgcacatctcaccgagccacttaaactttttcgacggtgagtgaatttcaagtgcatctttcgcaccttggaacaagctgtttgccaggtttttaacctgccccgtcaaccaatcccatccaccactgatgcctgtccagataccatcaacgatatgcttaccgatttcactcatccttgatggcagatctttcagagctgctacaatgttgtcaaagaacccctttcctgcatctgatgccctttcccgcattttggcggcgaacgataaaatccgaccaatcacttttccaagtaatgtcgctatccgttctggcaactggctgaaaaatgtcacgattgaatcacggaaatttgttccggtctcaaccgctttcgcaaccatattacttgcccataccgcaagatctgcaagaatctttccaaaaaacgccgcgatcttttcagggagttcagaaaaaaatgtcacaatcgtttcggcaaattccggtattgcggttgtcgcccagtttatcagatcctgtccccacaaaatgagagaggtgagaataaacccgagccaatacatgatcgtttccggaagttccgacacccactgaacaaccctatcaactatgttagtcactgcttcggatacaaccgcaagtgcattattcccacattccgttaatctacttggcagttcttcaaaccacgcaactatttttccaataagttccggcaccacttcggaaaagaaagtctctactattttccatgcctgcgctattccatctgtaatgaaagagatgaccttttgaccaatgtctatccagtcgaaagcagacaatgttgtagaaaccgcttcaaatatctgtggtaatgctgcaatcaaatctggtatactcgataaaatacccgttattaactgccaaattagttctgctcccctttgtactatcagagggaaattttttattaggactccagatattgtaataattatctgtggaattttctgtataagaactggtaatgctttagttattccatctacaagcttactaagcatgtcaaagccccagtttataatatctggtgctctttctgttagcgtatctccaagtccttgtacaaaatcaagaaactttgcaagcgcatctggtagtttctctgaaaatccctttattaaattttcaagaagctctgcaccgatatcgattatttgcggcagcaaagtagtgcctaagctaccaaacccctcaataatgctattgcatatttctccgattgcttttaatatctgtggcagattatcaataatcccctgcgcaagtgctccaatcagctgcaccgcgaaatcaatcatctgcggagcaatatcaaccgccatgccgatcagatccggaagcgccgcggacaccgaatcaagcaacgcctgtgtcccatcgagaatggacggtaacaattcttgcaaaattcccggcagatatccggataaatttgttgcaatctgtgacagaccatctaccaaccgcggtgttgtctctacaatgcgcggtataagattgtctgcggcggtcaacgccgaatcaatcagattgtttagcaaagtatcgaagtcctgatctggatctgccatacccgtcagaaagttttcccatgccgccccgagcgatgctatactgccctggattgtagtggacgcttcctttgcggtcgttccggttatatcaagattttcctgtacaacgtggatcgcatccacaatatcagcaaaactatcaatactgtagctggtcgcaatcccctgctgtgcattgatctcattggctgtcgcaatcaggcgctccatctcttccttggtgccgccatacccaagtttgaggttgtcaagcatggtgtagttctgctttgcaaagccctgatatgcattctggatatcacgcatatttgtgcccattttattggcattatccgccatatccgtgattgctctatctgcttttgtggctgcagccgccgtatctccatcaagactctgtaaaagcgacgccgaaaagctcgtgacggtgtccatataagcattagcggaaagccccgccgtcttatatgctatattggcatattctagcaccgtgctttcggattccttgaacagggtctccacaccaccgacaagctgctcatagtcagcatatgcctttactgactgcgtcgttgccgcagtcagtccggccgccatcgcgccggttatagcagtaaccgctttcgtggacacgctaaaagcactcgtagccgtctttttgaccgtatcaagccctgttgtaaatccttttgtatctaacgctgtctcaaatagcagcttgccatctgacataatcctcaccacctgtcacgggtggctctggatcgtgtctctggctcttatgccctactcaaaatacgcttcaaaattctgcacggtttgcacgtccgccgccgacattttaaccggaagcgcccacatttcgcgcaatctcttatactccttgtcgtcaccgttataacagcgatatccgataatctcatgtaactttgtcgcactgctaagtccattaagcaaagcccggaacttatgccagtgcatccctgtttctgtcagatcgatgccgtactgttgcaaaaatgcactgtaaatataatccgcatcgatccggtaatctaataccctgcttccatctccgccgccgctcttcggcacagtagcagacggatacgcaaagccgatgattgcctgcatatcctctgccgtgctgatgtgtgggatctcgtcggcaaacaaataactcacgttaaggctctgcttctggttccacatttcaaactcgtcgcaaaaccgcatccacggccggaaatctgtctcgatcaaaaaaggctcaccgccgatggtcacggtgtccggcaagcctttcgttatcagatcaatcatttcttcatcgccatgacgcgctggatggattctgcattcttcgccagagatccgatttccgccagtgcctttctggtatcagcatcaagctccggtttgttcgcttctcttacagggcgatcatactcgcgcgtgatgcggatgtacaaaatgttcagctcgttcagatccatttcgtccggatcggtggtgccaagcgcttttgcgacgttttcctctccaagcacatccgccacgaatccatacagggcatctacgcgatcatccaccggactttccgggttcgcgatcttctcattcacttcatcgatctttttcttcatcccacgggtaaagaccgggagaatgtatgttgctccattgtgttttactgcatactgcataatctacctccttaagctgtttttgctgattttgctgttgattccgctgcctgcgtttcagcagttttctcagcgaaagaaatagcatcgccggattttgttgcggttccctttgccacttctccgccgaacagtacctggaagtcaagcttgctgtctacggcgttgagatcctgcacggaaagcacggcatccgtcttccatgccaaatagccgccaccttccgccggttcctgcatgaacaccaccatacattccacgtgcgcatctgatccggtgcgcatctcgtagaaatacggccagatcatctcataatctttctctcccttgtacatcgtgagatcctcgtcaatgcttggcttgtaccgctttaactccgttgtcggcacctcgtccgcgatgtaatcataatcttccgtctccgggttcatggccagcgtaagctgtgtcgctttcttgacccgcacccagtccggcttctcggatgttccgccattcagaaacagcccgatcaaatgctttcttaccattcgtcttctacctctctttcccttgtatacgttatcttaagtgttacctggtacagcactgtgttattttcttttgcttcaaacatatacggcgtgccagccagttcgatgtcttcacaagtacggtggttatccagcttgggcagttccttcgtgtactggcaatcgtccacccagtacgcaaaattttccaaccactcgtcattgtcctccctgtcacggttttcctgcccctctctcaccacgaacagctgataccactctgtgatctgataagatgattccagaaaatcggttcgctctctggtcggagacttaaatataccaagactatccgtaccctcgccaacctgatccgtgtcaactctgacaacgcacatatcgtagcccttaagccactccgtaattgctttacttactgtcatactatttcgctcctgtcatgcgctttacaccacgcagaatagcatctttcccgccgtcctgcttcatgcgttcaaaccagagccttcctctttggtctgctccctgaaactgggcgttgatataataccaatgccttgcatatggtgtatcataaattacctcgccgctcccgatctgtgtgttacgtataccgcttcggatcaattccccggtatccatcggaacatacggttgacattttttcaacacctctgcatctatatactgttgaacccttccgctttgttcaagccctcttttttcaatgatttccgctttgtccatatgcatcgatttcagcgtaaaggtaaatggctctcccattacttgcacaccacctttatgtgtttcagcaggggcttgttccggttgtcggacacctctgcaactgtcacacagtcataatctgctcggagatgcttgatccggtactcatccgcaatctcggcaataacctcgccctgcacaattacgtccagatttccggcatcatccagcgtccagtagttctctgtatccgacagttttcggaattcatgcttcggaaggtattttctctcacacaccgccgatcccgggatcgtgatattcaccgtcgccgcgagattcacttttccatccgcagtcacggtttttaccgtctttccggttaccatcacacctttaaccactgttcgctgataccggtcatccggcagatggttgtaaaccgtgacggtatccgtaaatatccccatcataagcaccccatcagcccggtaccggaaagccactggaagcatacactgcggagctccgcgtctgcctgctcctttgtcacgtttgagtaactttcagaatacccatcattgctgaccgacgctatgccagatccggcgcccacgctgttctgatccgccatagcattgattaagttcgcaaccgccgctttcgtctgctcaagcttatagcctgtggctgtccgtgcgcggaaatgtgttaaaacatccacttttgcttctgctccggcaagcgccgcatcgaattcttcctttgtcagcttcggaaaatgggagctgtaatactcccaatcaatataatgatccaattacaactcccacctttcctatttctctgcctttaaggcttcgttctccgccttaagctgctcattctctgcctttaaggcttcgttctccgccttaagctctttcagttcctttttcagctttgtatctgcccttttatcagcaggcttctccgctcctactcctaccaatctcatgcgctcacctcctacgccttgctgttgaggtagataccggcgcgcttgtttgcgtaggcttctaccagaccatacttgcggtacttgataatgtccgcatctgcatccgggttcgcttccgccggaataatattgcttgcaatatgcttatcgaacttgatgactgcaggcttatggataatcatgaagttgatatctgccgcagatgtcgcctttttgtagtgtcccagttcctcgcctgggctcttaccgtcaagcatttcgattgcagtgtaaaatctcgcctgcggaactgctttcttcaccgcgaactttccgagaatttcgcgtgactttgttgtatccaaagccatcacgctgttaagcaaggttgctgttgcatataaaatacgctgttcctgcggcacctcatcctcgtccattttgctccacgctgtcagcagtgcatccagaaactgggatgcatctgcaatcgtaccagttgccttggaaataccgtcgagcgctgccagtgttgcaaaagcaaacgcatccgcttccggtgctgctttttcacgcatcagtgtggctcccgccataccaaatgcaaggttacgggattcctcgttatccatgacgtctacagaaatccttgtaccacggtcataattgaatgttgctgttttccacttaagatctactgcgccagtggtgtatccactatttcggtcgtaatcgccaagtccgcttacactgatctgcggataaacgatctcgtttgcattcgcgccagccttcgacattgtcggatcagacgtcagatccgatgttaccgatgccaggcgatacgcctcatcgaggtagttaatgtaattttttgctaaagcaattgtgttcggcattgtctttcctccttatttctgttctgtgttcggtgttggcggaagtcccataaccgcacgcattcttgcgtccgcggcatctaccccgccaccaaatacggctccgataatgttcccctgcttctgcacctgcggctctgcctcaccaaaaagcatcttgctgtcctcggcttctgacaattctttcagtgccgccgtgatatcctctttctggttttttgactttttcagcgtgtccacgtccagcaatgccgtgatcgctttcacatttctgcctttcgccgccgtaataccttccctaagagaatcggaaaaatcacgatccgccagttttccctggtaatccgtctcgatctttttcttttccttctccagatctgtgatctgctgcttcaatgcagacacatccgcatctccaaagtcttccaactttttcttcagtttttcagtcgccgcatcactcgccttgattttctcattggcgacagccagcttttcagtctggttgttgtagtcagtcacagtcttatagttttccagaacggctttttcaaagtctttctgtttgtcagccggaacttccaagccatattccttcatgatttcaaaaatgttcttcatgcatcctcctaaaatgatttgtgaatcgcattttctgcgataaggattgtaaacgcaaaaaagagccggacaacgaatctctaacttcttagaaactcattattcggctcttaggcgctattgttattaagctttcctgcttgcatctcttgcaatacaccgggaaacgctctgcttttgtgtcatccctcactctgtaagctttgggattaccacatatcgggcaactctgccacgaataggtgtgcttcactttctcaccccaccgtatagtatagcacacacgttctatttagtcaaaatatttctacaggaaacagcttttgcgctattccatgcagccgctccatctggttctacagtgctaaacacatacggttcgtctccatttttggggatgcacacattagcaaccccataacaagcagacttgcattgcggaacaaataaccaactatctgcgttttctcttatttcatgaacgccaacgtaatcattatccaggaaaaaaccatttgcaattttatatgctttttctaaatcaaccataaaatcactccttttcacatgcgtttactccacggcttgaaatgatggcattatccgttctaaaatatatcacttctttattcttaatatccaacccatttatattgtacatcatacctgtttgagggtcaacaaattccactttctgatctttgaaatatgctgaaaaagcatgcccatcacccgtctccctgtctttttcacaaacacatattctggcgttttctccccactctttcattttttctgtaacttctgcaacaatgtcatccttaacctctattttttctgcattttcccatgcaatcaaaggatcatttctcaacttagaatttgcctttcctgcaattacattatatccccggcatctcatttcatacgcgattgtcgaattaacacaattcgtatgatacaacacctcatttttatcatataacctcgggatttttacatatttagggttcgcaccttttaatgcagcatcagcatcttttactgttttattccaacttttgggaatcgttgcagtataaccactgtactgatctgaaatccatttcatggtttttgtcttgcttaggtcactgctccccgtctgtactctgagccgttccgttttcggtctgatatccacatccgaactaaatcgcttatagtccgccgtctgcttccgaagcttgctttgcagctcctttgcgtctccgccaagcgctctctgtgcttcaatctccctcttggttgctctgatctgacgttccatctgccgctgccgttgtgttgcgtggtaatagtcataatctctgccatttaccgtgacaggcgcaggctccggatcccattggttcggttctgatatcccctcgaaaaatacatagaagctatgacggcagttatacccacacagtccaagcggatcagacggatatccggtagcatcctccagattgcggataggataaccaagccgccttgattccgccctgtgaccgctccgatctgtcgtgtatactttgccctgccagtaagcatgatcgctgtgaccgcaggacccgtccgaccgcgcaccccagtgttgcgacacttccacaagtctttctcccgtcgagtccatattcagcatggttactttcccggcaagctgaccggatgccgtgcggatacaatttctgaccgcagtatcaagttgcatgctcctgccgctcttatagtcgatcgtccgcagtccgctctgtgccagttcccgcacacagtcattgaccacctgctgccacgaatacgctccgctggtcagcttaatcaacccaaggtcaagctgatgctgatatacattttcaagggctgtaaatccgatattcttaaagccgagagatttcgttagattcttgagttcgccgttcgtttgcactgccatagcatctacaagctgatggaacccggatggctgggacagactttttcccgcctgctcccacatagacagatccgcattaaaagccatatttccggcatccgccacaatgtcattcccctgctccttagcttccgccacaactctggagatctcgcttgccacatactgtttatactctttggtatgctctgccactgccatctgatactctttgtcagcacgcaggactttcatgacctcgcgctgaatccttgccggagaatacccctgttccatcaatgcccttgccatcagctcggctgtctccgtataccgcccggtcttttttacccggcgtgcaatatccgcgatcacatcctgctccagttcttgatatagtggtacaagcctgttcccgagcaattccagctgttcgtctgtcaatgccatgccttaatcctccgtttcatcatctgtgtccggatctgcctgtccctcctggtaatatttcgtagcttctttctctgaaagctgatagcggtccatcagataccagatggtcagcatcgggatctccctgaaagacaatgcatccgcacgcttgctctcaagttcgctctggcggtctgtcacatatgaatcatcaaaatccacagtgatctcctcatccagattccagcctgttccctggaacgtattggagaaccacagcactgccttgcaaatatccctgacatagttctccgcttcggtgcgctgtttgtttaactcctgcatggcatcctgccgctccccggcgtactccgttgcggtcttgatctgcccattttcaaagctatatttcttcgtcccataaccgaacatggacgaaagcagagacagacacagctcaaaggactttgtgatggaatccactctgatttccggattgatctcctgtaccagttctttctggtctggaagtttttcacctcccagcagaacaaacgttttcttaacctgctcattaggagtgatgggattcccggcctcgtcaaatttgcacaacagttcgttgaccagtaccagcttgtctgccttgtccaaatccccgaacagcacattaaagcacagatccacagctttaaggattccgattgccccgtagaccttcggatatccatatcccatcatgtgatcgatattattgacctcggcattccgcaggacagcgaacggctttacactgccaagctgcaccaccgtggtcacatcaggaagtagcgtgccatattcatcaaaaacattcgtttccgaaacatagttgccatgctcgtccttcacaaagtcaacaactgtcgtcctcacttttccgccaaccagtcccgttcccgcaaccgcggcttccgtcacctcatcattttcaactgtgagtgggataaaattttccgcagacacataattcagccggatgtttccaccgcgcaccgtattgtcggacataatatccgcattgtccagccgcacatagcaagccgccgttcctttggctgatacactctcaatctgcttacggaacatagggagaaagcgattctgtgccagaatatccaccagatactcatgttgctctttgttgttccctccgtttacctctgctatttcgcataaatttgcatcgtccgcgcagcatctttttgcaaatcccatccggttcagctgatacggagtaccgtgcaccgtggtacgctcgtggaaatcttcaatcacacgatttgcgtaccagttatcacattccttaatcactgcctgcgctttgctgttcacattgtagccctttccctttaaatatgtttccacaaaattttccataatccacactcctatctatccaggtcaacacattcaataaaatccaaaattgtataattttccgcgtcccaccagtcgttacagtttccgatattcttatcctccggtctgtctgggtgatccggatcccatttcaacttcccgattgcgctccgaagctttgagcacttccggttcaccttccatctgccagtattcatcagcatatcgtatgtccttggtctgtctgatacttcatttttccgacatcctttaatatgtcggtatggcagtccttcttttctcgcagcactccgcagactgtttatcatcgtggtgctggcactgtccgggaatacccagtcaataaaaccatatttttccatgcagtatttataaaactttatgaacttactgcatatcgcctctgcgtcaatgtacggtgacagttccaggtttgcttcctccgctgtcctcagatcatgatatccgtggaagtaaagcttcagcacaaaggttgtcattgatccgtttccaccaaagtcaacgcccattgtgattttggatggtctgtgtatcaatttcccttttatgtccctggcaaacaagggatccgtatcctcatcatacagatatggctcgttgtcctccgcgaacttacggaagataattccctctgcaacagcgcgttcgcctttaatatctcgcctgtaccacactgtacctttctgataggtgcttaacactttccggatctgctcgtctgtcatgctcatgttatccgccaaagtgaaatgtccgtagttatatccataatcaggattcttttcctgccgttcctcgtggaatttaaggatctccgtgtaataccagtgttcttcctctttcgggttgaggtcgtgaaatatcttacggtcggaactggaaagtgttcggtcgaatacctctttcagaaacttcggatggcactcgtttgcttcggtcacatacgccatcccgtaggtattaccctttatcagcttctcatctccatccttaccgccgccggatacaagtacaactttttcgcccgttttcgtctgtacatatacacaatcacgatccttatattttccttcccggcatctaccttcaaagtaattcagcaaaccatatccgtcacaatctaatatatttaattttgccgttgcattcgatacaccagccaccagatgaattttgttcttatgtgtttccagaagcgaacagaagatcagtgttgcaagtacgttctttccccctcgtttaccgccctccgccacgttgagccagctatcaaaacaccgcaggaaatattcatactgtctctgactgagtggtgccggtttattcatgatcctgcacctcctcaaaatcatctatactccggtttgcgaccgggtgccgcagaatatccgtaatggtttgcatattttcaaggatctgctctgccgagtcatccttgacctctgcgcgctttttatcaaattcagccttgtatttatcatctgggtgcatgaggaaatattttgtcagccagtcatacgccttttgcttatctgccagtttaagagacacaccgtctttcccctgctttacttcttgtataatttgggtgtctactttgtacgattcattcagcttgacagaattgacttcttttttcagtgtctcccccgtctcagaatcctttactggtccaaaggcgcccatgacatctaccttttccctgccaaacgacagataatcgccaatatccgcaaaggctattcgcatctgaatctccacaaaatcttcctccgtggctatgatctgctggcgcttgatttctttcagacgctcgatttcctgccgcaccttaacattccttaacaattcacttcctcgcaccatcgcgctttcatacttgcatccatatgctttctggtaactctgcgccgcattaaatgtcctgctataatatatgcaaaacatctgctgctccggcgtgagatcatcgttctgcaacgtctccctcgtgccatcatctattgctgtttcacttctgtttttttcctttgaaacgttgcgtttcgtttcactctttttttgaaacgtttcactttcgttatcatcccaccgatagcgattcttccatgtacggatcgtagccgcggagcaattcagctggtcagcaatgtctaccagcttcatgccgcccttatacaattcatgtgctttatccgccaatggatttttctttgctgccaacttctcacttcctctctgcaaaataaaaaagagccgaatacacgaaacttatcatagtctcatatattcggctctatggcgctatttttatggagcactacagtctagcattttgccagcattccgtcaattacaccttttgaacaatgctcccatgtaggatggcacaactcaccatcttctaattcaaatttaactatggcatattcccctagctcttcgtagcattctacccatatcatttctgctttatctattccaaatttttcagaaatttcattcgctagattttctgcccaatttgtaatgcttgttccgtgattgtcctcaagttccttggcgataacaatatttccctcaatctctatatcacacttactatcacacccacgcaaaccgttatatctatacaacatttatgattccccctccccttctaaaaataaattatactattttgttcttcgatattcaattaaatattcagcaaattctatccctccaccttcactctaatgtaatttttatcccttcacccttgaaaactagctgtcctgtttcatctgcataaatcgcttcatacgcgccgcccttgtcagcaacgctcacggcatcctctcggcttattaaaatttcttcgccttttttaactgtaattttcatgattttcctccttaatcaatcgctttcatctgcttttcatcgtacagctcgccacagaatggacaccgtgacaataatactggcatcttccgttctctcttctttcctttttcctttaccacaaattccagatacgctttcccagacaaaagatctgtcggcgcttccacgctttcgtatcttcctgttttctgaattttctcaattgcttcattcatgcaattacacattgtctccttccttcccgccccgccgcattactgctggcgaagctatagctgtttgacctcatgtaaaccggagctgtccggcctgctactctacataaagtcaaataaattcgtttgcgcttcatgctgtttcaagcgtttctttgacaaatcataataatatttgtccttttcaaatcccacgtattgcaatccggcatcatgcgcagccataaggctgcttgcacttcctacgtgtgtatcaagaaatttcataccgcgctctgcatatctgctaaatatccaatcgtataatgcttttggcttctgtgtagcgtgcaatctatctttttcatttgacattcctacccattctttagcagttccgtcaagattagtccaagcatactcgcacattgaaaaacttacattttctgatatttgtggttttctccagacaagaaaacattttgttggtggaagataaaagtagttacccccccaaataatttgcttcttacttactctgaacagttcgtcaaagtacttttcatccggtatttcgctatcccaatatgcttttggataagcagacttcttgtctccttttcgtcttcctatgttgcagttaatatttattccatatggaggatctacaacggcaatatcgaaatacttatctgggaattccttcataccatccatacaatccatgttgtaataaccgaaatccatcatggcatcacctccggaaagtcttcaaatcccatctgttcatctttttcaaagacaagcatttctcccttggctctctgataaaaattgcgatcaatttcaaatccgaaagcatttctccctatctcagctgccgcgcgcaatgtactaccgcttccgcaacacggatcaataaccacgtcgcccgggtccgtaaaaatctcaatcagttttttcagtaccacaaccggtttctgcgctggatgtatcttcggaatgtcctttccgtccttttcccaggtaaaccggttgaagatcatatgccccgtacctctgatggttttcccatcttcatcaaattttgccccatttctgaactttggcaacttgtcccgatacagtaccagagcatactctgtagctcctacaacacgcatatttgctttaagaacctgcgggctgtaattttttacaaatacaagcggtatgtaatgctcaaatccatgcttctttgccgccgcaatcaatgtctgcatctgctcaaaggcgcagaacacgatcatgcacggcgcgtcagaacttcgccctctagttccggctttcttcggttctttcttaagcatcttgctgcagaaatggaaatattcatacaggttgaagttaaaatctgaattgaacgccgctttacccacaagcttactctctccgtttttattgtctccaccgttgtaccacatcggattgctgccgtagaaattcttccctacgttgtaaggcacatcggcaataataagctgtgccgacggtatcgcgtactttttgtaattctgcatagaatctctgtaaatttcacattttgttttcattttctttttaggaacccggcgcgccttttatccggataggtcccggctcctttcatatcaatttttctaatttcggaataatctcttccgtctttatgtaacgctgataatactggtttataagctcttcaatatgatgcgttagtgtgtctactttttcctgtagcgcatcccgctcctcttcgcattcttcccgttcagcttggacggcatcaatgtctcccacctcatcttcaagaatgtcatacgctgtttgcagttcatcatattcagcctgtaactcctcatattcctgtcgcagtccgccatcaaacccattctcaaaggctttccgaacagcttcgtagacttctggttccatgtaatcacggaaatcatccacccttgtgatataggcaacctgccctttatactcaaatccaatcatttttctcaaggagccgatgcgcatcttcccgggaagctcgcactcctttctgatttattttttcttacctctggtcttgaacttatacacatcgtttctctgccggcttaccgcactccggtagccgttcagcttactcgctctgctctttcccatgtgcacctccctctatggcatctaagcatccgttccagcctgcatcgaaccttccattgtcgcaatgatctggatgatctgatctctccggcagttcccggagcgggcaccaatccggctttccaccctccatgatttgtttatctaccgtataaacagtgcaaatcttgtctctaaccaaatattttttcagtttgcaagcatttaatccccgacaaaacacgcattgtttgcaatcttccggcatatccataaccaatactgctttagccatcttccacctccaaatttactcaatgacaaaatcaaaatcagtgcagttaaagtccgtttctttttctggaatcggcatacatactccaactgcatcttttacatatggcactccgtttatctcaataacttccattggataataaccgaaacgtcttttgtaacaatcaatcttcttgcctacaagttcctttgcatttccttgatataatttcaccctgcacctcctaaatcatcatgcttctggtttttcgcaccgctcaaattcgataacccaaacccacggatttgcatcccaaccataccggtcaaggtcggatttcttgatggttgattcccacagccaagcaaattgctcctttgcaatcccgtactctgtgtctacttctgttccataatttttttcaccgtatccgatatcatcatagaaaaggtttccaacaccttcgctttctgccccctttggtgttatatcctgcaaccgttccactcttacatctgtaaccttaagccagatacgcgccgcttctttcggcatgcggatggatgggtgccactttgcatctccacttatttcatctgttgctcgatacatatagcaaccgcaaactttatccaaaacgcttttttgtggttcttttgggcaacttccgctttcgtccccttcacaattccaacattcaaagcgctcccatgtttccctaacgtacagtatatctcccggacaaatagggcaggttctctctgtcgtacttaactgttctatatgttccaggtctgcaaagttatgtactgcataagttctcttgtcggcattgtaaaaatccatatccggcacagtacactcattggcatctttgcaaattcgccttgtgcaagtcttcctcccatccagaatcacacgaaccatttctgcattgaataaaatcggtttaattgccatctaccgcacctgcctttcttctcgtttctgccctgtgttttgcatcatatctgttgtggcatctctggcataacgctctaagattactgtaagcgcaattttccggtttatggtctaaatgcgctattgtcaggacaacttttgagccattttcgcggatagcataattctcaattccacaaaattcgcatttattgtctgcccgtttaaggatatcttttcgtatgtctttccagtttgctggatatcttttccgattttctggtttaattggcatctactccaccgcctttcacaatctggattgctttgcctatgcactcttctatgcatttttcatatggagtgtttttataatagcgtgtttcttcatttccatagtctcccaactgctccacaaccttgtccgggtcgtaggcggtcggctgcgaatcaataaaatcgagaattgctttcatctgacttttattgtaatttcgcccattgaactgcaaattgtttgcatcaatcaatcttcccatcgtttgccctcctgttccaatctgtagttgctttcgttcgctcgtctttccctgttctgatgcctccgccctgatccatatacatctcacattcatagctttttgggagttctgttccgcatttcatacatttgattttgaacattaccccaacagccaaatgtgatgacttatttgtaatggttaagaacattgcttttccgccacaaaacgggcatggcttaagttcttcgttcattcttcatcctcccatttcagcttttgaccgcaacttgggcaataggcggaattatcacttttaaagcatctcgggcatgatggacaaatcattgcgtttcccattattctcggtcgcttcgctgtctgtttctccactgccgcccggcattcttctaaagttccaaccttacgatattgccgccagtcgcttaacgcttcagcaaaatctttcttcatctcctgcaattcttccggtgtgccgattgtgcggtactcttccacttctgcttccagttcctcgatgtattcatctttgtggtcgcagttcacacaaatctgcgtcgaacggtttgcaaactcatttttgatgttgggattaacaactgacgtatgccagcgctgaatctcctccagtgccttgatcgccatttccagatcttccattccgttttccccagatacctgctccactgtatgcatccggtacttgattctttcgattgcttcattctcttccatgtctatccctcctaatctgccattaccggcaaagcaaacgcccacaggcaccacgccgatcccgtcatcttgattccggcgataaccgcaatgctaacggcaatccacttcacggctttttcaaagcccgattttttgttcttgcgcttctctcggcatatatcgtagctcgggcactccatgcagcaatatgtttttccaagtttgcattctttttcgcaactcattattttccctgctttctcctgtaccttaactgatacggcacctctctgaatctcttaagcgcgtcgccgctcacatgcttgctcgggcgtgtcatcttctcgctgatctccgccacgcgcctgcggcgctccttgctgtctctatgcatttacctcgccccctcccgatcgtaacgggcaccaccgtggcgacgttttaaccaccgccagaacctcccgctccgcttccttgcaaatccgcatgggatcgaaccgctctctctggatttttccgcaatgttcacactccgcgcagatatgtaccggctcatagccgtcattttccgtcacgtatcggagaccatttttattcacgtagtacaccaaaccgctgtattcgcacccgccgttcagcgccgggcatatgatctcgtcgtaaatctgtctgatcgtctttcccgcatcaagtgccgccacgacgtcatccctgtattggtcatacatgctcgttctttttcttctgcccatttccctgtcctctcatcaccttttcaatcatctcttcctgatgccgctccgcgatatggtcccgaaccgattcctctgggaaagcaatctgatatgtccgctccttgatccggttcgtgatccggtcatcgtaccgcaggctgtccaatgattcattgctcgtaaatattgtcacccgccggttgatataccgctcgttgatgatctggtacatcttgtcgttgatccacgccgccggggattccacgccgaaatcatcgataatcagcacatccaccgtgttaagcgcatccagtaaccggctctcactgtattcggcatcccgccgccatgtattcttgatctcctgcaagatggtcagcgataccgcgaacttgactgcatagcttttcatcaactcatttgcaatcccggcagcaatccgggtcttcccgctgccctttgtgcgggaccagataaacagccccattccctgctccctctgggttccgaaatcttccaggtaagcctttatgatccggcaggcatccgtaaccgtctttttgctgtctggctgtcggtacacatccgtgcggaaggttttcaaatccatcccccggaacgcttccggtatgtctgcaaaccgcaaccgccttgacatcgccgcccgctcccggcacttacattccaccgccgttgtaataccgtccttttcggtcaagatccactcggtgccattgcacaacggacacacatcagaatccctcgaattctccggtgtctccaagttccccgagccgctcattgatcgatttttcatgcgctgtagtattttctccagcgtttgttccatctgctccattgcccgctccttttagatactgcataaatacattctcacgaagccagttttccgctttcttgatataccgctccgccgttctgtcccgccgacaagcatctgcataattctgcgccgcccgtatcagatcatcctccggtacaccagccatcaccgcattgcagtattccgattctgacaggtagccggtacattttttcgggtaggctgcagcaaattccacgaaccgctccacgggggatatagggggtgtatttcttcccttctttccttctttcttttcttctattgttggcgttagaatgtcgttagaatgtcgcttgcttgtctcttggctgtcgttttgcttgtcactcgtctggtataaatcgtacttaaccactgtaaatacggtatatttgtttgtcgttttgcttgtcacttcgcctgtctttttcaaatgcgaaattgctgtccgaatttcgcgctccgtaagtccagtttcgcccgccagcttcccgatggacgagacaaatgatccacgcgaaaccgttgtccctttaaaatttccatccttccagttggctttcaacagcatgtggatgaacagccgggtggtattgatatccgtgtaccattcccattccagcaacccccggctcaattttatgtagttgccatccaaccgatcaccccgtttccaagtccttgagcaggtctttcagcgtcattttcgcctgttccgcggtaagttccgtgatcgtcacttcgatcctcggattctccttatccacaaacgtatcaaaatagaagttcgggatgcatctctggttgtcgtccttgattacccatgcctttttcaagctgtcctgcacaaacttagccgcgcaggacaaaatattgtcgttatcccggcgccggtctttctcgaaaaaccggtaataaatcagtaccggtgccgtaatggtaccaatacccggaagctgccgccggatctgccagatgattccgtcctcattcttctgtttcatgtgtccgcccttgtgcggattcgtccggttggcggcggtgtattcattcaacccgtccagccgccccgggatcgtgaacttatactccatccgcaccacccatccgcatctgcgcattacaatcattgatctgctccaccaggtacgccggaagcgtatagcagtcaacaaattcatgtgcatccgcgagatcctttctcttcaacgccttgtaactcttcatcctgccctcatcatcgtagattccaaattcccggcggagctggttgtaaatatcccgatacactctctgccggatcgtactgtccagatatgcttccgttttcttgccaccgagaagttccgcacctctgcgtctgatatgtgccgacaattcatccgattctgcgccgaagagcggcatatcgttctcaatgtggtcgagtcttacgttcatgcccgtcacccgtttatctacagcaatgacagctgccagttctggcgaaatccctctgtacggatccagcgcctcttccatctcgtggaaacggttgatatacttcgccgtgaattccgttcccttaaccccggtcagcttgtgtgcaatgaactcgcagcctttcttcgtgaccagatagcacggtcgtgtctcccctttgccgtccttataagtgctttccataaagaaatcaaccagcgcaatcttgctctcgttaaactgctgtgaatatcttcttatgtctctcaataattctttatgttctttaccgaccatctcggcaacttctaatgaagtaatggttctctgctctaataaattcaattttcttcccctttcccctccgggacgaccccggaggtatccatggctttcaataattcgtgatataaaaaccgcatgaacgggtttcttaaggtgtttcaacctataagtaactgcgcccgtatctctttcggaacagttctcttgcattctcctccgactcgccaccggcaacgcaatgtttctcccatgccaactgaccaatgatatgcattaacgtgctcatttctttattcatgtgcacgctcattttcccctcatggtgttcatacgacaacggtacccacagtccgtcttcatctgatagccggcggtttgccgttccctcgaaaatatgatgacggtgtacgttcggtgtcccatcaatcatgtcgtactcggcatatctcatatctacaacaatagaatctttcatctatacctccccgagcaattcacttgaccagataggcttgtccagcactttggtatacttgcagtaatcacactgcccgcagcggatcggcttcaaggatcttttctttaaagcaaggatattcggcacattgtgctcaacctctgtaagggcttcgtccagaagctgctgctcaacagcgatcacctgtatgtcgggttctttttctttcgacactgccgcaataaagaatggaagctttttgccggtattgatctccactactttctgatataccgcgccctgaatgtaatacccccattcagcaaggaaattcagatgtccaatatctgggtgggaaaatgtttttgtgatgctctggcaagtcttcagatcaacaatgcatctccccggatggtagctgtcgatcttgatcttccactttgccccgaacatctccgctgtcataatgacctgcttctctccgctcatgaactgcataaaaagttcatcccgctcacaccgctggatcatataatttgctttgatgtactttgccatcagttcaccattttttttgaacatgcacggatgcttcgccttgaacaaatcaagtgtgccttcaaaatgcgcatctacatacgacccaaccatcaaggcatcggaatcttccatattttctttccatgtgccatctatcttcgcaagagcacactcttcacaacctgcgctcccatatgtacccataaaatccttgtactgactgacagagagaaattctctgttagcttccagactgtaataattctcattagtcaacagcattatcaaatacctccgatgcttctctctcagcctgtgcctgtttggaatctgcaaacggatccggcactggcgttgcaggtaccttcgcaatgtcttccgcctctccctcgacggagcatcccataagtgaattggaaatatgcacccttgcgaaaaaagctgatgctcgataggcaagcattaactccggcatagtctgccattttgatgtttcatttccatacttgtctttcttcgaataccacccttcatccttcgccattttaatggtaacttcgactccgtgaacctcttcgccatcctcttttctaatggcactgatatagcacccccagctatctgtatttttttgccctgtataaacaggcttcacacttttaaataatggcgatgcctttatcattgacatacaagcctgcccgctccactgtggttttcctttgacaacatacagattctgcattacaaacattggggaaacgttcattctgtttgccatatcgcatgcaatcgcacagtccataggctttccctgatatgcctgtggcaccagggaagatgatgcaaacatcttcccaatattaaataaattctgaaaagcctccggatcagaaaatacatttgttgataactgaccggtctgctctactgtcatgatctctgtgttttccatgtcatacctcctacaatgtaaccactgtcaaatcttcatcatccgttgtcctggtggcaataaactgcaagcctttttccttacacttggcataaagcttctcacgcagatcggttgccagtttctccactccatcaatcaatatgatgttcagaccattctgattctgaagcgcaacatcaatgcaaagatccagcttctcgccctcggacagattgcttaccggtaagccgttaattaacggaatgccatcctccaccgtcaagccctcaatcgggattgtgcagtttgcaaggatctctcccggcagtgttcttgccttttcgatcttgtctgtaagctgctgtgactgctcctgcatatccgcgatctcgctctgcaaccggagcatccgtttatattcgttgatatgagactgcattttctcaatctcctgcgcctgttcctgtaacggtgtcacatcctgcggctgcttgtccgcatattctgcatactcggcaacctccgcgtcaaaccgtgccacgttcgccttatatgtctgctcaatcacttccagcttgtctttctttttagatgcgagctgttctttctccgtctcatatgaccggatctgttcattcaacgaagcgatggacttgtcaatctggtttgcccggttggcaatttcgcggtccaaagcagtgacctcgatttcacgatcagcttcaaattttctgatcttactgtcacggctgtccattaacagcttggctctctcaatggtctggttttctctctgcatacgctcgatctgacggtaaatatcaccggcacttgcgttctcccatttctcaacgtcatatcctgcaggaattccattcgcgatttcttccacgaatgctttattatttctaatatcccggtcgatgttccggcggttctgataataatcaccgttctccgcctggatatcattcagtacggaaagaatgctctgatcgtagctgacccacgccggaatttcgccgaaccactctttaatcttgttcatatcccacggataatcgatcatatcaaggataatcgcgttctgctgcttcttatccatcttcatgaactcgattggattcagctgcagcggcatgaataactcccgcagaaatgcttccgggctgccaacctctaagccatttcgtttcacagacttgtagtctgccttgttcgttctggatttgcgatcgatagaaaggcctgtgtcagtctctacaatgatctcgccctctgtctcacccttgtgcacgatgtactcgcgatcacttttgtttgtaagtgcatacttgatcgcatcaagcacagaactcttacctgtaccatttttgccggaaagctccaaagatcttccgtctgcttcgtactctttgattccaaaaagattcttaatcttgatttttgttatattcactttaaaatgtcctccatttccatctgtttaaaatccgtcgaccggatcatccactccatcttctcttcgcgctcccgccgctctgtttcaccggtaacgcagtcatcacacataccgttctgaccctctcccgggtccatcatgcaaccgcagcgcctacattgatactcgtacattgacatatcctccacatcagtgttacaataaacgcagaaatacttatgtattcctacggtaaatagcacctgcgttcgccaaaacagtcagggtgctatttttttgtctcatgttccagatactccgttcttaggtcgtatacaaactgacacagtttttccgccacttcatccgccatctcatttcccgaaagatttctcacataactggttccgcatatataacatgtgagcttgcggatcatatcccaaacgctccaataaacatacgtgccaaaaagcttgtacataatagattccgtattgcaagatgcgctcgtaaaccattttgaacgtggcttcttcaaaactgactgtgtatcttcgcgaataaccgttcctttcatcttttctaaaatctgcttttcaacctcagaaacaatctcctgtttttcctgttccgtcactttcccacctcctcaatctcgatccacacaatatccggcttgtccatctcgatcacaacctccgtgcgccgccgctccgccagcatgcagatcgcatagcccgcgccgcccaggaagccaccgatgatacacaacactcccgcaaggtagccgtatacatcctgcgaatccagacagcatcctgcaagcagtgccgtgaccacgccgaccgccgtaacgatcttgcctatccttttcaacgttctcacctccccgctcccgtcgttctaagtctccacttttcaaatgctaccgtgtcaaacaatatcggactgtttttctttggagtcgctttccatgcgtaactctgtccttttctgcggtaagcataaagcagataatcccgcgggaagcccatctttttaagttccgttgctcgcattacaggttttggataattcatgtaatcacctacctctctaccggaatcccgatcacgctctctaccagatcaatatgctccgcggatatgcgcacctcggtatgcggatcatgattctttttcaaccagtcaactaccggctgacacagtttctcaagctgctctgcttcactcactctttttcatcccttttcttctattcttcacttgtggtacaatctccttacaggacgttgccgcgtccgagtattatgaaaggagcattgttatggagataaattttacgtctcaagagcttctgtttctttacggacatttcaaacttgaagctcaaaaattagaagccttaaaagccacaccaggttgcccaatttcatctgaaaatttagactctgacataaagttttataagtcaatcgcacaaaaactaagtgattgcgaaccgaagcttctaaatatgaatccatacttagaacaaataaaaaaataatttatttgtagcaaatgtcttttattgaacggtatttgtcgactgtaattacataactatcatctttatatttaattgcagtcacaaaatgccgtctttcacttccaagaaaccaaacaaaaattcttgctataaacgctttcactcaatcatctcctttttcacgtcagtactcttgacagttgaatttaatatgctgaggctcttgcggaaatcagctctgcgagagcctttgtctcttctgcagcttcactttcgctgtaagcatcgccagatgaaattttttcactgatatgctccgccagtgcttcaataagtgcatctaccttttccattcttctcactcccttcttatttgctgtccatcttctgggtatattctttttgatatttctccagaagatttacgaaatctttccactcctttgattctgcaatttcattccacgcgtggcagggtgcagcaaatcgaactacaacccagtcagataaaatggatttaaattcatcaaaaccctgctttggtggttcgtctggtacaagaaaagtattcggatgcaccaccgacacttcttttttcttaaataatttcactcctcaccctcctctctccgttttgctgtccaaattattggacagataccgtggtatcttcatagaagtagtcaatggtcacgccgaaatactctgcgagaatcttgagtttatcagctttcggcttgctacgaccggttttccaatcggataacaccgattgcgcaataccagtgtcttttgctacttgataagcagttttgtgatgtttcgccaacaattctgcaaattttttgtacaattttgcaccgcctttccgtattaatattattgtgtttgctacggaaatgtgatatacttcgattatcagacaaagcaacatattcccgtagcatatacactaaccgttacaacggttttcttgtgtatgctcatactatactacggctatccgttattgtcaatgctttttatcggatttctttagtattgcttatctttatgaaaggtgaacagattatgtatgagatttttgttgaattactacaaaaatacggaacaacaccgtataaagtaagtaaagaaactggagtttctcaatctactttaagtgactggaaaagaggtaaaagcactccaaagcccgacaaactccaaaaaattgcagattattttggcatttctttaatttatttgatgactggaaaagaagattcagagcctaaagagccacagcttaagcctaaagacgaaaaagatattaagactatccttgcgaatacagagcaacttttaaagcagccagggcttatgttcgagggaaaacctgcaagccaagaatcgattgactccatactctctgcaatgcaaataggtatggaaatggcaaaaaagaaaaataaggaactttatacacctaagaaatataaagaggaacagtgattttaatgaacatacatagtttggcagaatctattgttaaaaaacatcacacacgaaatccttttgaaatcatcaacgaaagaaacgcaatactgatatatgctccgctcgtcgatgttcgtggattttatcaatactttcagagaaatcatcttatttatattgatgaaaatttgccagataacgaaaaaacctttgtgtgtgcacatgaattagggcatatgctcatgcatcaaggagaaaattcagtatacatggacactcgtacttgcttcaacacaaacaagcccgaaatcgaagctaatacatttgctgccgagcttctgattccggacgaaattattttggagaaccacaatatgactactgaacagctatcacgattattaggttatgaaaaatcacttatagatttgcgtttaaagtcttatatgagtctttaatattctacaaacgtgtgttatgattttgttattacaaaagaaagaaggtatatgttatgggcttcactgaagatttaaaacagtttgcagagagagttattcctctcaaagaaaatatttccactgaagaagcaactaaaatgtcaatgattattccgttttttcaacttctagggtatgacgtttttaacccgggagaattttgtcctgaatacactgcggatgttggagtaaaaaaaggggaaaaagttgattatgccattctcatcaatggaaatccagaaattctcattgaatgcaaatggtgtggcgaatctttgtcaaaacatggttcacagttattccgatattttggaacttcccctgcgaagttcggaattttaacaaatggattaatataccaattctttactgacttagacgaggcaaataaaatggaccttgctccattcctcgaaatcaatttgaatgatctgaaagatgctcagataaacgaactaaagaaattttcaaaagaagtgtttgataaggataatattttcagtacagcatccgaccttaagtactcttcattgataaaagggcttcttgcaaaagacttagatgatccaagcgatgaatttgttcgatacatactttctaatgtttatgacggccagaagaatcaaaaagtcatcgataagtttaaatcaatcgtcaaaaagtcatttaccggatttgtcaatgatatcgttaaccaaaagatatcatccgctcttacaccggaagcagatgaacaaccaaatgacacacctattttagatgagcaaaaaagcaaaatagttacaacagaggaagaaatggaagctttctacattgttcgcggtattctagctggtacaattccaatagaagatgttgtataccgcgatactgaaagctactttggaatcttatatcaggacaataaccgcaagccactttgtaggattaatctcgacacaaagaacaagcaattgcttattcctgatgagaataagaactttgagcgtatttatattgactctctgaacgatatttattcttacaaaaacaagcttattactgtagcaaagagatatttagagaaataaataaaaaccgccccactctaaagcaggacggttatgctccagatgataccagagccctagacaagcatattgtatcattcggagcagccaagtgcaagcggaacacacgttccatgctggctgttatttttatacccaaaaactcctcgatttcgagggggttagaagaaaggatggtacatatggcaaaagcaaagtacacgaaaaactctcgcggagagtatgaaaccaagatctgggacggaacatacaatgttgacggaagcaagcaccggaaacggcttgtatcacgcaaatccagtgcagatctggagcggcaggtcaaccaactcaaaagtgaggtggagaacggtcagtatgtccagaatactgatgtaacctttttagaatacgcccggagctggcttaaaaccaaaaaagctgcacgcgaaatgaacacccggaaaatgtatgagaatataatagaaacgcatctatcctttttggagggtgtgcgcctgtcagatatccgaaacagccacttccagctcgcaatcaacaatgcactggataagccgcgcacctgtcagcaaatagagatcacctttaaacagatcctcaagatggctgtcgccgataattatatcggcgttgggatgtatgataagatctgtgcagacatcaatctgccatgttatgtaaaaaaagaaaagcgtcctctcacacaggtagaaaaagccgccatttcaaaggcgtcttttaccgcccgcgaaaaagcttttgtttatattatatattcgtgcggattacgccgtggagaagcgctggcactgtcaaaattcgattttaagacggagaacgggaaaatgtccgtatcaatcacaaaagcgcttattttcccgaataacgcgtccgaaataaagcccatgccaaaaagcaacaatggcttccgcaccgtaccggtaccggacaccaccgccgcatacttaaaagagtatttggctactctgccgggcacctacctttttacctgccgtgacggatccatcatgacacattcagcgtatgtcaaaatgtggcagtcaatcgtgagaaaaatgaaccatgccgccggtggcaccgatgcgttcccggtcatatcagatctgaccgcccacatcttccgtcacaactactgcacaaacctctgctatcaggtgcctgccatcagcataaaaaaaatcgcacagctgatgggcgacaccgaaaagatggtgctggatgtctacaaccacatcatggacgagaaagaagatgccgcggcggtcgtgaatgatattctggcgatctgattttgcggacacgatgcggacattgcggtcaaaataccccttgcggacgcgttgcggacattaaaaaccatctacttctgcttacttttccttacctcaaaaatcgcataaaaaaagcggaaaaccttgaatttactggttttccgctcttcattccttagtgagacacgggggattcgaacccccgacaacctgattaaaagtcaggtgctctaccaactgagctagtatcccctatatcagattacaacaaaagcaagctgggctagcaggattcgaacctgcgaatgctggaatcaaaatccagtgccttaccgcttggcgatagcccaacaaataatcgttgcacctatcgcaactaaggtggatacagggattcgaaccctgggcctccagagccacaatctggcgcgctaaccaactgcgctatacccaccataaaatgtgctcgaagggattcgaacccccgacccacggcttagaaggccgttgctctatccagctgagctacgaacacatatgatcttgtataaacctgtcagtgcagatttaaagcgggtgatgggaatcgaacccacgtatccagcttggaaggctggtgttctaccattgaactacacccgcacgaaatcggggtgacaggattcgaacctgcgacctcctggtcccaaaccaggcgctctagccaagctgagccacaccccgaaggattttatcgcttgcgcactcttccggccactgagctgtccttttcgtgacgcaaggattattatataggacagcttctgaaaagtcaacacttttttataaatattttatttcaaaatttgcctttccgtttttgtccagatccatcacaatgtaggacggtcttctcccctcctgcctcggataggaaagactgcccggattgagcgcaatcacatcccttgtgtaatcgatcacaggcctgtgcgtgtgtccgaacatcacaatatcatagccctgtgccgccgcttcccgctcaatatcggcgatccccgcactgacatagtaataatgtccatgcgtgatcaatacacggtagctgccgatgcgaagttccttttcccgtggaagattggaaaaaaagtcattgttgcccgcaacgatctccagccggcatcccgccatctccgcaatactgtcctcgtctccctccgcgtcacccagatggatcagaagatccatcggctgctcacgctctaagataacttttaaattttcaagtttcctgtgcgtatcgcttacaaccagtattttcataggctaaaacccgtactcgtgcaacagcttcttcatggaacgaagcgcttttcctctgtggctgatctcattcttctgctcttctgtcagctccgccgtcgagcagtgatactcatccacatagaagatcggatcatatccaaatccgttctcccctgccggacattccccgatatatccctcgatcgtctcccgtgtcacaagtgtcttcccgtccggaagcactgctgcaatcgcacagacaaaccgcgccgtgcgctgctccttcggcacgcccttcaaacggtcgagaatcgcctgattcttaatatcataggaagtatcctcgcccagataccgcgccgaatatacgcccggctccttgtttaaataatccacctccagaccggaatcatcggccagcacaatatccttcgtacaggcagctaccgccttcgccttgatctgcgcattctcctcgaacgtcgtgccgttctcctcaatatccagggaaatacctgcttccttcatggagcagatctccatatccatatccgccataatctcgcggatttctctcatttttccggcattgccggtggcaaaaattattctcatggctttgtcccctttttagtattcttcttcaaatgcgcgaagcactgcctgatagacaccctccgccgtctccctctgatatgcatcagaattcagcttttccagttcgtctttgttcgtcataaatccgacttcaatcagcgcaaccggcacctcactggttctaatgatataaatactgtcgccttccaccagtcccttgtcacggcttccgatcctgcctgtgacttcctccagacagatctgcgcgaactggcggctcgcctccgacgtctcgtcgtacatgacctgcgtaccgctggtacccgacatgcgtccgcttctcgtcgagttgttatgtatactgataaaaagatccgcgtccgacttgttggcaagctgcactctctggtcgaatgtcggattgctgtcatccgtcctggtgtaatacacgccgatgttctgatcgctgttgtcaaaaatctctttcagcttcagcacgatcgccaggtcaatgtccttctcattgattccctgcttgttcgcaccgacggctcttcctccgtgccccgcatcgattacgactactttatcatagacttcatgaggtgtcaaaaaattaaaataaaaattctgcgcatcatattccgtctgcagttcatataccttgttggtcgtgacctctatcacgcccatctccccctgcctggtgtaggagagaccgtcaatatagtcgctgttccccagaaccgggtagctgtcaaaataagtgcggtccgcctgcgggatttccacccggatagtctgggtcacataatcgttgctgacagcaatccgatccccggtcacgccctccggcaggcggatactcagttctcccttcgcccccgccgcttcattctgctctttgatctttaagttctgcatcgtgacctgactctgggcgaactcctcctcggcaatgcgttcctctctcgcctccacctcccacgtgtgaagcgccggaagcttcggcagaagcacaaaagataccgctgtcaaaatcatgagaaagacagccgacagtctcaatgctttttcttccataaccgtatattcctttatcgattcttactgaatgccttaatacagagattacattcctccaccgtatccacgctgtcccatctggcaccattggtactgatataactctcaccatcgtccagaatcacattcgcggtcgcctcgtcggcagcgtattcgattgccatcggatgcaccgaccccggcgtaatcatgtgaagcacaatcgcataacgctcccccgcatccagtgaaattgcctgattaaaatcaaccgtataatagcccgcgttggagagcttgccggacgccaccggaatccgctgtgtcagcgaatctgcattttcaaaattccgtacaacatacagctcgtactgggaatcttttcctgttgcgtaaaagcctgccgccaccagttcttcttcctgtgacgtcgtgtagacattggcgccgtaggcgctgtccttgttatagccaagctgtccgacccagccgcacagatcgctctgatagatatggtcatagttgcccggctcttcgatctttgtatacacaacgttgtgggtgcctatattcgtatcataatacgatatgtaaaacaccccgtcctcgccgaacgtatctccccagctgttctggcagataaatgcgccgtctccctcgagatccacattaaaattctccttggaataactgtcgtcccagccgataatcacaacgtcgtgattcggcttctctgtaccgatgtagcagtaggaatttgtcttctgattgtaatacggagactttgactgcgagctgcgcagcccgttatagatcgacgtctgcactccgccgtataaaaagaccgactccttgatcttctcataatcttttccgtcgatgatctgcatttcctgtacatgcttgaccgctgtaagatccggattcgttttattgtccccgtaagggtcatccgcttcgtatacaggtccttcccatgccgccagataagccattcccatggtatattccccgccgtcatcctgcgtcagtgtaaatccattgttcatcgtcatatggtcgaccgaaaactgcagtttctcttccggcagcaacgacgactccagtgcccccagcgcggcaaacgcccagcaggtgccgaaagttccctgattgcgcactgctgccgcccgtcccttctctctcagatcatagcgggtcggtatgattgtcgcactgtccgacgtgtccatcgccgacgcctgattctcctgtatatcccaggaataggaataatccagataattcgccagatcattcaggcttacatagtaggtatcgtccttgcggataaacggcgacacgatcacctcacgggttccgttgactttcgcctccgaggcgcccagtgaaaactccacctcattcgcatgcttctccacaaggagccgctttccgtcatacacatgcgcgctgcagttgagtgcatcgcgcagaatgttcaccggaaccatgatattcagctggtcatccatataaaacgtatggttctcgttggtgtattccttgttatcgatcaccagcgacaacagattatcatttacgctggatgcgatcaacgggttccaggttgtcgcctgcagattggctccgcggaaattttccaccgttccgctccccgatgcccccagttctaatttaaaaatcagcatggcggctaccagcacgccaaacacgatatatctttttgaatatttcattcatcccctccggcggtatcccttacactccgccttggtggcttcggccccataaactggtaaaaataggtgcgaagcattccattgtagatcttgcggttcttgtccgcttttctgccgatgtaacgctccgcctcatcataactcgtaatcaggtacatcgaccaggaatcaagtccccggaatgccgccccgatctccccgtacagcttcggcagatccgccttgtcctcgaggcgctcgccatacggcggattcgtcacgataaagccgtatttcttcgggtggtggagttctgccaccgggcgctgctgaaaatgaatcaggtgatccacgccggcgcgttttgcattctccctggctgcctttatgacgtccccgtcaatatcatagccctgtatgtcgaccttcacatccgtgtggatcatctcctcggcttcctttacgcactcgtaccacagcttgcggtcaatcaggttcgtccattgctccgccgtgaactcacggttcattccgggcgcaataccggcagcaatcatcgccgcctctatcgggaacgtaccgctgccgcagaacggatccaccagaatccggtccggtctccacggcgtcaacagcagcagggaagctgccagcgtctcggtcagaggcgccttgctcgtcaatgtgcggtatccgcgcttgtgcagagagtccccggacgtatccagcgtcaccataacctcatccttcagtagaaagatgcgcaccggatacggcgccccgtcctccgcgaaccattccacatcatagtactgcttcatgcgctccaccatcgccttcttcgcgatcgactgaatatcagacggagaaaacagcttgctcttgatagaagacgccttttttacccagaactttccgttcacagggatatagtcctcccacggaagcgccttgattccctgaaataattcctcaaaggtcgttgcgcggaatctgcccacttcgatcagcacgcgttctgccgtgcgcagaaagatattggcacggcagacagcttccgcatccccctgaaatgagactctgccatcctccacccggctgatctcatatcccaggtcatagatttctctcttaagtaccgcttccagtccaaaatgacatggaaccaccagttcatatgtcttcatgtattctcctctgtatcatatgtctaatttcctaataatatattatccattctaattttccctgtcaatcacttgttcgcattgcctcaatgccgccaaccacggtatatacctcatacccctccctgccgagctttctcgccgccagaagactggtgcttccataatcgcagtagagcaccagcggtctgttcttcggcagacggtgcatccactgatcgatcttttcatacggaagatttctggcgttcggataatggtattcccgataagaatccgcctcccgcacatcaatcagaattccgtgctttcttctcataatatcttccaattcccttggatgtatcgtataaaacgtcatgcccgcgtatcctccttttccgccatatgctcctgtaatcgcaaaaacagattacaaagaggttctctgtaatctgtttctgtcaatcttattctatcctatgcgctttttctctgcctgtgccagtctactgctgatacttgtcagaggtcttgttggaaccggacacgttggatgtcttgttggttgacttgttagtcgacttattctttgcgctgttggaaccgcttcccgcgttgttctcgtagctgttctcataaccgtctctgcaattagaagtcgaattctgtgtactttcattttttgccatgttgccctccatcccggcacgtgctcgtgccgaatctttttatttgcttactgcatggttagtatctgatgttccccggaaaatatacatggcttttgtggttttgcattgctttttcaaaaagaatgttctatactaatgctgtgatatgtaaaacatatcattttataccccttattaattatttatactcccctcagaaaaagccaagtgcatcgcacctggctttttctatcttatcacagttcatatcttatcacagttcataatattcaagattgtcggtaagctcctgcgtgatcctgcctccggctttctgatacttgtcatagactccctggatacgctgcacggtcttcgcgttcaaaagatcgaggcggtgcagagcgctctcatacatcggattcccctttaactcctcccggatcggctttgcgaacgggcaataggtaatcaggatctctcttgcgatcttgttgaggcggtagcttcccttcgactcatacttcatccagttctggtaatccttgacgaagacctcacggtaattatttcttccacgcaagagcgcactcttgatcttctccttcgcctcggcggaaagttcgcggttcttccggtagaactgcagataatcgcaatactccgccgtcagggacttctcacggatatcgttccagtgtacaccctgaatcttcctgcagatctcccagcggtatcttccgaccgtatcgaccatcatatcgtcaatatcgaccgctgtgaaaatcgggaacaggaaacgcgccgaggtatctcttcgcacgcctgctgtctcctgccacatcatcgagcgtgttcctgcattcggcatcagaatgatgtccggcatgatctccttcataatcatctcgcggttgatgcccttgtccggatccgagaactgcacttcacgatagaacgcggagaaatcgatgtcgcggatcttgtgcagtgactcgtccagcttctgcgccgtcacgagcatcttttcaatggagttgatcagatcatactcccctaaaatcgggcagaacgtggacagcttgccataagtcgcacggtttccggacgtgaacatgttctgaatctcaaacttgactttgagctcccggttggacataaaatgcttctgctgctctgtcgtaatcttgccggtcttgcgcatctctgcaagatatgccggataatccatatcgaactcatttttcgacggctcgtttcttccgtcataaacactgcgcagccattcaaaaatcgtgtatacatggtcagatttgcagacatccagatgctccgtgagatcgaacagaatattggcattctcctcgccggccatctgcacatccataaatccgaaattcaaaaacatttccacaatcggggtaagctctttttccccctttacggtatgcataaacgcttttaagtaggtatcgtagaaaatctgtgtgatccgcttgcggattgcaaacgtctgcgcgtccgtggaaaacatatccggcagatcccggtacttctgcacaagctcctgcatctcctcgatgacgctctgctcggtatccgcataggtcaggatatgaaccaggcagtcttcactgcgctcttcctgcgtttcttcctcctcgccatcctgtgcctgcggcgtctcgtacgctgcaccttctgtctcgaagtggtatccgcggtattcttccatccgcatgtcgaccagctttccgctgtagatgccaagctttttgatcacctcggcaatccggtccatctcatttaaaagcggctttacatcataatttttcttatgcgcctgaatcgccagagcaaagaacaggttaaaaagatcgtttttcgattccgccagaagaatatcctgattgtagcggagatattccaccatctcaatgattccctgcgtcacacgcctggtctgataactggcttccatgatcgccccgatgcagagattatcgtcccgctgcatcagatgcacatactcctctaaataacttccggtcaggctggcactgttgcctatctcccagttctccgcccggtgcaccatctccaacggcttgaaattgtccatgcgcgtaaaactctgctcgtccagatggtactgtgcgcagagattctcatactgactgtactcattctcggcaaaggagtgaaactgccttaccagattggtaaaaccggcataggttctaagaagcatctgccgctgtccgagtgctgcccgaagcagaatactgcgcatgctctcctgcccgtgaatcgcctcctttaaatcctccgccgattcacaattgaacaccgccagcacggaatcctcggtcgcaacataatcacacagatatctgtcgccctcagaaattccaatcaccgcattttttccaagaacaatcttggcgtaggaattgcactgaatgacagtaccctcctgcacgatataccatttttttactttctctttctgcttggcgattatctggttcttctgtacctttactgtcgtcatcgtctctctgtcccctgcctgcgcacatgaccgtgtgtctactgccccttcgcgcgtcctttacttattattaacaattccgtaagcagctcgtccgctgcctcctctttactcatccgtgccagttcccgctcgccgtcctctgtgatcagtgtcagcacgttcgtatcggttccgaaaccggcgccttccaccttcagattattggctgcgatcagatccacattctttttgcgaagcttttttcttgaattctcaagcatgtgctccgtctccatggaaaacccgcacagtatcgtctttcctttgtccgcccccagagctgccagtatatcctgtgtgcgttccagttcgatcgaagcttcccgatcggacttcttgatcttctcctccgccacagatgccggtctgtaatccgccaccgctgccgccttgacaataatatcctgctcctttgcacggctcatgaccgcgtcatacatctgtgccgccgtcacaaccggaacaacattcacaaaccgcggcggctcgcacgctgtcggtccggtcacaagtgtcacatccgcccctcggtacatggcgcgtctcgcaatcgcatatcccatcttccctgtggagtgattggtaatatagcgcaccgggtcaatcgcttcctgtgtcggacctgcagtgacaagaatttttaatcctgccatgtcctttggcgcagcaagttctcttaagacatactcggccagctcttcctcggacggcagtttgccgtctcccgtatcgccgttcgccagcatcccccgcaccggttcaatcatctcatagccgtaatgctccagcttgcggatattgtcctgcacaatcggattgtggtacatattatggttcattgccggggcgatcaggcacttgcaggtacacgccatcaccgtcgttgtgagcatgtcgtctgcaattccgttcgcaatcttgccgatcacgtttgctgtagccggtgcaatcagcaccagatccgcctgtttcgcaagcgccacatgctccaccgagaactcaaaattccggtcgaacgtgtcaatcagacacttgttcgccgtcagcgtctcaaacgtcgtcgctgtgataaaattcgtggcattctgcgtcatcagaacatgtacgttgcacccaagcttcttcaacatgcgcgctacattcggcatcttataagcggcaattcctcccgtcacacaaaggagtacggttttcccgctcaaaagtccccttggcttttcgctctgcttattcattttttcctcctgctctcgttcacttatcccatgatacgatgctaaaattccatttttattctatactcttttccctctctgtgcaatgcctttctgcctgcgcgcccaactttcaccgctaaatgtaacgcggcatttcctgaaaaaagaatcctattacataaaaaacgcacagaccgtgtcacgtgacacaacctgtgcgcaaataaatatgttccctatacaaccgcccggatgtaatgctttacctcgcgcagctttttcacaaactggttgtccagctcatagaatccaaggccaagcggaaccgtaaccagaatgttaaacgggacagcaatataccatgccgtctgcatgatcgcgccgcccagttcaaagtgatagtataccatctgaatcaggaagatatgataggaagcttttccaatctgtgtgagcagtctccccgcaaatcccggaatcgtacagtgataaaatttccggaacaataaaataacgatcgggaaaatatagaacgcaaccggcatcgctgtcgtcttccagtagccaaacaactcgaaatccttgtcgaatccgaaaactgcaatcagatatgccagtcctgccagaaacatcatccacatctgatacggctttaccctctgctccggatgcagatacagataacagccaaacgcgattaagagcaggtatcttccgatgctcaggcggtaataatatttatccatatcaaacacgatgacgcacacctcaaacgcgagattggcgagcgctgccacagcaagtccaagcttagcattgtatgcgatcatcacataaatcaacggaaaaataacaagcaactgcagcatgatcggtacataatagcttccaggtccgtatgcgccaagcacaaaaatacggaacaacggtatatttttatcctgcgctgccagcagcagaatctcaagcagacaaatggcaaaaaacggcagcaaaaagcggatcagctttggtttcatcatattccagccatacattttctccagatttccgtctgcttttttgcggtttgacattgcaaaattataaccgctcacaatcataaataccggcactgccatgttgatcagcatcgtaaaaaaaggagatgtcttatcctcccatccatagtgcgtaatgattaccataatgacacagactgccttgagataatccagaaattcgattctctgtttctttccctcttgcatttctaatcctcattcctctttttatacacaatccagatgtcctctttttgacaccaattctgtatattacgcactttttgcatgattttcaatagtaattgtggctaaatttgggcttcaatcgagggatttataaagcatttctacgatatgattttcagataaaacaaaagatatatactatagaggaaaaaaagacccggaagataatcttccgggctttcctacgtgcgcgagaggattcgaacccccgacaccttggtccgtagccaagtgctctatccagctgagctacgcacacatattcttttttacatatctattatagcactcttgtcaagtacctggatatgaatgccggcgaccggaatcgaaccggtactgtgtcaccacaacaggattttaagtcctgcgcgtctgccagttccgccacgccggcattactgtaacagttgttacagaagtgggacctatagggctcgaacctatgaccctctgcttgtaaggcagatgctctcccagctgagctaagatcccatatgaaattatcataagaacaattttgctctcatgagcgacccaagcgggactcgaacccgcgacctccgccgtgacagggcggcgctctaaccaactgagccattaggccagacatcttacaaacgcttttgtgacaagtggaccatcggggactcgaacccaggaccgaccggttatgagccggttgctctaaccaactgagctaatggtccaagtagattacttctataagccgatgatcggactcgaaccgataacctgctgattacaaatcagctgctctgccaattgagccacatcggcatatttacctcagctgattacagccagccaaaagctagtgactccaacgggaatcgaacccgtgttaccgccgtgaaagggcgatgtcttaaccgcttgaccatggagccaggtagttttacaaatacacttctatagtcaaaaaaaactccccgagtaggactcgaacctacgacagcgcggttaacagccgcgtgctctaccgactgagctatcgaggaatattagctgatacacagcttccggtaaaacctatcataaataagttgtaccttcaaaacttcatacagaaatcatccaacaaactttttggtcaagccctcgatcgattagtaacagtcagctccacacgttaccgtgcttccacctctgccctatctaccttgtagtcttcaagggatcttactcacttatgtgagggatatctcatcttga

SEQ ID NO: 8 - DNA, 252491 bp, Roseburia hominis
ttagattactacaccgaaaggtgtacaacttgttaagttgattgaaccgccgtgtaccgaacggtacgcacggtggtgtgagaggtcggaatttcttatttaagagaaattcctcctactcgatcgtggaaagggaaagatgcggaagagaaaaaatgttcagcaggcagtgatacttgcaggaggttacggaaaacgtctggcaccatttacggaacatgatccgaaaccgatgtatccgtttaacggggaaccgtttctgggctacctgctcagacagattaaaggttttggaatagaagatgttgtcattttgttgggatatttgccggagaaagtgacggagtattttggagatgggagtcggtatggtgtccgaatcaagtattgtataacgccagtagagtatgaaactggtgcaagaataaaagcggcagaaagctttttacaggaagattttctgttgatgtactgcgataattattgcccgattgattttgaaaagcttcagcaggattatgatacaaataatgcatccgtacagattacggcatatgtaaataaggatcattatacgaaaaacaatttaaggctggacggggatgactgtgtacgatgctatgataaaaaacgggttcaggagaacctgaacgcggttgatataggatatgcgattatttcaaaacaggtaatcgaacagatacccgatgcaaactgcaattttgaggcagagatgtatcccaaacttgtcaacagcggaaaactatttgcgactcttacagaacacagatattattccattggatcatgggaacgaatcgaattgacaaagcagtttttctcggggataaagaccatttttctggacagggatggaaccttgaatgtcaagccacccagagcgcactatattgagagtgcggaagcgtttgtgtggatagatggcgcaaaagaggcgcttcgtatgctgaaagaggcggggtgtcgtctgattttgattacaaatcagcctggaattgcaagagggaatctgacagaggagacattggctgagattcatcacaagatgcaggcggatctggcaaagattggagcagccatagatgcgatttattattgtccacataactgggaagagggatgcgagtgccgcaaacccaaaccaggtatgttatttcaggcgcagagagatttttcactgaacctccgggagtgtataatgatcggagatgatgaacgggatatgcaggcggcgcatgcggcaggatgccgtggaatacttgtggataacagctatacattgaggcacgccgtggatgatatattaaagtgatgcaaggagaataacagatgataatatcgaaaacgccccttagaatgtctttttttggtgggggaacggattttgctgattactataaaaacagccgttacggatatggaacggtaataagcactgcgttggacatgtatgtatacattatggtgtgcaagagatttgatgataagatcagagtgtgctataccgtcaatgaatttgttgattcggtggatcagatcaaacacaatattatccgggaagcattaaaaatgcttgggatagagaaggggatcgatattgtgtattcggcggatattccgttaagctcggcaggtatcggactggcttcttccagtgcgcttgcggtaggagtgttaaatgcgctgcatgcttataagggagagcatgtttcgccggaagtgcttgcgcgggaagcatgtgagatagagattgaacgtctgagcaatccgatcggcgtgcaggatcagtatgcggttgcctacggaggatttcgtaaatataagtttcacagagacggaagcgttacgaatgagatggtcgtatgcagacaggacacgctggatcagttaaagaacaattttatgttgtactttacaggactcaccagagtatcatccaatattctggcggagcagaaagctcatatctatgacaaggagaaagtgcttgatgcaatggtagagatggttctgtcggcggaacaggcattggcagaaggggatgtcgctcaaataggcaagatgctggatgatgcatggaatttgaaaaagcagatgtccagtggtatctcaaatccacttatcaatgagatgtatacaaaggcgaagaacgcaggcgctgtgggaggaaaaattctcggagcaggtggaggcggttttatgttgctttttgttccgccgcaagaacaggaaagagtaagatcagcaatgagtgaatacaaggagacccagtttggttttgagactgagggatcgcgcattatttttacagaaaaaaatcggggagaataggatacacgatgaagaaaattattatttttggtgcgggtccgacgggaaaacgcgcttacgcattttatagggagttttgcgatgtggttgcttatgcagataataatgaggcaatacaggaaacggatatcggcggtgtacctgttgtttcggcagagcagattgtgaatatggcttacgattatatcgtaatagcttctgtgcctgggtatgattccatatgtcggcagctggaaaactacggtgttgctcaggaaaagataaagaagtattcatccgatgtgaataataatagagaactttccttttttcaatatgcgagagaattaagggatacatcaggagcctgtgcagaggtgggggtatttcaaggagatacagccaaaatcatcaatcaggcatttgcggatagaaagctttatttgtttgatacattcagcggatttgatgaacgggacgtggagacggaaaagaaagcgggattttcagaggagaaagcaggggattatcaggatacatccgtagagcgtgtattagaaaaaatgaaatatccaaatcagtgtattataaagaaaggctattttccggaaactgcggaaggaatagaggaaacatttgcgtttgtaaggctggatgttgatatgtataaaccgacgaaagcgggattggagtggtttgggaaacgcatggaaaaaggcggacttctaatttcccatgattattatacgaaaagttatagcggtgttgcgcaggcaatcgatgagtatgtaagcgagcatccccaactgcgtagaatcccggtcggagacggtttgagtgtaatgttgataggattttaggtggaaaatatgatatcagtcatcatgttgacgtataacagggaaaagtatatagcgcgatccatcgaggcaattttggcgcagacatacagacagtttgaatttgtgattgtcgacaacgggtcaagcgatcaaagcggaacgattgcagatgaatatgcgttaagagattcaaggattaaggtgcttcacattgaaaaaagcagcattgggcatgggagaaatatcggaattgcgaatgcaacaggagaatacattgcatttgtggatgatgatgatgttgctgcaccggacatgctggaatttttagaccggcttgtacaggaaaatcatgcagatatagcaatatgcggtgcaaaaaaggatgtaaatggaaagattctgccacatagcatgtgggatgaatactgtatctggagcgcggcggatgctgtgacagaacttttaaagcgcaagcgcaataatgcagggctgccaaccaaactgatccggagagaattgtttgaacagataccgttcaaggaagactgcaaatacgaggatatctggatctgttacaaatatatggcaaatgcgaataaggtggcagcgtatggactgcccaaatactgtttcacccggcatgagagcaataacagttcttttacacaaaatgcaggtttgtggaaggcagaacaaatgcgggaatatctggcggcgttttgtgagaggacagagtatatcagtgctaaactgccggaattgacggggctggtgcaatacagcgagtggtcttatatgatcagtatgtgcgacaaaataaaaacctatgatctaaaggactgccagggcatattcatagaattggtcagagaactgcggctaaagcaggaggaattcctggcgttaccatatattcagaattttgagaaggaatggatgaacaaatacgttctgcaggaaggatagactggaaatgagttatagtaatattataaaatcatatagtcaggatagaaatgtactgggaaaagtattaccgcttgatacgccctatacggtattgatcgatataagtgattcctgtaatcttcgttgcaaatattgctttcgttatgatacaagcattggggcggaagattatcggaaaaatcgtctgatggattgggaaacgttccaaatagttgttgagcagttaaaagaatttccaagccagattaaaagaattgccttgtcacataatggagagcctttgtgtaacaggaaactgccacaaatggtcagttatattaaaaatgccggtcttaccgggagaacggagatacataccaatggattacttttggataaacagtatatagaggaattgtgtgaagcaggaattgacagggtagtcatttccctgcagggtctggacggggatgcatattataaagagtgtggagttaaaatcgattttgaacggttttattatcatttgaaatacttttaccagaagaaaagagatacacagatacatattaaaattgtagatgaagctgtgggagatgagagagacaggttttatgagatgttttcgcctattgcggatcgtgtttttgtggaatcggtggtgcctttatggacggattcggatatgaagactggagaagtagaaaaaaataaatacggagatacgtttaaagtccagcaatgctgtccgttggtcttttatacaattaatgtgctgccggatggaacgatatacccgtgcagtcatatcagaccgccatttaaacttggaaatgtgaaggaaacgacgatatatgaggcatggaatggggcgcagaaaaaggcgtttatgaaggatatgcttgaatcaggaagatttaaaatggaggcgtgtaaaaattgttatattccacagaatacggtaatgactccggaagatagtatagatgcatatgcagaagaaatattagaaagaatcaataggactcaagggtaagaggagtcggctataaaattagggttaggagaatgtagaatgtcaaaatgtgttacggtttatacacaggcgtataatgttgagaattacatagaacaatgtattaagagtgttttatcacagacatttcaagattttgaatggattttagttgagaatggttcgacagataaaacgagagaaataatacgtaaatatgcagcacttgatgaacgaattaaaccagactattttgatgtaaatcaggatgggtttacaaattattatattgcggaaaaagcagacggacggtatattgtaaaaattgatagtgatgattggattgaaccagagtatcttgaaaaattgatcgcgccatttgaagatcctgatgtggatatatctatttgtggcgcagtaaattatgaggaggaaacaggaagggaaactccgcatgaatatggagaactggatggggtttattctaaaagtgatatagaaaaacaattcatagaaatgcgttcttatatgggaacttattggggtaagatgtttcgcagggaaattttttgcagtattttgcctgatatgaaagaaataggggaaaaactgaaaaaaggagataatttcggaggagatgtggcatttgctttgtgttatttaggcgagtgtaagaaactggcttttgtgaatgagagaatgtatcattatagaattcataataacagttatgctacccggacaataggaaccaatagagtatttagctgtctggctttaagagaaacagagcatcattttttacataaggtaaatgcgtatacggaacaaaatgtaataatggttgatctgctattctggcagaatatagaacagttatttaaaaacattattagagcagattgggatacagaccaaaaaataaaaacgataagcgaggtttgcgctaataaagatttacaacttcttcggaaagaggcatataattctaaggtacgcacaattttaatgggggatattgcatggtgttatatgaatgcaggcaatagcaaatatttgaaaaatgttttaatgctgctggaacctgacatatttgacagcatttcaaatgaaacttatgaatggatgagggaaaatcaaatattgatgtcctatattattatgggagaatttgataacgcaaaaagatatatggaagaaattacaacaggaaataatgtggattacattcgggagcttcaacagagaatgcattagaaatgtgggagagagaacgtagcatgagagaagagttgataagtgttatcataccaacttacaatagaagagataaagtaacatatgctgtaaaaagtgttttagatcagacctattcaaatatagaagtaattattatagatgatgcgtcaacagataatacggaggcagagataaaaaaaataaaagacgatcggatccggtacatatatctggaaaaaaatcatggagctgcaggcgcaagaaatgttggtataaaagaagccaatggaacctatattgcatttcaagacagcgacgatatatgggaaaaagaaaaattacaaatgcagattgataaaatggctggaactgacaacgttggacttgtatattgtgctatggttcagtttgatgcaaagggaaggctgctttcgctaattccagaaaaaaaattgccagaaaaatacacttccggtaagatttttgattttatgctaacgtatgcattgattagtacacagacaatgcttgtaagaagcgacataataaacaaaatgaacggctttaatgaaaatttgcgagcattggaagattatgaatttgccttaagatatgcaaaggacaatgaagttggttttgttgaaatgccgcttgtaagacagattctaacaaaggacagcgtaaatcaaaatggaaagaataagattttagcggaaatttatatattggaagagttttgggaggattataagcgcttgaataaggtaattccccagtttgaaataatgagagcagaagcggaacgctatgggtgcttggaaatattacaagagtatgtattagaccatagaaatttctacgaatgtgaggcggagtggaaacaaatatatcaaatttgttttagtgagcaaaagttgctgtattctcataaccgaaaatatgagggagtacaactaataatacaattatgtgaaaatttaaagaaggatatagaggaacagcaggcagaagaaattatagagggaataaaaactttttcaaagcaaattggattagatatatgtgatgaacaggagttatgtgagtacaatcatcaatatcaaaaattggcagataaaatagaaaataaattaagaggacagatttatgtttgctcggtatgtaaaaatagagtaatatttgatccaatatctgattattacagggaaaatagaatgaaatatggcttcccttattggaatcgcgagtttcaactggaaaaccgagagcgctatttctgtcctgtatgcggttcgacagatagggcaagactgattattgaatttttgtcgtatattaaaagcgaaaacaatcaaaaaataaaggtattgcagattgcgccggattctgtcatagaaagatacttgcgggcaagagaggatgtgatctatgagtcaacagatttatatatggataatgtgacttttaaagcagatatacaaaagatggacatggtagatagtaactattatgatctggttatctgtgcccatgtacttgagcatgttaaagatgacatatctgcaatgaaagaattatatcgtattttaaaggcagaaggattatgcatcgttcttgtgccgcttattgttggcttagaaaatacagatgaacaatggggatgttcagaagaagaaaactggcacagattcgggcagggagatcattgcaggttatacgcacgagatgattttatgaaaagattagaagcggttggatttcaagtgaatgaattaggggaaaaatggtttggagccgatctgtataaaaagtgcggttttgatagaaactcgattctttatgttttgtcaaagcaggaaatgttaaattagagataacctataagcaacagtatcatagaaagagcaggttatgtcatgggaaaagaagacattgtaatagaatgtatagcagaagaaagctttaataatttctgcgagattgtagatgcaacaagcatactgagacaggataagcaaattgtaatatttggcgcgggaattatgggaatgcaatttgcgtatacgttgcaacagttgggaataaataattttattttttgtgacaacgattcgcaaaaatggggtgtccgactagtcggtacaacgataaataaccctatgctgttacaaaatggagataactattttgtttatcttgcaatggaaaactatgaagaatgtgcgccccagcttgaagaaatgggatttgagatggggatagactgggttaatctgacaaactgctcagaaaggaaattgctggattcatttgaaaaaaatgatgatgcgcatgtcttgattttaggagattgcacagtgtctacagtctctgtgcaagagaaatataaggtatcgataggcgaaatattgagaaaaaccggggatacaaaagtacttgcattaaatggcttatatatgagaagctattataacattctgagactatgcaaaaacagaatgaaatatttacaagaggtttatgtgctgctgaatgttgacataatgggaaatcgatattttttgtatcccaaaaaccagcatggcagagtaatgaaagagttgtataaaaaaagtaaaaaaacggatgataaagagatgcaggactttcttcaagttattgaagaaagagaaaaagggacaagtatcttagatttgtcatctccgaatcgttataaacatttatcggaaaaggaagttgagaatcagagacgagtccatatgaagctcaattttttgtatcatatatcggaaaatacagagagtatggaatatctgcatcatatcttagatttctgtagaaatgtaggtataaagataacatttgtgattatgccgataaattatgagcggggagaagagtattttggtgatgaatttcggactcgttacggggaaattataacggtgttacagaggcatatcataaatggcaaaggaagtatattagatttaagttatttgctgcctcagggggactttatctgtcttagatccacgaatgagggaattctggaacatggaagaaagctaatcgcagaaaaaattgtggaacggatgaaaaaaggatgtcaaagcgaatggagtggccattaaaaactgcacaaaaagagatattgaaggcatttgatcaatttgtaatagaaaataaatcgtttttagaaaataaaaagctgctagtatggggcgcgagtgttcgcggcactttgctgggtatgatacttgaaaaaaaggggttaatagatttcctgtatatcgacaatgatgaacgaaaatggggaaatcatattaatgggcattccattttaaatccgaacgaggtaaggaatcaattacaaaatacttttattcttataccggtagaatatcccgaagaaatttgtaaacaattatatagttggggattaaaagaggattcatttgcagttataaaatccaatattgaaaaaagctatacagaagaatttttccggcaatatggttatgaccgattggttataggtgaaacttttttaaatgaaacaatcattgatgaagaaaatccggaaagtataaaggactgcctgtggagaacatataaaaaagaaaatatgaaagttttggcaatgaattgcatgggaatgcagggcttttatcatatgatacggttgcagattatgcttggatatgtgccccaaaaggtatggattttcgtcaattttgaaacattaacggaatttcatcatatgttgtcgagaacacaacatccggatttgttgaagatgatcgctgaaacaggacaaatccgggatgagtattttcaacagtacatacagcaggcggaggaaagagcaagaaattataaaattgaaatgcagtattctccacaaagaacatttgacggtaaaaacgttgacaatgagacgattcaaaaagagtatatgaagattcagattcttcgaccattatctttggagacagaggaaatgttatatttcaaaagaatattgcaagtgcttagaaaatatgacattgcaggatatgttatcaatacacctatcaactatcaactggcaaagaaattatatcatgaagaatttgtggaaatttatgaaaaaaacagaagggtgcttaagaagcttgcagatgactataaatgccaattttgggatatgggtgatttgctggaggagggagattttgtttcgatggtaacgattaacgatgcggtttgtcagagcggaagagataaaatccttgcttatattgacagaaatgaggagatggaagatggagcagaaaattaattttgcgtggccggtaacttcgagcagcaaggaagaatatgtagctttttgtgaatggatgacagcacataaaacaatgttggaaagtaatgagattgctatttggggagcaggaattcgaggaactgaattttcgttgttttttaaacgaacaaactatacaaaaattttttttgtagatagtaacaaggagaaatggggaggatacatcaatgaatttccgattgtttctccggatacaatgagagagaaaatccagacaggaaaggtaaaaatattaatatccgcagaaaatagtaaagaaatagaagaatttcttgaagaagatggttataaaaaggaagaagatttttttacagttagatcaaatttatatgaaaaatatgtagaagaatttattcgtccttatacaagagatgtgttgattatgggagattgtgaattttcgaaaatctctttggaagatacggatatgcggaacctggcagaaatgttaaaagacgaactgggagagcgccgggcaaaagttttggctatgcatggaatgggattacgatcgcattataatttgctgcatacgcagattgccatggggatgattcctaagatattagtgattatgataaatctggatacgctaacaggtaaacagcatttattgccaagatcacagcatgaagaattgttaagaatggtatacgaaaaggctcatgtagacagcaaagagtatgaagaatatctcgaaattgtgcatgaacgcaaaaagaatcttcaggcagaattttttactactaataaatttggaaaaagagatgttccttccgatgcgaaatccaaagtatactttagggttaattacctttatgaattggatgtggaaacagaggggatacagtatttgaaaaaaataattcaactggcaagggaaaataatataaaagtaattccatttgtaccgccggtgaattacgaacttggggaaagaattttcggagcggattttaataaacgttatgctaagaatgtaaataaaattgatagtatagtaagagaaaatgatctggagcttttggaaatgagctatagtttaaaacagaatgaattcgctcagccagacacgcctgatgaaacagctaatgatgcagggagaaagaaagttgcggaaatattgtgccgaaaaattgaggaggtaatgtaacgatggaacaggaaatattgcatatattacaggaaataaatccatatatggaaatagaaacagatacgaagctgttggaggaagaaattttagattccatggagatattattgctgatatctgaattagaggataagtatcaaatacaaattccactggaaagtttacagttagaagattttcaagatattttaagcattacaaagttcgtaaaaaagcaaattgagggtacgcaatatgataactaatgtaacacagtacttggatcaaagaaagattgatagtggaaaaaaagtggcaatctcagacggagaaaaaagtttgagttttgaggagctgtatgatcgctcacaaagagtagcagtaagtattaggcggaaaaataataacataaataacagacccatcattatattcggcaataaaggaatagcagagtatatagcatttatgggagtgctctacagcggaaattattatgttccgcttgatgtaaaaatgccggttccgcggttggagaaaattgttcgcttgctacaggcagaagtggctattgtagaaaacgagtatgaaagccgcttgcgcgaggctggatatgagggagaagtcatttatttacaggatgatccggctattgaggaacagcaggtgcttgaaaattacagaggaagagtggtggatacagatcctgcatatgttttatttacgtcagggtcaaccggaacaccgaaaggtgttgtcgtgagccatagggcgatcgttgattacatagaatggcaatgcgcgtatttgccttttgataagaatacagttttgggaaaccaggcacctttctattttgatgcgtcgatgccggatatatatacaccgctatgtatgggagttacattatatattattccggaaatgctgtttctggttccgaataagttggttgattatatcaatcagtataaaattaatacattaatctgggtgccgtcagcgctgatgacattaacaaatcgaaattattttgaaaaaaagaagattgatgacttgcggttagtgatgttttgcggggaaataatgcccaataggcatctgaatatttggagaaagtattacaccaagaccgagtttgttaatttgtatggaccaacggaggcagcatatgcatgtacctattttgttgtaaataggccgtttgcagataacgaaccactaccaatcggaaagccttgcgaaaatacggacataattgtactgaatgaaaataatacaagggttcagcagggagaagaaggcgaattgtgtatacggggcacttgcttggcaaacggatattatgataacaaggaaaaaacccttcaggtatttacacaaaatccacttaattcattatatgaagataaaatttatagaacaggtgatattgtaaagtataatgaatttggggaacttgaatatgttggaagaactgattttcagataaaacatttgggctatagaattgaactgggagaaatcgaaaccgctacttatggattagatggaatcaagcagtgctgtgcaatatatcaaaaagaggctgataagattgtattgttttgcgttggagatttggaacaaacagagaagcagatatatacatacttaaaggaacatataccaagatatatgttacctgggaaaattattttactgcaagagatgcctctaaacgcaaatggaaagattgatagattgctgctggcgggcaagatacaactataaaactataaaacccgaattgactcaagtatttcctgatacgaagtaatcgtgaataatagaccgatggacaatttgcggagaaatgtggcgtttgaaaggttatacggaggttacagatgatacgtgacagttatttaaaacaaatcgtagaattgcttgacaatataagattttccggagagaacggtctggataatacaagctacaccgaaagcatggagctgcttacgagacagtttgagaaggtcagagcgggcaaaggtcgggtcttttttatcggcaatggaggaagcgctgcgattgcaagccatatgacggcggactttatgaaaaacggagacatgagaacatatagcttgtacgataatgcggttcttacctgccttggaaatgactatggctatgaacatgtattttccaagcaactggaatcgctgatcgaggagggggatctgttggtgtgcatcagcagctccgggaattccgaaaacataataagagcaattaaaacggcaaaagaacatggggcatatgtgattacctttactgggtttgatgcggataataaagcgagggcgatgggaaattttaatgtgcatgtaccggtcagacaatatgggatggtagaatccattcacaatatgatgcttcagcagattgtggacatgctacatgaaaataaaaagtaacgtgtatgattgtgtatggtggaatacgatccggaaaatgaaaggaatcccacatgaacctatccatctgtatcattacaaaaaacgaagagcagaatattgaacgctgcttaaaggcacttgttccgtacggtctggagacgatcgtggtggataccggatcgacggaccgcacgaagcagattgcggagcgctacacggacaggctgtatgatttcctgtggtgcgatgacttctcggcggccaagaatttcgcgatagaaaaggcttcacattcctatgtactggttttggacagcgacgagtttgtagagcagctggatctgtccgcgctggaaaaacagattgccgcgcatccgggggcggtcggccggatccgcaggcggaatgtgtttcacagaaacggggaggagcaggagaaccgggagtggatcaaccgcatattcgcaaaagaatattttcactacgagggcaggatccatgagcaggtgacgcccctgcatggcgcagagagcggttaccggacgtatgagacgccggttgtgatcttgcacaccggatacgatctgcccgagcagcagaaaaaggaaaaggcggagcgtaatatccgcctgctggagcaggaattaaagcagctgggctgggatggaaatgccggggcaaaagacggcgtcgcaaaggcagagacagccggaacagatgcgaatgctcgttggagcgggcagattccgtatcttctgtatcagcttggcaagagctattacatgatgggagaatacggcgcggcgtgcggctggttcgcgcaggggctttcgtttgacctaaatcctgcactggaatacgtgattgacatggtggagacgtacggatatgcgttaatcaacagcgggcaggagcagacggcactgttttttgagaatatctatgacgaatttggaaaaagtgcggattttcagttcctgatgggattgatttacatgaaaaacgcacggttcacagaggcggtgcgcgaatttgagaaagcggccgggcatgcagagtgccgggcacagggagtgaattcctatcgggcagactataacatcggcgtcatctacgagtgcctcgggaaaaaggaagaggcgcttgcctattaccggaagtgcggcggctatgcgccggcagaggagcggatacgcgagctggggcggaggtagaagaaaaagctatgacaacgagagaagaagcattggaatacggaatgtcatttccggatgtctatgtggatacaccgtttcacgatccaaactgggtgctggtgcgttcccggaaaaataagcgggcatttctctggacttatgaatatcagggacagatgcggattaatgtcaaggcagatccggagtggattgatttctggcggaaagcgtacgaagcagtcattccgggttatcatcagaacaaaaagcactggaatacggtcatccttgacggcagtgtgccggatggagatgtaaagcggatgatagcggaaagctacgatctggttaggtaagggtagtgtcgtgctcgtgcctggatatatgaggggatgcaaatagagttgtatttgaggctacagttggatttctactatgtttgacagggatcgaggcgttaagtgtaatgggactggcattactggcagtggggattttatccggtttaaaggcttatatgcagagcgtaggaaaagcagcacttcaggctattctgggagcaggtacatcggaggttgtgaaagagttattgactctggtgctgcggaaaggatgatagcgatatcgaaaatgcttaaaagaagatggcagggacaacgggaaccctgccattttattcgtgaatattttggacagatagatcgggtttataatttacataacagatccggggtggaagcctacattaaatccttgcatgtgatataaggataagaacatacaaggaaataactgggaagtaactgggaaatgacgttgcaatttcccacccacgggcttataattggggcagttaggggagggcatgcaatgcaatatatgacatccagacagaaagctacagaatggtctgtcacgaagcgtatggtaaattactggtgcgcaaacgggcagattgaaggtgcatacaaagaaggcagccgctggtggattccagtggatgtagaacgtcctggagaagaggagtgtttgcggcgcatgagagcgtacaccgttcggattacaggcaagaagagcgttgcggttggcattcaggattttgaggcgttaagacgtgatcagatgttttatgtagacaagacggattttattcggcagtggtgggaatctggcgagacgactacgctgattacacgccccagacgttttggcaagacgttgaatctgagcatgctgaactgctttttttccgtgttctatgaaaatcgtgcggatttatttgaggggttgaaggtttgggaagagaaaagctatcacaagctgcaagggcgtttccccgttatatttctgtcatttgcaggtgttaaggggacaacgtttgaggcggtgcttcggcagataaattatggtattatagaggtatatcgccgctttgagcggatacttgacatgtcgcggttcacggaaagggaacgacaggattttggcagaatatcatgggacatggatgcgtccacggctgcgcagtccgtacggcttctgacggatttgctctatgtgtattatgggcataagcccattattttactggatgaatatgatactccgcttcaggaagcttactttaatagcttttgggatgagatggtttcttttgtgggggctttttttaataattcctttaaaacgaatccatcgctggggagagcattgctgacgggcattaccagaatatgcaaggaatctatcttctccgacctcaataatatagatgtggtcacacaaacgagtacgaaatatgagacggcatttggctttacggaagaagaggtaaaggtgggacttgccagagtaggtctgctcgattacagggaaaaagtaaaagaatggtatgacggatttacatttggacagcgcagggatatgtataatccgtggtcgatcacaaagtttatcgatgcagaggggatctttgatacttattgggcgaatacaagtaataataaactggtgagctcgttaatccgaaagtcttcaaagaatatgaagatggcgatggaacagcttcttgaaggagagatgttacatgtggagatggacgagcaactggactttgcacaattggagtatcgggaatcggctattttcagccttctatatgcgacggggtatctacgcgtaaaccaaaagaacgatcaggaatatgtgctgatgctgacgaacaaagaagtggagattatgtttcgacgcattatacgggaatggtttaacgatatggatactggctatggagatttcagaagagcgttgctgcatgataatatagaagagatgaactactatatgaatatggtcacgctatccaccttcagttactttgacacaggcacagggcgtggtaatattgatgagacagagcgcttttaccatggctttgtgcttggattgctggcagatttatcagatcagttttcaatacggtcaaacagggagagtggtctgggaagatatgacattattctccgcgcgcgggaagaaaacggcaattcttacattatggaatttaaggtttttgaccgggagagagacgagaatatgaaagcgtgcgttgcaagggcgttgcagcagatagaagagaaacaatatgagacagagcttgtggcagacggaattgcgagggagcggatcagaaaatatggatttgcatttgacggaaaaaaggttctgatcggttcatagaaggagagtatcttgaagcataccattatttattttatcggtgtatacgacacacttgatttatttaccggaaaattgcgggaagcttttgagacgatgggctatgcgtcctttgtgtatgacgcgcggctgccgcagagcaaggatgcactgctttctgtgcttgcggagagcagttcgccggagcgtgaattttcatgtgtgacatttaataatctgggatacaatctggatatggaggtgcctgcgccggcacagagcgtacgggagaacgatgcgtgtatacaaaagggtgggaccagaaatgtctgggaatattacggcatcccgtatctcaacattctgatggatcatccgtttcactatgagaagccgctgcgcctggcgccggagacgtcggttgtgctctgcacagaccggaatcacgtaaaatatatccgcagatattttaaaaatatccatcaggtggattttcttccgcatgcgggagtggagctgggaagccggcacaagccgcttgcggagagagggattgacgttctgtatgccggagcgcttccgatttatacggtggcaaaaatgataccggatctgtcttccatcccggaagtggatggacagctgatggcgggggatgtgctggcggaattggtgcaccatccggaccggacgacggaggaagtcattgaagagtatcttaaagaccggcgaagcgatatcccggacaagcgcgtgcaggagatcattgtgcagatgcgttttatcgactcctacgccacttcgtttttcagggagcaggcggtgcgtattctggtggaaaacggaatccgggtcacggcgtacggtacgggatgggatcagtgcgagtggagcggcagcccgtatcttgattaccgtggaaaagttcttgcgccggagatccttccgtctatgaacgatgccaaaattgtgttgaacacgatgacctggtttaaggcaggagcgcacgatcggatttttaatggaatgctggcgaaagcggtggtggtaaccgacgattctacctatctgcgccgcgaatttaccgatggcagggaacttgtgatgttccggcggcaggagcttggaacactgccggagagggtgtttgatctgtttggacatctggagcgggcacaggagattgcagattgtggatatgctgcggcgagagacggtcatacgtggaaaagccgtgcggagtatctgaaggagtgctttctgacctgacgaatgcacatgggcgaagatgggagcggtaaatgtaagcttctgcgcgcggtaaggcgaacaaaggcggtaagtctctgcgcgcagtactgcaaagaaggcaatatataggatagaggaatggacagctatgcacatattgatgtaccgatggaaagcatataattacagagacattgagcagacttttttgctgcttggacatacggtggacaatatcgaacaggaactcggaagctatgacgtaagtcctgaatttgagcgggtgatcgaggagaagatccgggggacgcattatgatatggtatttacggtgaactatttcccattgatctcgaatgtatgtgagcgcacaggcgtgaaatatgtttcctggacatgcgacaatccgctgatcagtatgtaccatgaatcggtgttccacgcctgcaattacatttttacgtttgataagacgaattacctggagttccgcgggatgggcgtaaaacatatctggtatctcccgctggcggtagatacggagcggatggatgcgctgctcggggcgccggaaaaaccggaaagacggaatgccacacaggattcggagatgcggaaataccgcggagatgtggcgtttgtgggaagcctttatgaacgcaattcctatgacaagatcaaaaacaggctgccggagtatttaaggggatattttgacgctgttatggaggcgcagcttaacatcagcggagcgaatatcgtggagccgatgctgaccacgaacattctcgaacagctgcaggaatattttcagctggaaaaatccgagggatctttttcggatctggggctgattttccagacaaccgtgcttggattcaagattgcggagatcgagcggagaagggcgctgattgaactttcaaagcattacagggtcaatgtctacagcaacagtgatgtcagtgatctgctgcggattcagtattgtgggtcggtggactactggagcgagatgccgaaggttttccgcatgtcgaagatcaacctgaactttacgataccgaacatcaagagcggtatcccgctgcgtatctgggatgtgcttggctgtgggggcttccttctgacgaactaccaggcagagattccgtactattttaaggagggggaagatctcgtctgcttcgacagtctggaagacctgtgtgaaaaggtgggatactatctggagcacgaggaggagcgtaagcggattgcatggaacgggtaccgcaaggtgcgggagaagcactcttatatagaaagaatccgtaccattttagatacggttgcatgtgaagacgcaaaataaaaaggtggcggcgcactgccggaccgctgtgaacaaaaggaattgccgcaataagcatatcgtgctttgggctgataagtaatattataagaaacagatacttaaaagttccagataaccatgcggcggcaaattctgatcgcaaaatccggtatttctaaccatgccgcagctggcatccgtgatgatccgtgtctttccaagtttggagcactccacggactgtgtgcgcaagccagcagacaattttaggacttttgtgtgtgtcccttgcggcaccagacaacagatggcataaatgccatctttatgtcgaacaaaacataaccgcgcgaagccgatgtctgagttgccatctgccatatttttaatagcagatggcaacgagtttcggttcgcgcggttttatattgtctgtgaagaggtgccattagggacaccagaaagtccgctcattgtctgcggcttgtcggacacactccgtgagtgtccaaacgtggccaagatacggaatgggatgccagccacggcatggaagaaatacgtgaattttgcttcaaagatttgccgccgtctgtttattctggaacttttttgttctctggtatttctgtaatattacttatcaccccaaagaggcctacgcgtattgcggcaatttcctttaacaataggtatcaagcatcagaccggaatacaccgaagagtgataagccgccgcaaaattgtgccccggattcttgtaggcaatcaggactttgctgacatagctgatcgggtcgatggaagcctgggtggctttgcgttgaagaccgtttttgaaattgttcagggtacgaaaactttcgcgtgcgtccggtgcggaaacggcgtcggttaacaggttcttgtcaatctggatcgatccgtcctgctgcagattcagcccgatggattccaactcgttgaaataggactttgcaacgctctccatatcgtggagaagcttgccggactcctgactgccgtggtaattgtgaccgagctggatcatgttgttgtagacgttgaccagcgactgcacattgtctgcgaccgcatccgtatccgctttgaagccgatcgttgcggattccccgtcggcactgggggctttcagcgtcagttcaaaagcgttgttgacagtaaatgtgttggacagcgacgaatgttcggtaccgtttaacaaaaagagcgaattgaccggcatttccgtgacgtcgttgatgccgagcgtgcgcatggcgcgtatggaaccactgtccggcgccggcataatctcaaacaggtactgctcgctatcgccgagaccggtctgctgcgacgtgatggaaagcgcattctgtccgcggtcgttggagaccagtgtggcgtttaagccgatattggcattattgatcagccgcatgatcttgcgctgcacggtctcgttggtgtccctgccgctgatcgtgtactggaattcataagagcttaagttggtgttcaggtcgaagctgtaattgcctggcacaaagtcacttgcgcccggggcaagatacacgccgcggttgacctgcggtgtggcgagacgttctaccgttatatcgaactgcttggagttgtccgcgtccatgttcgagccgatgtactgcacactcacagcgtcctcatcagaagactgcgcgattttccgggaaaaagcgtgttccgcattgtcgtccggagcattgtttgaaagcgctgcgataaaattctcgatcgagcgggcctgctccttgatgtcgatggcaaaacggccggtatccctggtgaaattgattttgtaaaggggggaatctttattaactttgacaatattattgtatacggcgcgcagctggctttttttgtgcgtgtcgtagcgagacatgccggaaccggcataagtgctcaggtaatactgataggcactgtcgatgactgccattgaaatccctcctttcttccatgaaatcatatgccttcgcatatgcagggatataaatccgtttatattgcttcctgcttatatataatgaaactgtatttttaaatgcacaatagatatacttctaataatttttatcggtaaatagatataaaatatttacagtaaaaataaaaattacgccatagatttgtaaaatcagaaaaaagacttgcggcacactatatgtagtgctaaaataaattcgttgcacgagtttaaaaaagtggttgacgctccatattgattgtgatatattagactagcgatggaagtaggtcttttttttatgcctttttttaggacccctttcctgaggggatctaagcccggtcgcagggaacgaaagacataagaaaagcacaaagaattttaatggaggtggaagttgtgcgcacgaaaataacattggcatgtactgagtgtaagaatcgtaattacaacacgacaaaggacaagaaagctcatccagacagaatggaaaccaagaagtattgtagattctgcaagactcatacattacacaaggaaaccaaataggcttttgggcaaaggagtgagaaaatgggagaaaccgagaacaaagctgctcagaaagagagcttttttagcggcctgtcggctgaattcaaaaagatcatttggccggacaacaaatcacttgcaagacagacagcagccgttgttgctgtttccgtagtaatgggtcttgtgatcgcgcttctggattttgtgattcagtatggcgttgatttccttgttggtttaagtttttaatggaggcataggtgatttatggcagaggcacactggtatgtagttcatacctactcaggatatgagaataaggtaaaagcgaacattgacaagacaattgagaaccggcatctggaagaccagatcttagaggtccgcgtaccgatgcaggaggtcgttgagctgaagaacggcgcaaagaaatccgtatcaaagaagatgtttccgggatacgtgcttatcaatatggttatgaatgatgacacttggtacgttgtcagaaatacccgtggtgttaccggatttgttggtccgggatcgaagccggtaccgcttaccgatatggaaatgagaccgcttgggatcaagacagagaacattgaggttgattttgctgagggagacaccgtagttgtcaccggaggagtctggaaagataccatcggcgtgattcaggcgatgaatcctggcaagcagagcgtgaccatcaatgttgagcttttcggccgcgaaacgccggtagaaataagtttcgcagatgtaaagcttgcaaattaagcgagcaatcctaatcaggaaagaatgaattaaggaggcaattccaatggcaaagaaagtagaaggatatatcaaattgcagattcctgctggcaaggctacaccagctcctccagtcggacctgcacttggacagcacggtgtgaacattgttgagtttacaaagcagttcaacgccagaacagcggatcagggcgatttaatcatccctgtagtaatcactgtatacgcagacagaagcttcagcttcgttacaaagactccgcctgctccggtactgatcaagaaggcttgcaacatcaagtccggttcttccacaccgaacaaggataaggttgcaactctctccaaggcaaaattacaggagatcgcagagttaaagatgccagacttaaacgcagcatccttagaggcagctatgagcatgatcgcaggaactgcaagaagtatgggcgttaacgtagagcagtaagacacgagagtgtaatgcatcagagagcaccggcggtgttcttatggaacgatatagtgggagggtcctctcccgatactaccaccaggaggtttatattcatgaaaagaggaaagaaatatcaggacgctgtaaagtcttttgacaaggcgaatcagtacgatgttgctgaggcaatcagcttagtaaaaaagaacgctacagcgaagtttgatgagacaatcgagcttcatattaagaccggttgtgatggacgtcatgcagagcagcagatccgtggcgcagttgtactgccgcacggaacaggtaagactgtaaaagttttagtattcgcaaagggcgtaaagttagatgaggcacaggcagcaggcgctgactacgttggaggcgaggagttagttccgaagatccagaacgagggttggttagactttgatgtgatcgttgctacacctgacatgatgggcgttgttggacgtctcggtcgtgtacttggaccgaagggcttaatgccgaacccgaaggctggaactgttacaatggatgttaccaaggctatcaacgacatcaaagctggtaagattgagtacagattggacaagaccaacattatccacgtgccagtaggaaaagcttctttcactgaggagcagttaagcgacaacttccagacccttatgggtgctatcaacaaagcgaaaccgtccagcttaaaaggtcagtatgtaaagagcgcaactcttacatctaccatgggacctggcgttaagttaaacgtaaccaagatcacaaactagtttgtgttgttggcgaaaagtgttgacagccgcaatatacagtgttataatgcagaagcgttgtaacgcggtgcgtccgtacggatgcagtcgtctcacataagacagatgccacagcagtggcagatccacatctgtggattgcatataatggccgaagacagcaggtgccgcaaggcgtaatcatagagcctgccgagggactttcatgagcaatcattgagaatgagattctgatccctctctgtccaggcagagagggatttttatatcctttcggatttgttatatgcgtaaaatctaaaaaggaggtgcacgattcgtggcaaaggtagaattaaaacagcctatcgtacaggaaatttctgaaaacatcaaagatgcgcagtctgttgtagtcgttgattaccgcggacttaccgttgcagaggatactcagttacgtaaagcattaagagaagctggtgttacttataaagtatataagaacacattagtaagccgtgccgtagagggaacacagttcgagagcttaagagacgttcttgagggaccgaatgcattcgcaatttctacgacagacgcaacagctccggcaagagtattagcagatttcgctaagaaagctccggctcttgaagtaaaagcaggcgtagttgagggtaacttctatgacgaggcaggcatgaaggcaatctcttcgattccgtcaagagaagttcttctttccaagttacttggaagcttacagtctccgattaccaatcttgcccgcgttcttaatcagatcgcagaaaagggcggtgcagctgacgcggcagtagaggctgctccggcagaggaagctcctgcagcagaagcagcagagactccggcagaataatccggatcgaatgtagtgaaaaaagccgcagggatctgcaggcagaaaacgtatcatcgtgatacaatctcaatattaaatggaggaaaataatcatggcaaagatgacaacagcagaatttattgatgctatcaaagagttaagcgtattagagttaaacgacttagtaaaggcttgcgaggaagagttcggcgtatctgcagcagcaggcgttgtagttgcagcagcaggtgctggtgacggcgcagcagcagaagagaagactgagttcgacgttgagttaacagaggttggcccgaacaaggttaaggttatcaaggttgttcgtgaggcaactggcttaggcttaaaggaagctaaggatctcgttgatggagctcctaaggttctcaaagaggctgctgacaaggcaaccgctgacgacatcaaggctaaacttgaggctgagggcgcaaaggttactttaaaataatcgcgtaagctacgagaagcatataagcggaaacggagccatggtggaaatttatttcctgccatggctccgtttttgcttatgcgcggcgacagccgcgtgctgaccggctctgccggacagaatgcttcccgcagcatgcgcgatttgcttatttgctctgcttctatgcggcgacagccgcgtgctggccggctctgccggacagcgggctcccgtagcagctgcgccggtacgggaaaataaattccctacttcccaaaagaaaacacttggtatatgatagtactaacaggatttataggaaaatagtacttttccagaggatgaaagtacgggaaagaggagaagataccatgccgtgtttgaggatgtcggtcaaccgcctgcgggagggaatgatgataaaagaggatgtgttttcaaagacaggggcggtgattgtgccggacggagcggtcgtcacgaaggacgtcgtcgcgctgctgaccagacattttgtggacagtgtgatggtggaatatccgacgggcaggaaagaacgcccggaacagcaggaacagagtgcgccggcgaaggaacagcatctgaaagagttccaggcagagttctcggttgccgaacagtcgatttcggaagaactgaaagatattgtataccggagtaaggatgtgaacatttccatgctgctggagccgctgaacggactgctgaaaaaagcggatgatgatacagatcttgcggacatgctgcttcatatgaaaaaacagcagtcaggtctgtacgcacataccattaacgtggcgctttttggacagcttcttgcacggtggagcggatgcaccgaggcggagatggaggaggtcatggcggcggggctgcttcatgacattggatttcttgaactctggaaggacgggcaggaacagacggaatttctgcaagaatacgagacggaacgatatgagaaacatgtcgtgagcggatacaaccttattaagaagatgaacatagaccagcggattaaacaggcggttctgacgcaccacgagcgcgtgaatggaagcgggttcccactgcaggtaatgggggataacatcaactggatttccagaattcttgcggtggcagatacttacgatgcccttacgatgcgtcagggagataaagcgggcatctcggcatttgaagcgatcaagaagatggaggatgaggggtataaccgtctggatgccaactatctgatgacatttctgaagcggattgccgagacgatgatccagcgcaacgtgatcctgaatgatggcaggatgggaagagtggtcatgattaacaaatataagctgtcatgtccgcttgtgcaggtgggggacacttttgtcgatctcgcaaaacaaagccggtattacattcaggagatacttgaagagtagcggtattgtgtgttataaagaaaatagaaaaggcgggcagggagagcagcggaacttgagaacagaaaggaggcttttatgaacggtattacttcgatgcagcgaagcagcacatcttatgcagattacgggaaattcgcaaacggcaaaaaagtgaaccgggcggcagacggtgcggcggagcttgcgatcatccagaagcaggagacgcagaccagaagctataaggtcggggagaacaacattggcgcggcaaaagatatgctgaatgtggcggatggcgcaatgagcgggattacggattatcttcagaagatccgtgaacttggtgttcgggcgtccaatacggcgacgatcacagatgcggagcggacaagtattcaggcgcagatcgagcagtataagcagggcatttcagatattgcaaaacagacaagctttaacacgaagccgcttctggatggcacgtcgcagaagtacaatatcatgacggatgccaccggcaacggaatgaagattacgaatgcagatgccacattacaggcacttgggattgcggattttgatgtgacgaaagattttgatctgacgcaggtggatgatgcgcttgccagagtgagtgcagggcgcagcggtatgggcgcacagagcaatgcattggagtatgcgtaccgctacagtaccaacaccaggctgaatgtaacggcaggaaaaagccggctcgaggatctggattacggacaggcggtatccgaacagaaaaagaagcagaccctgcagcaatatgcattttttatgcagaaaaaacagatggaacagagaacccgcgcggcggcaaattttcttgtctcataagcggtggcgaacggcggagcgaaggctttagagctttccttcgtcgttttttacgtactcacggagaagaaataaatattttaaaaaatccttgacgcggcacttgctattgtgctatcatatacgttgcactattgtggtgcattgggcttattgcgcgcttttcgcgttgtatgccgccggatgtgcctataccgtatcttgtggttacggtggattgagacagttgctgccacttttggggcagcttagtgtaaataaaaacgagaggtgaaacgtcaatggagaaaaacagaatacgtccagtgaaagctggaaagggcatacgtatgagttactcgagacagaaagaggtattggaaatgccgaatctgatagaagtccagaaagactcctatcagtggttcttaagcgagggcctgaaagaagttttcgatgatatctctccaatcgctgattacagcggtcatctgagcctggagtttgtagattttacattgtgtgaggacgatgtaaagtacacaattccggagtgcaaagaaagagatgcaacttatgcggcacctttgaaggtcaaggtcagacttcacaacaaggagactgacgagatcaatgagcatgagattttcatgggcgaccttcctttgatgacagagaccggtactttcgtgatcaacggcgcagagcgtgttatcgtcagccagctggtgcgttccccgggtatctactatggaatcgctcacgataaagtgggtaaaaagctgtattcctgtactgtcatccctaaccgtggtgcgtggttagagtatgagacagactccaatgacgtattttatgtccgtgtagatagaaccagaaaggtgccgatcacggtattgatccgtgcacttggcgtcggaagcaaccaggagatcgtagacctgttcggtgaggagccgaagattcttgcaagtttcggcaaggatgtggcaaccaactacgaagagggacttctggaattatataagaaaatcagaccaggcgagccgctgacagttgagagtgcggagagccttatttctgctatgttttttgacccgagaagatatgatcttgcaaaggtcggacgctataagtttaataagaagttaatgctgcgcaaccgtatcaacggacatgttctggcagaggatgttgtcgatgtgtccacaggtgagatcatcgccgaggcaggaaccgaagtgacaagatccctggcggatgatattcagaacgcggctgttccgtatgtatggattcagggcgagaccagaaatatcaaggtgctgtcttccatgatggtagatctgagacattatgtggactgcaacccgaaggatctcggcatcacagagctcgtgtactatccggtattaaagcagctcatggatgaatatccggacgtggaggatttaaaagaggccattcacaagaatgtgcatgacctgattccgaagcatatcaccaaggatgatatttttgcatccatcaactataacatgcatctggagtacggcatcggccatgatgacgatatcgatcatctgggcaacagacgtatccgtgcggtcggagaactgttacagaaccagtaccgtatcggtctttccagactggagagagtagtccgcgagagaatgaccaccctggatctggacggtatttccccgcagagcctgatcaacattaagccggtaaccgcagctgtaaaagagttcttcggatcttcccagctgtcccagtttatggatcagaacaacccgctgtcagagctgacacacaagagacgtctttctgcattgggaccgggcggtctgtccagagaccgtgcaggattcgaggtgcgagatgtacattactcccactatggaagaatgtgcccgatcgagacgcctgagggaccgaacatcggtctgatcaactctctggcaagctatgcaagaatcaacgagtacggatttattgaggctccgtaccgtaagatcgataaatccgatcctaagaatccgcgtgtcacagacgaagttgtctacatgaccgcagacgaagaggataactaccatgtagcacaggcgaatgaggcgctggatgaggaaggacatttcgtccgtaattccgtatccggtcgttatctggatgagacacaggaatatgagaagaccatgtttgattacatggacgtctccccgaagatggtgttctccgtcgctaccgcatccattccgttcctgcagaacgacgatgcaaaccgtgcactcatgggatccaacatgcagcgtcaggcggtgccgcttctgaccacagaggcaccggtagttggtaccggtatggagacgaaggcagcggtagactccggtgtgtgtgttgtggcgaaaaaagccggtgttgttgagagctctgagtccaaccagatcatcatcaagaatgacgagggcggcagagatgtatacaagctgacgaagttctccagaagtaaccagtccaactgctacaaccagaagccgatcgtgtttaagggcgaccgcgtggaggttggcgaagtgatcgcagacggtccttccaccgcgaacggtgagctggcactcggcaagaacccgctgatcggattcatgacctgggaaggttacaactacgaggatgccgttcttttgagcgagcgtctggtacaggatgatgtttatacatctatccatattgaggagtatgaagcagaagcgcgtgacacgaagctcggaccggaagagatcacgagagatgttccgggtgtcggcgacgacgcgttgaaggatctcgatgagagaggtattatccgtatcggtgcggaggttcgcgccggtgatatcttagtcggaaaggtaactccgaagggagagaccgagctgacagccgaggagagactgctccgcgcaatcttcggcgagaaggcaagagaagtgcgtgacacttccttgaaggtgccgcacggcgagtacggtatcatcgtggatgcaaaggtattcacaagagagaacggcgacgagctgtctccgggtgtgaaccaggcagtccgcatttacattgcacagaagagaaagatctccgtcggtgataagatggcaggtcgtcacggtaacaagggtgtcgtttcccgtgtacttccggtagaggatatgccgttccttccgaatggccgcccgcttgacatcgtgctgaacccgttgggtgtgccgtcccgtatgaacatcggtcaggtcctcgagattcacttaagccttgctgcgaaggcactgggcttcaacatcgagacaccggtattcgacggtgcgaaggagattgatatccaggatacgctggagcttgcaaatgattacgtcaacttcgagtgggaagactttgaagcaaaatataaagacacactgaatgaggaagtcatgaagtacctgtatgacaaccgcgcacacagggcactgtggaagggcgtgccgatttcccgtgacggaaaggtacagcttcgtgacggacgtaccggagagccgtttgattcaccggttacaatcggacacatgcattacctgaagctgcatcacctggtagacgataagatccatgcgcgttctaccggtccttactccttagtaacgcagcagccgttaggtggtaaggcacagttcggtggacagcgtttcggagagatggaggtatgggcactcgaggcttacggtgcatcttataccttacaggagatcctgacagtgaagtccgatgacgtggtcggacgtgtgaagacttacgaggcgatcatcaagggtgacaatatccctgagccgggtattccggagtccttcaaggttctcttaaaagagctgcagtccctcggactggatgtcaaagtgctcgatgagaaccgcaacgaagtagaactcatggagaccagtgagtacggtaataccgatttaaattctatcatttccggcgataaggattttgcatttgaagacagcgagtcctttgcaaagatgggattctcccagaagcagtttgatacagagaacgaggaactggtagacgtagaagatgaggaagaggatgaagacgattctgagttttttgatgagtcatcagacgacgttcttgacgaagaatagatagaagggagtgtcataaatgccagagacaatgaataaagaggcaacaggccagtctatctctttcgatgccattaagatcggtttggcatcaccggagaagattcatgagtggtccagaggcgaggttaagaagcctgagacgatcaactacagaacattaaagcctgagaaggatggtctgttctgtgaaaagattttcggaccgagcaaggactgggaatgccactgtggtaaatacaagaagatccgctacaaaggtgtggtatgtgaccgatgcggcgttgagattacaaaagcaagcgttcgtagagagcgtatgggacatatcgagcttgcagctccggtttcccatatctggtactttaagggaattccgtcccgcatgggactgattcttgacctctctccgagaactcttgagaaggtattatattttgcatcatacattgtactggatgccggtaacacggcattacagtataagcaggtgctttccgagagcgaatatcaggaagccagagagcagtacggcaatgcgttccgtgtcggaatgggtgccgaggcaatccaggaactgttacacgcgatcgatcttgagaaggattccgcagagcttcaggcagagcttgcagacgcaaccggtcagaagcgcgcgcgcatcatcaagagactggaagttgtagaagcattccgcgagtccggcaacaagccggagtggatgatcctcacggtcatcccggtcattccgccagatctgcgcccgatggtacagctggatggcggacgttttgcaacatctgacttaaacgatctgtacagaagaatcatcaaccgtaacaaccgtctgagaagactcttagagcttggcgcaccggatatcatcgtccgcaacgagaagcgtatgcttcaggaggctgtagatgccctgatcgataacggccgccgcggacgtcctgttacaggaccgggtaacagagcactcaagtctctgtctgacatgttaaaaggtaagtccggacgtttccgtcagaacctgcttggtaagcgtgttgactattccggacgttccgttatctgcgtagagccgaagttaaagatttaccagtgcggtcttccgaaggaaatggcaatcgagctgttcaagccgttcgttatgaaggagctcgttgcaaacggaaccgctcataatatcaagagtgcgaagaagatggtcgagagacttcagactgaggtctgggatgtgctcgaggacgttatcaaagagcatccggttatgctgaaccgtgctcctacactgcaccgtctcggtattcaggcattcgagccgatcctcgtagagggtaaggcaatcaagcttcatccgcttgtgtgtaccgcgttcaacgccgatttcgatggtgaccagatggctgttcaccttccgctttctgtggaagcacaggcagagtgccgtttcatgctgctctctccgaacaacctgttaaagccgtctgacggtggactggtagccgttccttcacaggatatggtgcttggtatttactacctgacacaggagagaccgggcgcaaagggagaaggcaaattcttcaagagtgtcaacgaagcaatcctcgcctatgagaatggcgcggtaacacttcactccagaatcaaagtccgcatgagcaagaccatgccggatggaaaaaagattaccggaatcgtagagtccacgctgggacgtttcatcttcaacgagattatccctcaggatctgggctttgtagacagaagcattccgggcaatgaattaaagctcgaggtcgatttcctcgtagcaaagaagcagaataagcagatccttgagaaagtcatcaatattcacggcgcaaccagaactgccgaggtgctggatgctgttaaggcgatgggttacaaatactccaccagggcggcaatgaccgtatccatttccgatatgaccgagccgccggaaaagccacagatgatcaaggacgcccaggataccgtagaccgcattacaaagcagtataagcgtggtcttatcacagaggaagagcgttacaaggaagtcgtagagacatggaaagagacggatgagcagctgacacatgcacttctctccggactggataagtacaacaacatcttcatgatggcggattccggagcccgtggttccgataagcagatcaaacagcttgctggtatgcgaggacttatggcagatacaaccggtagaacaatcgagctgccaatcaagtccaacttccgtgaaggtcttgacgtactggaatacttcatgtctgcgcatggagcgcgaaaaggtatgtccgataccgctcttcgtaccgccgattcaggatacctgaccagacgtctggtagatgtatcacagcatatgatcgttcgtgagtctgactgctgtgagggaacaggcagagagatccctggtatgtgggtaactgcattcatggatggcaaggaagagatcgagagccttcaggagcgtattacaggacgtttctcctgcaataccatctgtgatgccgagggcaatgtcctcgtgaaagcaaatcatatgattacaccgaagcgcgcagcgcttgttatgagcaagggtgtggatgagaacggagaaccgcttacaaaggtgaagatccgtaccgtattatcctgccgttcccacatgggtgtgtgcgcgaagtgctacggcgccaacatggcaaccggccaggcagtacaggttggtgaggcaatcggtatcatcgcggcacagtccatcggtgagcctggtacacagcttaccatgcgtacgttccatacgggtggtgttgccggtaccgatattacacagggtcttccgcgtgtcgaggaaatttttgaggcaagaaagccgaagggacttgcgatcattaccgagttcagcggtgttgccaatatcaaagataccaagaagaagcgtgagatcgttgtgacaaacaatgagactggagagagcaaggcatatctgattccttacggttccagaatcaaggttatggacggtgcagtcttagaggccggcgacgagctgaccgaaggttctgtcaacccgcatgatatcttaaagatcaagggtgtacgtgccgttcaggattacatgcttcgcgaagtacagcgtgtataccgtctgcagggtgttgagatcaacgataagcatatcgaggtgatcgtgcgccagatgctgcagaaagtccgcgtggagacaaacggagattccgacatgcttccgggaacattagtagatacgcttgacttcgaggatacaaatgagcttctggagaaagagggcaaggagcttgcagaaggcaagcaggtactgcttggtattacaaaggcttctcttgcaaccaactccttcctgtcagcagcatccttccaggagaccacaaaggttctgacggaagctgccatcaagggtaaggttgatccgctcattggtatgaaggagaacgttatcattggtaagctgattccggctggtaccggtatgaagagataccgcaatatcaagctgagctcggatattgatgagaacgaggagattgcattcgatgatttcgacgattttgatgacactgatgtggcagatgagaattacgcattagaggagaatgtgccggaagagtccgaagatacagaagaataaagcgcagattatatctgcattacagaatggggcggccagacaatgtatggctgcctcgttttttttgaaaagatgttaaagaaccgtgaaaagatgtcgataaaatagataaggtataatttagagtttcataaaatgggacgaacgctaaagggatagatcaaaggagatggcgcgtatgtacaaggatgtatgcaagagaatttcggcgtttatgctgacagtatgcctgattgtgacgatggtggaatggccgacgactgtctgggcaggacagggaacggtaaacacctatcggaacggagacggggtactggcgggagcgccgtgcgaggcccaggctgtagctgcggtatttacagcgaaccgcaatgcggacggagcagaactgttagacagtattgacttctacgcacatgtggatgacggcagcaaggcaacggctaccgtggaatattacaaggatgtagaaggcatggcgccggatgcgggaacgagcattttccaaaaagaagtcagcgtgaaggaaggaaagaatacttattccgcagggctggcgaatcaggtaatggagaatggctccaggttttctgtgatcgtccggttgagcggggcgtccttttatgtatatggcggtacggcagagggagagagctatattctcggcaatgccggctggcaggatatgtatacagcgaacggaagctgtgcggcggtaatagcatatacctatgatgtgactgcaacatccgggagaagttcttccaatgcggctgatcaggcggcgctgcagagcagcaatgtgaagcagagtgccgctgtagcgctgaataagaacagtatgaccatcggcgagggctggacggatcaggatcttacactgcagaatgccacgggaacggtaacatgggtttccggcaatgaaacggtggcaaaagtaagcagtacgggcaacccggcaaccattgagggtgttgccgcaggaagtacgacgatcacggcaacctatgcagggaaaagctacacctgtaatctgacggtcacaccgaatctttcggaggatgcggtgacagtcagcccggagaatccggtatacaacggcggacagcagattccgagcgttgcggttcaggtgggagataccatattaaaagagaacgatcagtaccagctttcctattcgcagatggttggcggtgcggcgacaacttttgacccggctacggatgcgaccgtgcttgtgaatgcgggaacctattacctgtacattaccgggcagaacggttacagcggaaagattcagaaggaatacgtgattgcacagaaagacgtatcagacgcgacggtggaagtgacactgcaggacaatattgactgggataaggtgctggctgatgcggcagcagatccggacaacgcttctgccacacttgtctcctgcatcaaagaggtaaaggatacggcgcgtgcagatgcggatgccgtagacggcgtgaagaatctggttgaaggaacagattacacgatttccctcagcaagacaggaagaggaattacactgaccggtaccggcaactataccggagagagatattgcggtgcaccgcgcaatgcggcggacgcgaatgttgtttttgacaagacttcctatgtatataccggaagtgagtggacaccggcattccagcttctggtggacggggagaccatttcccaggcggattacgatgcggtatattccgacaatgtcaatgtcggacaagccacattgacgattaccggaaagaattctctttacggaacaaagacggtaaattttgagatcaaggcaaaagatattggcaacaaggatcaggaagaagttggcatggctgtgtctgtgacggctgctgcggcaggaggagcggacaaggagccggtcatcactgcaacctacaacggcatgacgctggagaaggggacggattacaccgtcggaacagatattatcaatgccggaaacggaacctaccgccgtgtcatcaccggtatcggaaactatcagggaacctacacggtggagtatcaggcggcaggcgctgatctctcagacctgatccagaaagtgacggcagcgacagtcacttataacggcaatgcacagacaccggaaccggacattacctggaagagcggcaacaacgatctgggactggttgagggaacggattactccgttacttacgcaagcaacacgaatgcaggaacagcaaccattacgctgcagggtatgggaacatacggcggtgcagtgaccggtaaattcacaatcgagcaggcggacatgtcaaaggcggtatgctactatgtggatgccgatggctccgaggtaagcactgcaaactataagatggaatattctccggacggagcagacgtgaagccgaaggtggttgtaaagtttgcgcagggcgcggacatggtaacacttccggagtcggactacaagctgacctattctgcggataccaagatatttgcaggtacggcgagcgttgagattgcgccgagcgattccaacagcaattttaagaccggtacaacgaaacgtctgacgtatacgattgcccagtgcaatcttacaagcacgaagattactgccagcattgacagagagctgtttgactatacgggagcagagattgcgcttccgacagagagtgttgtatatcattccgcatcaaagacagatcatacactgaaaaagggaaccgattatacggtggcatgttcaccgacaacggtaaaagacatcggaacctacacgatgacgattaccggaagcggcaactatacaggcgttgttaccaggacgtttgaggttacagcggtagatatccagacactgatcaacgacaagaaccttaaggtaaccaacagcgcggacaggatggtgacaggatatgacggaccatactgggcaatgctgtggtattccaacaataaaaacgataaccagcttgagatttcactcacggataaccagggcaatacgctggtaaaaggaactgattacgaattaaagtatgacggcatcaaggatatttcaaaagaaggaagcactgcttcggtaacgattaccggaaagggcaaattctatggcaagcaggagatcaagtatctgctcgcatccaagcttgatgaggattatgatgtatcggtgaatccggcagaaaacccggtatacacaggagatccgattacgcttgctgcggatgagatttcggtatcggacggcggattcggactctggaagagcgtccttgagcagggaacagattatacggtcaactacagtgacggaaccaacgcggatcaggcgatcaatgccggggaggcgacggttacagtagagcagatcccgctggaggatcagccgacggcaaacggatgctatgtgtacagcgacggcgccacaaaactgagtgcaacctttacgattcgtccgaaggacattgcaaccggtgtttcctacgaggcgatcaagaaagcgtacgacggaaatgcagtgacccttacagaaagtgagataaagcttacttataataagaagacattgactgcgccgaccgactattcgatcgtggctggcagctacgcgaacaacgagaaaccgggaccgatggcaaatgtgaccatacagggtaacggcaactacacaggaacgaagattattgtattcaccatcagcggaaaatccctggacgagatcatcagctggaaggtggatgagaacgagacgacctacaccggcgagcgtctgtatccgaagatcaccgagctgacgctgagcgatggaacaaagcttacgacagccgatgagatcgggaaagtgatcgcgtatgacgagtcttcctacgcggacaacctgaatgccggcgaggcatccatcaccgtttccggtaagggagattactacggaacagatgacagaatattgacatttgcgattctgccaagaagcctggacaacaactgcacgcttggcggattaaagtccggctacacttacacttcggaagagattacaccggtacctgcggtacagtgcacagatttgaagaaaaagctcggcgaggatgattacaagatttcctatgagaataatgtggatgccgggaccgcaacgatgacgattaccggaaaaggaaactatcagggaacctttacgaaagattatacgattgcgccgaagaatctggcagagccggaggtaaagatcgcaccgatcgacgcgcaggagtacaacggaatggctgtcacaccggcaccgtcggtaagctatgaatttggagacggaacctatgcgttaagcccggtcaacgattacacggtggcttacgcgaacaacaaaggaaccggaaccgcaacggtgacagtgaccggaaccggcaactttaccggaagcaagacggcagaattcagaattggccagctcatcacaaacgagaccaaatttacgatcagctgcccggcactcaccgacggcacacagtatgtttatgacggaagtgcatttgagccggaggtgacggtaacacggatcgagggcaacaaaaagctggtaaaagattctaactattccgtgacatatacggataatatccacgcgggaaccgcaacggtaagcgtggaaggtctgggaggatacgtcggtgtatggcagaagacttttgcgattgcaccaagagatcttacggacagcagtgtagagctttctgtcggcggagtgatcgatggaagttatcagacgcagtataccggaagcccggtagagcctgaagtggcacttacttatgacggacagaagatcagcacgacagattacacggtatcctacggggcggatcataccagccgcggaaccgtgacgttgacggcaacggcaaaggacggtacggactttacaggatcgagaagcacaacctttacgatcacacttgcaagtattggcaatggcggatatacaccggcaaacggctttaagatcggagcgatcgaaccgcagccgctggtggacggaacggcaacaccgcagccgaagctgtactataacggaacagaacttgtcatgggtacggattatatttgtacttatgagaagaacgacagcattggctccgacgcggttgtcattctcaagggaatcggcaattacacaggaagcgtgaagaagacctttaagatctgcgcaaacattgcggacgccgagattaccgttccggatgaactgtggttcaaagattatgtgaatgccggagagacggacattgcaatcggcgataagaacatcacgtttgacgatcagatcagtgttgtgctgaacggaacaacacttcagaaagataccgactatacgctggtctatgcagacaacagctgggtcggcaacgcagtagttaccatcaagggtatgggaggctttgcgggaagcgtggagaagacggttccgatcaaagcggatctttcggaggcaggcatccaggtggcaatcggagatcagcagtataccggagatccggtggaggcaatcccgagcatcagctactacggaacagagctgacatccggaaagcactttgtgattcatacatacgaaaacaacgtgaagatcggtgataagactgcgagcgtgacggtaatcggaaatgagaaaaacggatttaccggaacactcacagagaatttcagcattgttgcaaatgcgggaattctggaggtaagcggtgtagagagcagctacctgtaccgcggaacacagatccgcccgcaggttaccgttaagatagggaacaagacactgtccacgtccgattatgatgtgacctatggagagaatatcaaggcgggaacagacggcggaagcattatggtaaagggtaagaacgagtatgctggtctgatcaagctggtaacctttgatattaacccacttcagatggacgacctgaaggtgcttgacggaacgcagaacgcgatcggaagcagagagtacaccggtaaggagattgtgccggagttctcattgaagacaaccatcggatcaacggattacattctgccggcaagaagctataccattgcaaagaaggcagacgcggataatacgaatgtaggaaccggtacagtcgtgattaccggtgatggaagcaacgtaatcggaagccgtgaagtatccttccagatcgtggcgaaatcattggcaaaaccgtcatccggcaccgacttgattgcggtagaagtgattccggacagcttttcttatgacggaacggaaaagaagccgactgttcttgtgacatatcagtacggaacagaggttgaggtacgtcagctgacagagggaagcgattttaccgttgcatacagcaacaatatcaatgcaggaacagcgacagcggtgatttccggtatcggaaattatacgggatcccgcaccgtggaatacacgattacggagaagagttttgacggagcgattgtcacgttcccgaacggaacttcctatccgtatatgggaagcgacaacggggtggaaccggaagtgcaggtaacactggacggcaatgtactcacagcgggtacagattatgaggtatcttatcagaacaacaaggcgtgcggcacagcgactgtgaccgtgaccggaaaaggaagctatgcgggaagcgtaacggcaccgtttaccatcgtaagccacgatattgcggcggcggatgtgacggtggatccgattccgaatcaggcatacacgggtcagccggtaattccggaagtgaaagtgacctgcggcgattacaccttaaagcagggtgaggactacacgctgagctttgacacggacaacacagagatcggcaccgttctgatgcggatcaacggaaccggtggatttacgaattaccgccaggccacatttcatattgcgagcgacatcagccaggcggaggtcataggacttgacgacagctatccgtttacgggaagcgcatatacgccggacgatctgggcattacagaggtacgcatcggcgagacggtccttacaacagactcctacagctttgcatttgatgaaaacagcgatggcatgagcgccggaacacagacccttcttctgatcggtcagggaagctacggtggaaccaagaaatgcaccatcgagattacgccgaaggacatcaccgatgaagatgtggtgatgagcggatttgaggacacggtctcctactcagagcagattacacagaacgtaacgttccagtggggtgagatcgcactcgtaagagacaccgattataccgtgacatgcagaccggcaggagtggcaggaatctacgagatggaggctgccggaaccggcaactatacaggaaccgttacaaagcagtttaccgtagaccagacgccgattgacggactggaagtgaagggtatttcttctacttacacatataccggaaaagcaatcacaccggagccggaagtatgggcagacggtgtgcagctggaaaaagataaggattacacggtatcctatgaagacaacatcaacgcgggtgtagcgaagctggtaatcacagcaagcggaacccattatgcaggtactaaggaactgagtttccagattctgcgcaagagcatacatctgtgcgacattggttcgattcagacacaggtatataccggatctgacatcaagccgaccgtgacggtggaagatgacggcaaagccctggaacttttaagcgactacacactgatgtattccaacaaccgcaaggcaggtaccggtgtggcggcagttgcaggaaaaggcaattacacggcaacaaagaacctgacgtttgacatcagaccgtgcgatgcgggcgcggcggttgtgacaggcgcatccgcagacagtctgtccatcagctggacgggcgacggtgccgtgacgggatacgaagtataccgtgccggcgcagatggaaagtggcagcaggtaacgcgtaccagagacgctttctataccgataaaaagcttgcggcagagacaacatactcttataaagtaagaagctacctggtggcggacggcgagacttactacggtgagtttaccggagcagttaccggaacaaccacaaaataaagacagagaggagggagagcggttccgatcatggcggcatataagatagggaattttacatttgacacagaagaggaatatgccagaggactcgaagatgcgaagaaaatcgaaaagattcagagcaccgtcgatctcaatgaaccggaaaccgctctacgcctctattggctgatccgaacagggaagatcaagttcggcagcaaagtcggcaagaaattttttcttgatattgcagatgtcgtggcaaaatccgcggcaaaaaatataacgcaggcacaggcgccggaacaacaagcgggggaggaaccccggcaggtggcgcaggaccgcagcagaaagattctcggtgcggtgtgtgtgacggctgcgattctatgttttggctggtatttctggtcagattacacgaatcaccgcggcagtcaggcgaatgagtatttgaagatgctaaaagaaaatccgacagaagccgcagagatggtggacaatgacacctttttttcggaggatgcaccggaacttgcggcgggattagaccagacggagcgggagaacgaaccgcctcctccggttctgccggaatatgaagccatcgtggcgcagcacagtgattttgccggatggatcaccattgacgggacgaagattgactatccggtcatgcttaccccgaatgacggggattattatctcaagcgcaatgtaaacggggaggacgatatcaacggaaccttgtttatggatccgagaacggatctggtgcagcgcagcaccaatattattatctacggacacaacatgaaaagcggtgcgatgttcggaagtctcaagaagtatctggatgaagattactggagggagcacgcgcagatcagatttgatacaatttatgagaaaggcacctatgaagtgtttgccgtctgtctggcaaaggtgcagtaccggaattcacaggaatttcgttattatgattttatacaggcggattccgaggaggcgtttaacgactacctcgatcatatcatacaactctcggtgtttaccggaacagatctgccggtctacggggacgagctattgaccctgtcgacctgtaacaattttacagaagacggaagactgtttctggtggcaaagaaatgcagggaagcagagtaaaagcgtgggatcgcgcgtgaggttcacgggcggggctgcgtcgaaataaaggatgatgggagagagtgctaatgaaataccggataaaacgaaaaataggctatgtgctggtcgttgccatgcttgtggtgatgatctatccaggagagctcagtgcagcgtccggtcaggaggacggatttgtcataaaagggacaaccttgcaggggtatgtcggagcggagaacgcggttgtcattccggacaatattacaaaaattgatgatgatgtattcctcaatacgacgatcacatcggtggagatcccggacagtgtgacaaccatcggagataacgcatttgcaggatgtgaatatctgaccgaggtcacggttccggacagcgtgacaaagatcggagacaatgtgttctacggctgtaccagtctggaaagtgcaacatgggagagcagggaaggaatcggcgacggcacatttgcagagtgtgcgggactgacggacttaagtatttccaaggaacttccatcgatcggaaaagaagcatttaaaaattgcgagtccctcgagagcatcgtgatccccgaggcaaccaaaaccattgcgtcggacgcatttgacggatgtgtcaacatgcagtctattgatgtggaagagacgaatacttactttatgtcatacgacaatgcgctctacacggcgaacggggttacgttataccgttgcccgcagggtgcgagaaccatcgaggtatatgacggcaccaagatgatcggtgaaaatgcattttacggctgcaagcttggaaaagtcacacttccggagagcgtgacaaccgtggaagatggtgcgtttgacggcagtgagattcagacactctgccttggcaaagccttagaaacgtttggcgagcagaatacttctttcaagatccactcgattgaagtgccgggaagcgctccggctgcaccgaagctggtggagacgtacggtgcgattgtggtgacggattataagccggacgacaccgaggatacggagaaaccgaccgaggacacggaaaagccgacggaagacacggagaaaccgaccgaggatacagaaaagccgacggaggatacggagaagccgaccgaggacacggaaaaaccggcagatgacaataacaacaataacaacaataacaacgacaataataacagcggtaacaacaataacagcggcgacaacagcaataacaataacagcagtaataacaatagcagcaataacagcagcaacacgagcagtggtaataacagcagcagtacgggcagcggaagcggcagcagcggaaagagtaacggcacatcatctggaagaggcagcagaagcggcaacggcagtggaagaggcagcggtgcggtaaagggcagtgccggagcggcaggcgcacagagcagcggtaccggatcggcggcagcgacgacggcggagacacagggagatgtgcagccgacagcggcggaagtgcctgcgacgaccagatttgcagagcagggaaccgcatatatcaccggaaatgaggaactgaagggctgggatgcgatttacacgcagatgacggtggcggatccaggttcaacgatctatattaccatgaacggcaccacggttgtgccgaaggatattctgacactggcggcagataagcagctgacgctggttctggatatgggaaatggaatctcatggacgattgacggaagcagcattgacacaagcgttgtagcagatacggattttggcgtggaactgggaacaagcaatgtgccggcgaacctgcagagcacagtaaccggaagcggatggtcaacgcagatgcatctggcgcacgacaacctgtttggcctgacggcgcagctgaccgtaaatgtcggtgcggcgaacgccaataagctgggcactttgttctattataatgtagataatcagatcctggagtatatgggacagtctgatacagatgcggacggcaatgtgtcattttcctttgtgcatgcgtgtgattatgtcatcgtagtggatgagcgtcactcggattcaacggcgcaggcaacctccgggtttgtgattacaccggcaggcggaagccaggcggaaagccagccggcagagacgacggaagcggcggagacggagcagccggcggataatgcgcaggcggcggatgactcgcaggtaaaggatgagacgccgaagaccggacagtcgttaaatccgaaatatgttctgtgcatcggtgtgatgctgctgggaatctatatgattctgaccagtgagagacaggagaagcagagaaaacgggcaaatggctgaccgtttggtataaacatgtaaaaatgtggaagaatagatagatggaagatatccgttgggagttttccatcttttctttttacatgcagaactcttttttacccacgtattccgcgaaattcaaggaaattttggaaaagaacttgacaaaaaaagatagggttaatataatgatttagcgtgcatacgtacgccgagatcaatttatgatctcatacaaataaaacaggaggtgaaaataatgccaacatttaaccagttagtaagaaaaggacgtcagacatctgttaagaagtctacagcacctgcacttcagagaggttacaactctttacagaagaagccaaccaatacttcttctccgcagaagagaggtgtatgtactgctgttaagacagctactcctaagaaacctaactcagctcttagaaagatcgccagagtacgtctttccaacggaatcgaggttacaagctatatcccgggtgagggacataacttacaggagcacagcgttgttctgatccgtggtggtcgtgttaaggatttaccaggtacaagatatcacattatccgtggtacacttgatactgccggtgtcgctaacagaaagcaggctcgttccaagtacggcgctaagagaccaaaggctgcaaaatagtagcgtagagttactgtaattcagcgaaccaatagtatcacatggtaagtgttggaattgtttcacacagagatatatttccgcacgaacacgaagaggcagatacctgccactacattgtgagtaccgttgaattaatcgaaatgaagtcctccggatccagagactggagaccgggcaatgcagacagagttctgtatagtaaattatgattaaggagggaagaaccgtgccacgtaaaggacatactcagaaaagagacgtattagcagatccaatgtacaataacaaagtggttaccaagcttgtcaataacatcatgttagacggtaagaagggtgtagcacagaagattgtatacggagctttcaagagagtagaggagaaggctgagaagccggctctcgaggtatttgaagaggccatgaacaatgttatgccagttcttgaggtaaaggcaagacgtatcggtggtgctacttatcaggtgccgatcgaggtcagaccagaccgtcgtcaggctttagcacttcgctggttgacaacatactcccgtaaccgcggtgagaagaccatggaagagagacttgctaatgagatcttagatgcagctaacaacacaggtgcatccgttaagaagaaagaagatatgcacaaaatggcagaggcaaacaaagcgtttgctcactaccgtttctaatttagggaggaaataccttggctggaagagaatatccattagagagaaccagaaacattggtattatggctcatatcgatgcgggtaagaccacattgaccgagcgtattctgtactataccggtgttaactataagattggtgatactcacgagggtactgctaccatggactggatggagcaggagcaggagagaggtatcaccattacatcagccgctacgacctgccattggactctggaagagttcacaaagccgaagccgggtgctctggagcatcgtatcaacatcattgataccccaggacacgttgactttacggttgaggtagagcgttcactccgtgtactggacggcgctgtcggcgtcttctgtgcaaagggtggtgttgagcctcagtcagagaatgtatggcgtcaggctgatacctacaacgtaccgcgtatggcattcatcaacaagatggatatcttaggtgcgaacttctacggcgctgttgatcagatccgtacaagattaggtaagaacgcaatcgttcttcagctgccgatcggcaaggaagatgatttcaagggaatcatcgacctgttcgagatgaaggcatatatctacaacgacgataagggtgatgatatcaccgttaccgatgatcttggagatatgaaggacgacgcagagctttaccgcagcgagctggtagagaagatctgcgagctggacgatgaccttatgatgatgtacctcgagggtgaagagccatccgttgaggagatgaagaaggtcttaagaaaagctacctgtgagtgtactgcagtacctgtatgctgcggatctgcttacagaaacaagggagtgcagaagctgatcgatgcaatcatcgagtacatgccggctccgaccgacatcccgcctatcaagggtgttgacttagatggcaatgaggtagtaagacactcttccgatgaagagccgttctccgcacttgcatttaagatcatggctgacccgtttgtaggaaagcttgcattcttccgtgtatattccggtacaatgaactccggttcttatgtactgaacgcaacaaaagacaaaaaagagcgtgttggacgtatcttacagatgcatgccaacaagcgtcaggagctggagaaagtttactccggagatatcgctgcagccgttggattcaagttcacaacgacaggtgataccatctgtgatgagcagcatccggtaatcttagagtccatggagttcccggagccggttatcgagctcgcaatcgagccgaagaccaaggctggacagggtaagatgggtgaggctcttgcaaaacttgcagaagaggatcctacattccgtgctcatacagatcaggaaactggtcagacaatcatcgctggtatgggtgagctccatctggagatcatcgtagaccgtctgcttcgtgagttcaaggttgaggcgaacgttggtgcacctcaggttgcttacaaagagacatttacaaagccggttgatgttgaatacaaatatgcaaagcagtccggtggacgtggtcagtacggacactgtaaagtgaagtttgacccgatggatccgaacggtgaagagacattcaagtttgagtctaccgtagtcggcggtgcgattccgaaggagtacatcccggcaatcggcgaaggtatcgaggaagctgctcaggcaggtatccttggtggattcccggtactcggtgttcatgcgaacgtatacgatggatcttaccatgaggtcgattcctccgagatggcattccacattgccggatctatggcattcaaggaagctatgcacaaggcaaacccggtattactcgagccgatcatgaaggttgaggttacaatgcctgaggagtacatgggtgatgttatcggtgatatcaactcccgtcgtggacgtatcgagggtatggatgatatcggcggcggtaagcttgtaaaggcatatgtaccgcttgcagagatgttcggttattctacagacctgcgttctaagacacagggacgtggtaactactcgatgttcttcgagaagtacgagcaggtaccgaagagtgtacaggagaaggtattggctgacaagtccaaataagctttccgtatgcagtttgtaaaaatcccggattttcccataaacaggggaaatccggtaagaaatagcttgaaaaaccgctgattattttatataatcagagttagccgagttattcttatataataactatagcccgcaaggggcatcattttaaggaggatattcaaaatggcaaaagctaagtttgaaagaacaaaaccacattgtaatatcggtaccattggacacgttgaccatggtaaaacaactttaacagcagctatctccaaagtattagctgcaagagttgctggtaacacagctacagatttcgagaacatcgataaggctccggaagagagagagcgtggtatcacaatttctaccgctcacatcgagtacgagacagagaagagacattacgcacacgttgactgcccaggccatgctgactatgtaaagaacatgatcactggtgctgctcagatggatggtgctatcctcgtagtagctgctaccgatggtgttatggctcagacaaaagagcacatcttactttcccgtcaggtaggtgtaccttacatcgttgttttcttaaacaagtgcgatatggtagacgatccggagctcattgagttagtagagatggaagttaccgagcagcttgaggagtacggcttcgagggatgcccgatcatccagggttctgctcttaaggctcttgaggatccaatgggcgagtggggcgacaagatcatggaactcatggatacagttgatgagtacattccggatccgcagcgtgacacagataagccattccttatgccagtcgaggacgtattcacaatcacaggtcgtggtacagttgctaccggacgtgttgagagaggtacattacatctgaatgataaccttgagatccttggtgttaaggatgatgttcagacaaccgttgtaaccggtatcgagatgttccgtaagcagttagacgaggctcaggctggtgataacatcggtgcattacttcgtggtatcaaccgtgaccagatcgttcgtggacaggttcttgctaagccgggtactgttacctgccatcacaagttcacagctcaggtttacgttctgacaaaggacgagggtggtcgtcatactccgttcttcaacaactatcgtccgcagttctacttcagaacaacagacgtaacaggtgtttgcaaccttccggctggtacagagatgtgcatgcctggtgataacatcgagatgactatcgagttaattcacccggtagctatggagcagggtcttacatttgctatccgtgaaggtggacgtactgtaggatcaggacgtgttgctacaatcatcgagtaatcactgactaatatatattgagtaccgcaaggtacattgtgtccaaacgtaagataccccggaaccgtaaggtttccggggtttttctgtactctaagaaaagaattattcgtaaatttatcaggttagtaatagtgaaacatttatcagcaagatgaaatacagataaatttataattaaaaaataagaccagcggtgccaaaacggtgccaaaaagaaactcctgcgaatgtttgctattcacaggagtatttttttaccagcctttgatctgtttgatttgttcagcacgttctggatcacgatgatattgtaatttcagacggatagtttccacaacttcctgtctggattcatcatcaagctgatagaacgatgtaagcagattatctacatcaggcatactgttcttaccgaaaaggtacatcagcggatacatagaattttttaagtaagtctttacacgacttgcgtctaatgctccgttcaaaccgtctggaagtgtaggataaatctcttcttccttaattgtgccagaaaatggactggcagaacatatctcattcacatcaatttgcaattcattcgcaagtcttaatgcaaaatcaaatcgaatattggaatctttttgaataattgaatataaggttgtagcactgattccggttgcctttgcaattttgcggacatttgtgcctttttcatcaagatatttctttaaatttttaccgtcacccatagaatcctcctttttcatatattagaaaattacgaaaaacataaatctataaaatatcataacacagacgtggaataaaataaagaaaaaatagtgtacgaagttcgtaaaaatgtgtttacgaaatattgacaacgatagaaatacatgatattatcaatttacgaaaatcgtacagatatagaaatacagtaaacgtattctatatctggagaggaaaggaggaggcaatatggcaagttacaattatatgatgagtgctgatgaagtggcacaggaattaaactgctcaaaatctcatgcctataaactggtgaaagctatgaataaagaattatctgcacagggatatattacgatggctggaagaataccaaaggcgttttgggcaaaaaagatgtatggctatgaaatagcagaaaattagggaggatcaatatggcttacagagaaaaagacacaaaaaaatggacagcccagtggtttgagacaaatgtcatgggtgagaagaaaaaacgcagaaagcgtggatttgaaacaaagcgagaagcattggagtttgaacgaagcaaaaagttgagcaatgagcgaagtatggatatgaagctgagcgattttattgagatttatttttcagacaaacaaaatgatctgaaagatcgaacaatcaaaaataaaagatatatgatgcaacagcatatcgttccatacttcggaaatcagatgatgagtgaaatcaaggcttcacagattattcagtggcagaatgaaattcagaaaaaaggctattcagattcttatctgagaatgattcagaatcagttgaccagtctgtttacacatgcagctaaaatctatgacttgccggttaatccatgcaagaaagtgaaacgaatgggaaattcagattcaagaagtttgaacttctggacactggacgagtacaaacagtttatacagacaatggagccgggaacaagatattatcttatgtttgagatgctgttctggactggatgcaggatcggggagctgcttgcgattacaaaagctgatatcaattttgaaaagaatcagcttagtatcaataagacttattaccggacaggaatgcaggatattatcacagaaccgaaaacaaaacagtcctttcggacaatcgaaattccggaatttctgaaagaggaaattaaggaatttgtagatggtcattacggaatgccggatacagaaagattatttccggttgttcaggaagcggtacagcataagatgaaacggcagattgagctggcaggagtgaagaaaattcgagtgcatgatatcaggcacagccatgtggcttatcttattgagaaaggtgtggaaccgttattgattcgggacagattaggtcataaagatattcgtatcacattgaacacttatggacatctttatccaaatcagcagagaaagattgcaaatcttctggataatgaaaatggaaatgctgttaccggattgggagaagaaagagatgaatgttgaaaaggcaaaagaaaaagcccagataaataatctgagcaagttctctgataatcagattcactgatataccatcttggcagattcagtatatcacgaatcgggaaatacgacaattcccgaatatctgttcatcagagacttgcccggaagggcaggaggagatgatggaatgaatatgaatgaaaaaaataaaattgagaattgtagaatagaaccaaaactgaaactgatcaatatggattcagtagaggtggaacaggtagaatggctgctttatccgtttattccttatggaaaagtgaccattatacagggagatccaggagaaggcaagacaacgatggtacttcagattattgcaaaactgaccagaggagagccgattcttcctgttactgataaaacgaaaacaaaagaaaaacgaagtgatgaagtcgatagtgagaatgaagatttagatgctgaagataatatgcaggaacagtcttctgtgtcacctgtaaatgtaatctatcagacagcagaagatggacttggagatactatcaaacccagattacttgctgcaggtgcagattgttcaaaggtgctggtgattgatgacagtgaccagccactgacaatggcagatgtcagattggaagaagcaatcgtgcagacaaaagcaaaaatggttgttcttgatccgatacagggctttctgggagcggacgtagatatgcacagggcaaatgagatcagaccactgatgaagcgtatcgcagtgctgtcagaaaaatatcactgtgcagttattttaatcggtcatatgaacaaaaacagcaacggcaaatcttcttatcgaggacttggctccattgattttcaggctgctgcaagaagtgttctgattgtcgggcgagtgaaagatgaaccggaagtaagagtggtatgtcatacgaagagttctcttgcaccggaaggaacgtccattgcattcagactggataagaataatgggtttgaatggattggagaatatgatatcagtgccgatgaacttcttaatggagacggaagaggacagaaaagtcggaaagcaaaagaatttctccttgagatactggcaaatggaggaatgactcagaagaaaattgcagaagaagcagaagccagaggaatcaaaagtaaaacgctatggaacgccaaacgggaacttgaaattgattccgtaaaacgtggaaagcaatggtattggatgttgccagaataaaaatggaagatggcaagattaccatttcttaagaagaggggatcttgctaccttgaaaggagaatagatgcaaaataaaagtgtacagattccatacgagttattctttcagctcttgcaatattttttgatggataactacgatggtgaagaaataatacggttgggattggagaaaaaactggatgcaatggtgaatcgtgaagtatacagcaaatccaaaacagcaccaacggaagaagaaagagaaaagttccggaaggaatatctggacagacggggaataccggagaactttcgatggtaaaggttctttctgaacactttattacaggagcgtgtcacgcacctgtagatagcagacaaggagaatgttggtaaggtgtagtcgggagttgactggcgtagaagagaattttcaaaagggagccctgattcagggcgcccctgcggaaacggtagatgaaaggagattggcacaatgagagaaggaagattaggatataacagttataacaaaagatatggattattatcatcagatctatggattgatacaggatttcactgtggagaatgcctggaagtgttgcttgatgatgaatgggttcagaccagaatggaaatgaatcctgcaagagaatggtatcttgtagggacaccgtattgtggtgatttggaatatattcgggcaaggataccggagtaaaggtctctgtacccccggagggcgcaagggtacttttgatggacggtacggctgtcgaaagtgcttttgcgttacttttgacaaaagtaacaaaaccgccgtatccggcgaatatttctttttatactatagctggcaaagatacaaatttatgtgccatgtctggcactggttttagaaagcggggtgaggaatatgacgatgaaacgaacaatcagtggtatgatcgggacagggtctctggctcataacagacgagattttatagcagaaaatgttgatccagacagagtgcaattaaatatttgttaccggaatgagaatctgaaagaagtctataaagagctgtttgatgaagctgtagaacggtataatgtcgggaaaagaaaagatcggcagattacaaattattatgaaaagattcgccaaggaaaacaggaaaagttgttccatgaagtgattttccagattggaaaccgagaagatatggctgttggaacagaagcaggagatctggctgtaaacgtactggatgagtatgtaaaagatttccagaaacggaatccgacacttcgggtatttagttgctatctgcatcaggatgaggctactccacatctccatattgattttattccttatgtgacggactggaaaggaaaaggaatggataccagagtttcactgaaacaggcattaaaaagtcttggatttcaaggtggaaataagcatgatacggaactgaatcagtggataaatcatgaaaaagaagttctggcagagactgcaaagcagtatggaattgaatgggaacagaaaggtactcatgaggaacatctggatgtctataacttcaagaaaaaagaacggaaaaaggaagtacaggaattggagcaggagaaagagcatctaactgctgaaaaagaagaattaacagcacaaattgcagaatccagagcagatatccagaatttaaaagacgataaggaacaggcaatcaaggcgaagcaagaagcagaacaaaaggcagggagcgcagaaaaagaactaaaaagcctggaagatcgcagagaacagctacaaccgattatggatagtgtgagcaaagaaatcaaagaatatggaacggttaaaatgttactgccggaggcgggcacgctagaacgggcagtaacctatcgagataaaaaaattaaaccactgtttcttcaaataaagaataaggttgctgtaatggcggctcaggttaaagaacttacgaaagaggtggaaggttggaagagaaaatatcaaaaggtgaaacaaaaatataatgctattcagagagaactggatgatatacgtaaagataatcagaaattgtcagaagaaaaagatatattacaaggtgtttctgataggtatgatcgtgttgtgcgtgttcttggaatagaaactgtagatacagcagtacagcaggatattcaaaacgagaaagtcctggaagaaaagcgacggatggaacaaatgccgaagggaaatattcatgaaagattggcatggggaatgaaaaaaagcgagatggagaatcagcagcgtaagaaaactaaatcaaaaaacagagaaatggagagataagattatggaaacacacatttatgatgaaaagaacggattaagctatactttgcatggagattattatttgccggatttggtattgaatgaagaagaaccgatatatgggaaatatggaatgctgaggaaacagtttctgaaggaacacagattagcaaaatatcaatatttgttgttgactggaaagctgacggaacacctgaatcaaattgatcaggagagcagagagcaggtggaaatgcttatggaacagatggcagaaaaacagggcgtaactgaagaattaaaggtacagaatcggacgaagtgggttagactgatgaataatataaaagctagtgcagaagaaatggtgttgaaacttctgaaaagcacattgtttgtaaaactccctgctattaggttccacattctcacctcctttctcgttggaaagttggtggtgcttcccccttttcgcggggcaatacggcgtttttgaaaaacgccgaagattttttgaaattttttcaaaaaattttttgagcagcaaaatacgcctgtccgaaaagcccggacaggcgtataggtattgtaagcagtatttagatgattagacagttcatagtcaagggtagagaggttcccggcggtggtcgggctttttttgatatgtcaatgaccgtcggattttgtcgatagggtatgtgcttcatggcggctacctcctttagccgccgcttttaacagtgataccgcgtcatttcattagaagataaaaagaaacggcggctttgatttttcaaagctgctgcggaaatcaaagaacgacaagcaacagttctgattttgctccaatatggttattaggggcacaaattaaaatcaaaaaagagccgataacagcagtatttcaaactgcatattatcggctctgcgtctgtgcgtctggctcttttaattaaattatttctgttgttttttggctttattatatgtattagctaactgtccacaagctgctttaatctctctaccatgagaaactctcatggtaacttcaagtcctgtttgctctaattgatgtttgaacgcaaccatttcttgtttttgtggtgctctaatttttgaattactcgtcgggttgtattgcagcacgttaatcataacatttttgcccttaaaccattttgcaagttgccttatatctgaggaacggtcatttatacctggtaaaagcaaatacgcaaataccacttttcgattatgcctttgagaataggacaatgcttgcttaacaacatcttcaatagcgtacatgtgcatatgaggaatgatacagtttctcgcagcctgtgttgctgcatgtaaagatattgtcaactgaatttttagatgttcttcgcgcaatttttttaattgattaactggaccaactgttgatacggtaatgccgtcggttggaaagttaagtccatttctatctcgaagaatatggattgctgcaatcaagttgtcgtaattgaataaaggttctcccattcccataaaaacgatacgatttactttttgacgtatcaatacaacctgctgcacaatttcagacggtgttagattacgaacaaaaccattgcgtccggactcacaaaaaatacagccaacagaacaaccaacttgcgtacttacgcaaacagtcccaccatctcgccgtttaataaaaaccgtttcaatatacctgttatctttcaattcataaacatacttttcagtatcgctacttttatagactttttttgttgatattgatagattttctttgtgaaatggctgtttatacaattccgtatataaggctcttgctttatcctctccaattacttccgacatttctttgtaagtaaatccgtatgggtcattcaatatttccgtaggtgtacttttaggtaagtgtttcatttaaatatccttccttttcaaaattaaaaagtttgtttttcagagtttttgattatgatttctagtttttcaacatcaacgatatgcgttaatttacatttagggcagaaaagaggaaaatttcttaataccgtattataaaatacttgaaccctcgtctttccgttacaaattggacattttatccaatatttttcaagcataatatttctccttttgcgcaaaaaaatgcaggtcaattctcaacatgagcattgacctgcatttatacatataatactacaacaaaattaaggcatagtttttatactatgtctatacgtcgttagttttgttgtatagcatacgcaaaataagcatgacaaaaaagcccatattgaaaatgggaaaaatcttttttgatttcaatgcttatcgaatacgcatgctatgtaacataaacattcccccccttttatataatattatatacaaaagcagcttgttgtcaacatatatatatatgaattattttggctaactgatagaactatgtagacatatccaagaagaaaggggaacagtaaaatgtaagagggtgaataactatggcaaaaagaccagtaccaaaatacgacttcaaggcttttggggcagcgataaaggcagcgcgtgaaggacgcaaggaaagccgcaagaaagtaggcgacgaaatgtttatctcgccgcgctaccttgcgaacattgagaacaaggggcagcacccaagtttacagatattctttgagctgatacagcgttaccatatatccgtatctcattacttccagctttggcacgactattgaaaattgatatgaatgaattgttttcgtttcatgaagaattgacagaaaaagagattggacaatttgtgaatgaactttcggaagtttcattggacagctttacagaggctttcgagatggcatctcgtaaaatacaggagtatcctcattgcgacttattaatatatacgatcgcaaccgttctgaacggatctttgactttgtcagatcttaatgacgaagaacgaatggaatataatacagctattattgagtggctggaacgaacagcagatagtcaggatgaaagagtgagaaattcaagcgtttttatacttgcaacaaaatatgtccaaatggagaaatatgaagaagcaaatgcccttttgaaaaaaattcctgatactgtaattgatgcaacgattatgaaaacaagtgtattagcacatcaggaaggaacagatactgctgcattattcttagaagggaaattgctacaggcagttatcaatatccaaagctacttgtataagttaatagaaatggaagaagagacaggaaatcatgataaagcagagaaaattgctgagattacagatcacatgatatcattgtttggactatggaattatggcaacacagttccatatctgctgattgctggatatcgaaaagatgtagaaaaatgtatccagttaattaagcgattattaagtgaatcacagaagccttggaatatgacacaatcccctttgtattacaggtatgaagatactgcacagggaaaagctttttcgggacttggaaaaaattttgttcgtgaattgtattcggaaattgaaaataagaaagagtatgaattcttgagggggaataaggaactcgaatcaatttttgaggaacacttgaaataggttgtaaaaatgtatggaaatagatgtagttgagaaagaagaaaatttttgacatttccacagatgcgtgctaatatgattatagaaaaagagtgctaccgatagacggttagtccacatacttattgattacaaaaataaccgttcagtttgcaggctggggcggttatttttgtggtttatgattatctttgcctaatgtatatccgatactaaagcaggttaagccgaagctcactactgctatgaagtccacaatactcattggcttagccctcctttccactggattcctttacaggtttctatgtaatcagagggtcacagtccctctggagaaggactaaccgcctaccgttatggtagcacccatgtttcgattataacagttaaaaattaccggtgcaatataaagttggtagagaagtatctagtatctacagaagagaatcggtttgagtattctccggtgccaaaacggtgccaagaaatcaggcaaatcaaaataggtggtgcaattcagctgtttttcactgtattttggagagaaaaccataaaaaatatgagataaaacgggattaaagtatcgtgagggtggtagaactgtaggttcaggccgtgttgctacaatcatcgagtaattaaatattattcagtaaatttaaggctcccagggttttccttgggagccttttttgcattaaagtgggaaactgtagctgccgggatctggatcggcggttgcaggagaggaaaactgtagctgtcggagtctaggataaccgtcatggaactgagaaatcgcgggcaagaggccactcgacggaacgtagaatccgcacaaattcaccatattctacgctgcgtgtgtgtgaaagccgtgggagcgggaacataatgagaccagaaaggaggaagacatggatcagattaagacaggaaaatttattgcagatgagagaaagaaaaagggttacacgcagagacagctggcggagcagctgggaatcagtgataagacgatctcaaaatgggagcgcggaaatggtttcccggagatttcgctgctgttgccgttatgtaacgaactggatctatctgtaaacgaattgctgacaggagaacggatttccgagacagagtatcgggagaaagcggaggagaatatggtgaatttagtgaaagaagcacaggaaagcaagaagaaaattattttatccggaatggtatcggcgcttgtgattattgcggctacaccaatgtttgtggtggcgggagcatttccgatggaggactggatgcggattgcgctgattgcagtcggcatagttgtcattgtgatcggcattgcgattgcatgcattcttgatcgtgatgcaggagcttatgagtgcccggagtgtaagacacggtttgtgcctgagatgggcgcttatgtcatgggagcgcacacgctgaccagaagaaagctggtatgcccgcattgcggggcgcaccggtactgcaaaaaggtgttgacgagataaaaaatatatctgaaaatataggtagaaacccaaagaaggtacgcctatgattacattaaacgattatctctattccggagacaccgtcttaaaaattttgaaaaaatataccgaagacctgcggcagtccgcagcacggaccgggaatgaagtggacgtcaggcactgtgaatttctgtctcagattatggaattgctcgagcacaatgatttcctgacggcgcagtcgcagaagatccgggaattctataaatatatggcacgggaatatccctacctgtccttcacgttcaaagggaggatcaagtctttgatccgtgcggaggcgaagttcaacggttatgttgtggagtacatctatgattactatacgaagaacggaacgtatccgccggtgtcggaattgcaggaacgcttgaactgcttccgggatctgatcgcgtaccggattgtcatctccatgccgaagtgccatcttaagaatccggaggacggagagcgggaggagatccgatatctgtatgagaccgccaatgtgcttaagggatttctggaggagcgcgggtttacggcggagcccgccggaggtgtgaaggagagcgactccccactgctttcggatgcggtgcgcccgtattaccgcgattatatcgcgcatgtggacccggacggctaccgctccctgcatattacgttctttgataacagcgcgaagtgctacatggagatgcagcttcggacgaagcggatggacgatattgcagagatcggacccgccaatcatctggggtatgagaaaaagcaggagagcgaccgggcgagaagggatgccatccctgagggggaatgtgtctactttgatgaagcctacgagcgctgccggagactgcacgaactcgagcttgcaaagctggatgtcaatatgtttgcggcaatcgacaacagcctcatcaatgacgggtgcgggctgtaccgtggccggctgattcttccgtatgagcacctgtcgcgttttcagaatgatctgattgactaggagaaggcaccggccgctttttttgtatttatgtgaaagattctgtggcggatgattgacgaatggagccaggcagagtatgatagaaagataggaatgtgtacacattctatcagagaacacaggaataaggggaaagaacatggggacaaaacagtatgagaggatctttcagattctgggtgctgtactgctcgccgcagtggttgtgggagtgatcgctgtatgttttggcaacggagcgaggagcggagtcaagagagagatcggagcgtccgactattattcgcaggaggagatcagtgcggcgatggataccgcgcaggagtatttcgacgatcattttccgggatgtgtgatgacagctttccggtacgacgaggagagcgtgcgggaagcagagccggaatgggcagatcagtatcaggcagatcaggcaattgttcttctgtcagattttcagacggacaagcacggcggagacggaagcctcaatccaaacgaaatttatcaggactggcagtgggtgctggtgcgctccggaaacggtgactggacattgaagacatgcgggtattaacctgcatgtcttttttttcataggaaattacatcctatgaatgaaaaagccctccgggcaggatcgcactgcgtcggagtggaattatgtcgctagagcaacccgccgtaggcggagaatcctgcaaagcaggattctttcttgtttcataggaaataccgtgatacattcatgtgcgaaagtagaaccttcctatgaaataaaaaacgctccgcgaggatgcgcagctcgcggtaaggaaaatatcgctttgcgaaccgctcgcgcgcggagaatctcgcaagcaagattcatttcattaggttactttccggtaaccggggtacaaaaaaggtgcgtactttacacggcaggaggcgtatcttgccgggatgacaatggaaaaaggaatcacggaacttgacggacgctcgatctgcattgacggcgacatcggcgaagtgctggcgcagctgtagggaactgttattttttcccgtagagaatgcccatgccgctgatcatccagggtgtgcgcacgtaggcggggacaaaatccagtgttttttccagatttccgatgtagtggatctcggaaatgccttcctttttcagctcttccacaaaggcatccatgtcgccgtagaggcttttctgggcgaagagatcctggaaagaaaaagctccgccgcgttttacgacgcgcagtgcctcccgcacgacatcacgcttgtctctggcggagtggacttcatggaagacgaagttgctgacggcggcgtcaaacgtctcgtcggcatagttcaggtgtgccgcatcgcctttctcaaaatggatgcgggaagcgacgccctcgattgccgcatttttttcgcactgctctttggcgtagttccactgcgcgccccagtaatccatgccgatgagcgctgcgtccgggaatgccttggcacagcggatggtgagcggggcagcgccgcagccgatgtcgagaagcgtgccgtgtccgtcccagttgagatgggcgaccagatgtgcgtgaacctttgccatcatatcgccttttccaaaggcaaagcattcgtggcacgcatacatatagatgccgaaggcgagcagaacggcgcagagaatggcgcagatgaccgcgaggggcgtgtttgagaaagcaagacctgacagcagtgcaagcaccagaaagagagcggcgccgccgaaggtcagatacaagagtttttcaggtacccagtttccgtagtttggtttttgattcattgtgttttcctcctcgataacaaatattttttttgttatgttttataaaagaaaatgcccaccggattaacgatgagcatcattctcttcctttaaatattgtattaaactcagggtgccggcgtcggcgtggatgccgatcgctctggctaaaaacagtctttctttcattgtgtagtctccatgaactaattccagatacccgtgcaggcgcatggacgcaagaatccggatcagttccggatccggttcggcgccgagatactttctgtaataacggcggaaagattcctgcatcatcgcggctgcctcctcatgaaaatgttcatagcagctgccggcggatttctccatcaggataatacattcctcacggtgtgcggagagataccggatgatctggatctcattgtcgtctgcagtctcgggatgttcctcctccatccgggcaagcccggaaaggagctctctggaatctgcgatgaagggatctaagatggcgcgaagcagcgcttccttgctcgcaaaagaaaagtaaaaggcgccggttgtcacgccggaagcttcgcagattgagcggaggttcgccttcgcatatcccttttccagaaattcccgtttcccgcaggaaagtaatttcttttcggttaatttttttcggtcttcttccataacaactgttatgttagtacaaactaacttgaatgtcaagatatacgaggattttttttaatgtatagatttcgttaaaaaaatgaatagaatatgtccacatatcatgataaaatggggctatagacaattttaatggaggatacgaaaggatgaagaaaaaatcatcggttattgtcaaactcattataccggttgcggttcttgggtgcatcgcaattatgattgcaggtgtgagtctcttttccatgacagcggttcagaaggaaagcaatcagatctccggagagggtgtacgtgcgacaatctgtatggatgagatcaatcttgcttttgccaacacgcagaagcttacgcttgcgctctgcgcagagccgagcaaggatctgtatgagtatgtggcatcccagctgacggaataccagtcgaacgtggacagctatgaaaaggagcttctggcgatggatcactattttacggcagatgatatccagcttatgaatgagacatttgatctgctcacagaggcgcaggggacaaccgtggaactgatgcagacggcgatggccggtgattctgcagcagcggtggcaaaggcaaattctgtgatgacggagtggtcagatacgattgcggtcaatatggatacgctcatatctcgcaacgatgaattggtgaagcagaatattcaggagcagaaagatctgtacaaccagaatatgatactatcgctgatcctgctggcaatttcttttgtggcatttgtcatggtggttgttgtgattatcaagacggttgtaaagccgctcagaaagcagacgagtgaactgacagagattattgatgagatcaaaggtggacacggtgacctcacaaagcgcgttacggtaaagtcgatggatgagatcggacagtcatcgatcggtatcaaccatttcatcgaaacgctgcagaatatcatgtccaacatcatcagcaattccaatgtccttgacggagttgtcggaaatgtagcaagcagcgttgcagcgtccagtgacaatgccaatgatatttccgcgatcatggaagagctttctgcaacgatggaggaggtatccgcaacgacgaacagcgtcagcgagaatacgaccgctgcggaaggcaaagtacagaagatggcagatcagaccaaggttatgtcacaatatgcgcgggatatgaagaagcgtgcgacggagcttgagcacacggcgacagagaacatgaacaacaccaacgagatgatcggcgagattacgacggagatgaaccaggcgctcgagaattccaagagtgtggagaaggtcgcacagctgacggcggatattctgagtatctccagccagacaaacctgcttgcgctgaatgcatcgattgaggcagcgcgtgccggtgaagccggaaagggatttgcagttgtagcagatgagatcagacagctcgcagattcttcgcgtgagacagcgaacaatatccagacgatcaatgagcaggtaattgaggcagtacagggactggttgtttcttcggagaagattgttggttatatcaacgagaacatcctgccggattaccgtgcatttgtgcaggggggtcagcagtacaatgatgatgcgacccacatcgacaacacgatggcagagtatgcgggcgaggcgcaggatatactggcgacaatgatggagatgacagaggcaattgagggcatcagccgtgcggtcgaagagtccgcaaacggcgtgactgatgcagccacgaacattgattccctggtacagtccatgtccactgtaaacggacagatggaggagaacagtactgtggcaaagaacctcaaggaagaatcagcagcatttgcatgtgtatagaacgcgggacggagccatctgaaagaagctgccgcacgaagcaggtaaacagctttgagtgataagttatactatgagaagcatacccctacgatttcggctggaatgcctatggaacattctgttcaaaaaatgcggcatttctaaccagccggtgactgcatctgcgatgatccgtgtctttccaagtttggagcactctacggactatgtccgcaagccaacagacaattttaggacttttgtgtgtcccttgcggcaccagacaacagatggcatttatgccatctttatgtcgaacaaaacataaccgcgcgaagccgatgtctgaattggcatctgccctattttcaatagcagatgccaacgagtttcggttcgcgcggttttatattgtctgtgaagcggtgccattagggacactagaaagtccgctcattgtctgtggcttgtcggacacactccgggagagtccaaacgtggaagagacacggaatcagatgcagtcatccggctggaagaaatacacacatttttctccaacgaatgtttcatatgcagttccagccgaaatctgtatcaagtgcttcctgtaatataacttatcgccccaaagtcaactgcccgcctgatgggacagcttctttgctaacggcagggtaaagataaattccgttcccacgccttccgtgctgatacagttgatgttttcgccgtgtgcctggacaatctcctttacgatggagagaccaagcccggttccttttttgtccttgccgcgggagagatccgtcttgtagaagcgctcccagatctttttgatgctgtcacccgggatgccgatgccagtgtccttgacggagacgaagatcttgtcgttcttctctgtggtctcgattgtgattgcggagtccgtgtggctgaatttgattgcattgtcgatcaggttgtagagtacctgctcgatcttactcatatcggcggagacaaaaagcttctcgccggttaagatcaggttgaaagtaatgcgcttttccatgcagcgcccctcgaacgtctggactgtcatgcggatcgtgtgattgatgtcgaaatccgtgatgtccagcatcgtgccgtgtgaaccgaatttgtttaactcaagaaggctcttggtcagcttgttcagacgctcggtctcaaagaggatgatgtttaaatatttgtcctgcatctctacgggaatggtgccgtcgagcatcgcttccacataacctttgatggaagtgaggggcgaacggaaatcatgcgagacgttagagacgaacttcttctggtcgtcctccagggtattcagttcgttcgccatgtagttgagcgaggcggcgagatagccgatctcatcattggagtgaacatcaatctttttttcaaagttgccggcggcatattcgtccgccgctttcgtaatcttgcggatcggtatgtacaccacataggtaaacagaatcagtaccacaaaggctgccagaaacagaagcccaagcgtctcataagcgatggcgacaagtccgttcgcgtaggacacgagactgctggtcggcttgtggatgaccacatagccgcgcactttgtagttgacggtgatcggcgagaaaacacttaacatctctgacgtaaactggttataaaacgtgccggtctgataatagcggcttccgaagtcggtaatgttgaagccgggaaccggtgtgggatcacagcccggcgccgccgtgttcagaatgatgctgccgtgcgtgtccacgatccagatttcgctggagagatagatgcttaaggtggaaagctgtgtctgtatctcgtccagcgtcatggtcttggaaaaataatttccggcatagttggaggagatcagggcggattcccggtagaggctggcagcctcctttttttccacaaaggcgaacgtaatgtggtaggtaaaggttgtgatgatgagaaaaccgatcagaccgtacatcagatagccggcgagcagtttggggtaaagggtacgtttcataggtcacgaacctcgaatttgtagccgatgccccagaccgttgcgaggctccagttggcatgatccttgatcttctcgcggagacgcttcacgtgaacatccacagtacgcgtatcgccgatgtattcataaccccagatgtggtctaatagctgctctcttgtaaaaacctgattcggcgaagccgcaagaaaatataaaagctccagttcctttggcggcatatcgacggcctgccccatgtagatgacggagtagttcgagagattgaccaccagatccgtgtacttgacgcattttaactctgcggcaggttcctccggctttgccggctgatagcggcgcagcactgccttgacgcgcgcgacaagctccttggagtcgaacggcttcatcatgtaatcgtccgcgccgagctccagaccgagtaccttgtcaaaaatctcgcctttggctgacagcataatgatcggaacatttgccttcgcacggatctcacggcagacctgatagccgtccatgccgggaagcatcagatcgagcaggatcagattcggattgtactgatcaaaagcgatcatggcttcctcgccgtcattgacgatccgggtatcgaaacattcctttgtgagatacagggaaatcagttctgcgatattattgtcatcatctacgatgagaattttctgttttgctgccatatcatcatctcctcatttttattttaaatatcagtccttaaactcggcaatcgtgacgccggcatcgccctcaccgaactcgccgaggtggaatgatttgacatattttaagcgctttaaatgagcctgcaccgcgttgcggagtgcgcccgtgccttttccgtgaacgatgcgcacggacggcagatgtgccagataagcgtcgtccagatatttgtcgagaagcggaatggcctcgtcggtcgtcttaccgatgagattgatctctgtggagacggaggcggatttgctcatcttgatcttgccggcactggtcttctggaactttttggtgcccggtgtggcgtcttcttccagaaggatcaggtcattgatgttgaccagagagcgcagaattcccatctgcacatagaggtcgcccctggcgttcggaagggaatggacggtgccctttaagttcatgctgatgactttgacgctgtcaccgatgcgcagcttcttcggaacgttgtggttcggcacggaagcttttttctgctcggacatcttctgtgcggctttgtccatcttgccgcgcagcttggtacgttctttttccatctcgctgaccggtgcgcccgccttgccgtatttgttgaaattgcggatcgtttcatcggcgacatccttggcttcttttaagatgctgtatgcctgctcgtttgcctcgcgcagaatcttgtcgcggctggaatccaggcgctcctgcttctgctccagctttttctttaaggactcgatttcggctttgtactggttgatctctaactgttcccgctcgatcgtgctgcggctcttctcgagatcggcgatcagatcttcaaaatcgccctcactcttgctgatgcgccccttggcgtcggtaatgagatctgtcggaagaccgagcttttcagagatggcaaacgcgttgctcttgcccggaataccgattaagaggcggtaggtcggacttaacgtcgccacgtcgaactcacagcaggcattttccacgcctggtgtggagagggcatagaccttgagctcgctgtaatgcgtcgtagccataatgcgtgctccgtaaaggtggagcttcgagagaatggagatcgcaagcgcagcgccctcggtcggatcggttccggcacagagctcatcgaaaagtaccagagaacggtcgttgacctgctctaagatacggatgatgttgaccatgtgggaggagaaggtactgagcgactgctcgatactctgctcgtccccgatgtcagcgaacacttcgtcaaaaataccgagttccgagcgctcggacgccggaatatgcaggccggactgtcccatcagcgtcagcagaccgacggtttttaaggagaccgtcttaccgccggtgttcggaccggtcacgatcagcaggcggaaatcctcgccgagccgtacgtcgatcggaacgacctttttcggatcgagtaacgggtggcgtcctttgcggatgtgaatccgtccgtcatcattaaaaagcggggcgaccccgttgtatgtctgcgcgaaagccgctctggcaaaaataaagtccagctcggtcagaagttcatagtcggcgagcagctgtgtggcgtaggaggcggtcagattgcttaagccggcaaggatgacctcgatctcctcctgctcacggagctgcagctctttgtattcgttgttcagattgacgacagccatcggctcgatgaaaagtgtggagccggtggaggactggtcatggatcatgcctggaacaagagactttgcctccgctttgaccgggagacagtagcgcccgtcgcgcatggtaatgacggtgtcctgcagatagcttctggtcgtggtgttgttgatcatggagttcatctgtgcgcggatcttatcgttcattccgcgcatggaacgccggatcgagtgcagcgtgctgctggcgtcgtcggcaatctcgtcctcggagagaatacagcgccggatctcgtcacacagcggcgtgagaggctcgatgccggcaaaaagactggtcagggaatcgtccggctgatcgttgtcgtcctgtgatctggcaaaagccttcgcgcgtttcgcggactctaagagggagcagacgcgcagcagttcgatggcgcttaaggcgccgccgatctctaagcgctttagcgaatcgcggatgtccgtaactccagaaaaggacagggagccgtatttgaacagccggcttaaggcatccgatgtctgctgctgcagctgttcgatctgcgcgcggtcggtgatcgggcgcagcttctgacagcgcgacttggcgtcagcgctgaaagcatattcggtcagttgatcgagaatcttgttatattctaaggtgtgtaatactttttcgttcatagcagttcctttgatttgattgtcacatggttatgtccttcttattatatatgattccgggagtcttggaaagcggaacctgaaaagaattgtagaatcctattgcaagcgtatgtgattcattttataatgattactggtacggttttcagaaattcgtgtgtaaatacatgcagaaaagaggaaatcatgcagcaaaaggataacgatcagttttcttttattaacgaaaaaatcaaagaaaagccggtcaataagaagcgattgctgatgcaggcaggttttattgccctgatggcagtcgtttttggaatcatagcaagtctggttttcgcgtattttcagcctaagtttgaatcactgttttaccccgaggaggaaccggtggtcaccattccgcaggattcggttgcggtgacggagctgactgaggagacagagacatccgaggagacggaggcatccgaggaaccacaggcaccttccgaggaaccgccgctacagcagccccaggagcttgagattgcggatgtacagaacgtgcagaataagctgtatgcggtgggaagagaagcaaaccgctttgtcgtgaccgtgacgggggtcaagagcgacacggactggttcaacaattcttacgagagcagaggacaggcatccggcattatcattgcagacagtggtcaggaacttctgatcttaacggagcgcaaggtcatctcagatgcacaggaggtctatgtcactttcatcaatgatgtgacggtggaagcgtccatgaagcactacgacggcaatacgggaattgcagtgctctcggtgccgcgcagtcaggtggatgaggataccatgaatgcaatctcggtggcgaagctcgggaattcactgactacaatgcagggaaccatggtcattgcggtgggaagtccgctcggaacgaactattcgatccttacgggcaacatcacatctaccaataatgtgatttccacgatcgacaataattataccgtctttacgacggatattgtgggcagcagcagcggcagcggcgtcatcatcaatgtgaacggcgaggtgatcggtctggtcatgcaggattacggcaatgaggaggatcagacgacgctcacagccctctcgatctccgagttaaagcagttgatcgagaagctgtccaacaatcaggacattccgtatatcggtctgggactgacgacggtttctgcggcaaccgccaaggaatacgacattccgaagggtgcatacatcaaggaagtcaagatggattcaccagcgctggcggcaggactgcagagcggcgatgtcattacagagatggatggagaagctgtctacacggtggacagttatgagagcaagcttctggcattgaaaccgggcgacgaggtggagatcgttgtacagcggcagggcgcggagaagtacgaggagatcacctgtacggtacaggtcggagtgttaaagtagaggatagtaacagaaggcggtgtcttgcggcaccgtcatattatggaaatgaggtcagaaatgaagtatattgagagcctgcgtgagggcgagagaatcaacgaaatctatttgtgcaaggtaaagcagtcagcgctgacaaaggcgggaaagccttatgataatctgatcctgcaggataagaccggtacactggacgccaagatctgggagccgggctcggttggaatcgatgagtttgattcgttggactacatcgcagtcatgggagacatcacaagttttcagggaaatctccagctcaacgtaaagcgtgtgcgcaaggtgcaggaaggggaatacgatccgaaagattatctgccggtatccaaaaaggacatcgacgggatgtatacagagcttctcggactgattgcttccgtgaagcacccgtatttaagaaagcttctggagagcttttttgtcgaggataaggattttgaaaaacggttcaagttccattccgcagcaaagagcgtgcatcacggatttgtgggcggactgctggagcatacgctttctgtgacgaagaactgtgattattttgcggaaacttatccgatcttaaaccgcgatttgatcgtgtctgcggcaattttccatgatatcggaaagctggaggaactctcgacgttcccggagaacgattacacggatgagggacagcttttaggacatatcatgatcggtgccgagatggtcggagagcggatccgcacgattccgggattcccgaagggaaccgccaatgagttgaagcactgcattttagctcaccacggagaactggaatacggttcgccgaagaaaccggcacttgcggaagcactggcactcagttttgcggacaatattgacgccaagatggagacaatacgggagatttttgcaagtgttccggagaacaatctggagtggcagggatataaccgcctgctggagagcaatatccgcagatcaggaagagagtcataggtatatcacaggatatgaagaaaaacgacagtattgagttaaagatcgaagatatgggcgttgacggagagggcatcggaaaatacgaggggatgacctttttcgtgaaagatgctgtgatcggggatacgatccgtgccggcatcacgaagctcaagaagaactacggctatgccagggtgcaggagattttagaaccgtcgccttaccgtgtgaagccggaatgtccgctgtatgcgcgctgcggcggctgccagatccaggcgatggactataggcagcagctttgctataagcagaaaaaggtgcgcggcaatctgatccgtatcggaggatttgcgccggaactcattgattccgtgatggaggagattgtggggatggagcagccgtatcgttaccgcaataaggcacagttcccgatcggcgcggacagggacgggatgccggtggcgggattttacgcagcgcgcacgcacagcattatcccggtggaggattgtaaactgggcgttacgcagaatgaacagatccttggaacggtgctttcctatatgcgtgagaacggcgtccgcccttatgatgagacgatcgggaagggactggtgcgccatgtgctgatccgttacggattcacctcaaaggaactgatggtctgcctggtcattaacggagagacacttccgcaggagaagaaactggtggatgcgttgtgtaaaatagaaggtatgaccagcatttccgtgaacatcaaccggaagaatacgaatgtgattttgggggaggagacccggaccgtctggggatcggattatatcacggatcagattcatctgcgcgattgtgaccatgattttgcactgacagatacggcaatcgcttatcacatttccccgcagtctttttaccaggtaaacccggtgcagacggagaagctgtacagtctggcactttcctacgcgggtctgactggcagggagaccgtctgggatctatactgtggaatcgggacgatctcgctgtttctggcacagaaggcggggaaggtctacggcgtggagatcgtgccgcaggcaatcgaagacgctaagagcaatgcggcattaaacggtattaccaacgcctcctttttcgtgggaaaagcggaggaggttcttcctgagttctatgaaaaggagagccggaagccagatgcggacatgcttcatccggatgtgatcgttgtcgatccgccccggaagggatgcgatgagaagtgcctggagacgatgcttcgtatggaaccggaccgcatcgtgtatgtcagctgcgatccggcaacgcttgcaagagatctgaagatcctgtgcgggggcggctatgcacttcggaaagtgcgtccggtggatcagtttgggcacacgacacatgtggagactgtggctttgctcagcgcggaccgaagtggaacggagactggtcgacagtaggaaagtgaaggttgacatctcgttggaggatatggatttatcagagttcaagggaaaagcaacctatgaacagataaagacttatgtactcgaacagacaggactgaaggtttcttcgttgtatattgcacagattaagaagaaatgcggactggatgtgagagagaattttaatttacctaaatcagaaaatgcgagacagccataatgcacaccggagaaggaagaagcaatcatgcaagcgtttaagcatttcggaattatatagattgtttcatgaaaaggagttaaggatattatgcttagacatgacatggtagaaattgtcggaaaggaatttctgacaagcaatatagaagcgggagaatacagttatgttcaggcggcaggtggaaaagcacaactggaagcaaaggttggtcatcctgtatcacacttcaaattggatattcgatttgaaatggatgatgtggtggttttgattgagacaaagcagaactatgtggatgatgacgaaaagcagttgcgtgaatatcttgaggaagaacgtgcaattcatccgggaaacaaagctatttgtgttcttgccaatacaaataacgataaaatcaaagtatggaaatcatttgttgatgatgaacatgtattgaaagatgaagctatgctggacagaatggcccattatgtaagattgttcagaatcaataaatccaatgaccgagaaacagttcttagaaatacatattcattaaatgaacttttgcataaaaaggatattgacgagaatcttcgtagtcagttcgtaggaacaagtctcttgtatatcaaagaccttgtaaaaaagaaaggtactgttttgattacaaaagaatttgttgattcaatgaaagagttctggagtctgatgacaccaaagggcatcagaggtgctattgaaggcgtattatctgatttgttggatgactctgacaataaagctaagaagattgaattacttcaaaagaatgttctgggaaatcaaaaggttagagctttgaaaacaactgattgggtagaaattcttgaaacaattatgttggatatttacagatatattgatactgacagttcagaagggcaggatattctgaacatgttcttcatcgcttttaataaatacacaggaaaagcagataagaatcaggcatttacacctgatcatattacagagtttatgtgtcgcgctacgggcgtagatagaacaaagcgtgttcttgatgcaacttgtggaagtggttcttttcttgtacaagcgatggtaaaagagcttgctgattgtagacgtggtaaacgtgaggaagaggcaaaagaccttatgcgtaaggtaaaagaagaacatatttatggcattgaagttgaggagaatgcctatggtctttctacaacaaatatgctgattcatggtgatggaaacagcaatattaaatttggaagttgttttgattgcaaggagtttatcaaagatgcaaaccctgatattattcttatgaatccgccatataatgcgaaaccgattggaataccagctaaatacaaagcaagttggggaaattcaaagaatggaaaagaagacccaacaaaggggtttgtatttgttcattatttatctgatgtaatcaaagaaatgaatgataaaagagaaaaagatggtaaacctcgtaagacggtgaaaatggcagtattgcttccagttgcaacagcaataggaacaaaatccattattcaaaatgaaaaaatagcaatgttagaaaataacacattagaagctgtgtttacacttccaaatgaaattttttatccgggagcatctgcatcggcttgttgtatggtttttactttaggtgaaccacatgttaaagttgatggaaccacaaaagaaacattttttggttactataaagaagatggtttcaagaaaaagaaaaatctcggacgcgtagaacagtttgatgatgatggaaatagtaaatggaaggctattgaagaagaatggcttcgtttattccgtaatcataaatcagttgcgggcttatctgcaacagcagaagtaaccgggaaagatgaatggctttgcgaagcatatatgaaaactgattacacaaaacttcgtgaagaagattttcagcggacattgaatagttatcttgcgtatcttatcaaggagggcaagatttatgaatcttaatgttaatgactggaaagagtttaaaacatcaaaattgttttatgatatgcaaaatggtaaagcaaatcaacaaatgcttgaaaatggaaatgaatgtttttatgtaggcgcgaaaaaagatgacaatggagttatgttgcattgtgttaaagatgaaagtttaatgacaaagggtaattgtattatattcatttgcaacggacaaggttctgttggatatgcaaattatatggatgtagattttataggaaccacagatattgttgcaggatataatgataatttgaatgaatatacaggtatatttttagcaactatatattcgcaagaaagaccaaaatattcatttggaagaaaatggaaaactcatttggctgatacaaagatcaatcttcctattcagcataatgctgatggaacaccatttattgatgtggataaaaagtattcggatgatggttatgttccagattggaagttcatggaagattatataaaatcattaaatcataaaccgttgacgacacaaaataattatgaaactgtggagttgaaagttgtcaaatggaaggagtttcgtttgggaaatttgattcagaaaccatataaagcaaaagcatttaataaagacgagttagaagaaacaacagagcaggattttggaattcattacattacaagaacgagtgaaaataatggttgtgagttaattgttaataaaaaagatatacctagtgaatttgtcgaagaaggaaatgcaatctcgataggcgatacaacagctacttgtttttatcaagcggatgaatttattacaggtgaccatatggtagtagttagagctgagtggttaaacaaattattaggaatgtttattgtgagcatattgcaaaaagagcaatataaatattcatatggcagagcattcttaatggaaagaatttcggatacaattataaaacttcctgtgcaacataatactgacggaacgatttttattgatgacaaacataaatattcagaagaaggatatgttccagattggcattttatggaagattatattaagtcgttaccgtatggtgataaattgtaaattaaaagaacagatagtgtataatttttcaagtcaaggctacctcacatctaaagtgagatagccttttctaatattcaatttcacgaaatgattataattccaaagcaaaaatgaataaaacgtgtaaaaataaatgttcacattattttaatctaaaaggcgatagaaacacacatttacaaaaaggatgttcgattttactaagtattatatggaatactgctggatcacaagtgcctgtcagactccaatggagacgcatggcgtgataaatatggaattacctatatcatttttacaatcgaagaaattatgaacctgatgaacctggggaataagaaggttaacaaaatgttgaaggagctggaggagcatggcttgatttaccgaagacaccagggattgggaagaccaaataagatttaggtttatgatttgcgcaaagcagataattcaaactggttgccaaaacaaattatgttcggaaaggggagcaacaatgagaaagaagtattatgaagatgcaaaagagaatgcagcctttgaaagatgtgcagatgtaataacatccttgattctaaaatatggaccggctttaaaacgaaaatggaatctaaacgagtggattaggaatattcaggcagagagtctatggaaagacatagcttgcaaaaggtatcagcggtattttattcacatgatgaatatgaaaagtgttcatgcatgacaaaatcaaattgactaatactgattatcaatatataatacagacaaaacgaaaatgacatgaacggagaaacaatgaagtggagaaggttataacacttgaggaagcattaaaaagaattgaagagttggaaaatgagaacgctgagttacgtgaagaattggaatattataaaaatcgtaaattaagcggaaggcagaagcataatgcaaaatggatggctatttacgatgattttgttgccggttatgaaagtggaatgactatggtagagattgcaagaaggaataatgtcagtgagagaacgatttacaggtataaagcgtattatgacgaattaaaggacaaaaatgagatggaaagtaaatagacaattgaagtggaggatgatgaagtgaaaaatcttgtcaaagacacaattcatgctaatggaattgatattggaatatatacacaggactttgaaaatgaatttatatcactgactgatattgcgcgttataaaagtgatgaaccaaaggatgtaatcaaaaattggatgagaagcaaggatacaatagaatttcttggtttatgggaaaaactacataatagtaattttaaaggggtcgaattcgactcctttagaaatcaggcagggtctaatgcatttacaatgtcacctacaaaatggatagagacaactggagcaataggaatcgtaagtaaatctggacgatatggtggcacttttgcacattcagatattgcgtttgaatttgcatcatggatttcagcagaatttaaactttatataatcaaggattataaaaggctgaaagcagatgaaaatagccgtttttcattgaattggaatctaaacagagaaatatcaaaactgaattatagaatacatacagatgcaatcaaagaaaaattgataccaccggaattgacaccggcacaaatcagttttacatatgcaaatgaagctgatatgttaaatgtggttctatttggcagaacggcaaaacaatggaaagatgaaaatccggatataaaaggtaatatgagagatggtgcaaccctgaatcaattattaatcttggctaatttagaaagctataatgcagtgttgattcatcaagggaaaaaccaaaaagaaagaatggaattgcttcgacaattggctttgcaacagattcgtacactagaatcaattagtactgataagcttccaagattacgatagattcatattattaagacaagtttgggggataaagatgaaaaaaacaagatgttacatatatgctcgtgtatctacggctattcaggttgatggatacagcctggatgcacagaaggacaagcttagaaaatatgcagaatttcaagatatggagattgttggagaatattctgatgaagggcattccggtaagaatataaaaggccgccaggaatttatgcggatgctgaatgatattgaagatggcaaggacggagttgatttcgtccttgtatttaaattatcgcgatttggcagaaatgcagcagatgtgctcagctctttacagcttatgcaggattatggtgtgaatcttgtctgtgtagaagatggaattgacagctcaaaagaagccggtaaactgcttatatctattattgctgctgtagcagagatggaacgtgagaacataagagtacagacgatggctggacgtgagcaaaaagccagagaaggaaaatggaacggtggatttgcatcttatggatataagctggaaaatggagaacttgtcattgcagaggatgaagtggtaattattcaaatgatttttgaacgatatattcataccaatgatggaatcaatggcgttgccaattatttgaataatcatggttatacaaagaaattacgtcaaaacggaacaattcccggtttctcatcaagttttatcaaaaagattattgataacccagtgtatatggggaagatagcatacggacgcaggcgaaccgaaaagaaaacgggaacccgtaatgaaacgcatgtagtggaacaatcggagttccctgtatatgagggaattcatgaagctaatctggatgttacagatattcattacgataaaaaatttcagatttgcagagacgattagatacccaatatgataaaatagatgaagtggaggaggcaatcgtagaggcactgagatattttcagatgattccaagtgaatcgtaggatgattcggcttataagaaagagaaaatttaactaatgctatagagtcttcggacattgggaataaaacctgatgttcgtaggctttttgtttacagaaaatttttttgtggatataataaacatgacatatagatgtcgtgttgtgttagatatgatatgtatggagagtggaattatgaagatagataggcttattgggatattgtcaatcttactgcaggaagaaaagacaacggctcctgaactggcagaaaaatttgaggtatcccgcaggacaataaaccgggatattgaagacctttgcaaagcaggtattccaataaggacggcacagggaaccggtggcggtataagtattatggacggatatcgtatggataggacgatactgacatccaaagatatgcagatgattcttgcaggtttgcggagtcttgacagtgtgagcggaagcagatactacagtcagctgatggagaaaatccagaccggatcatcagagttcatcagtggaagagactctatgctgattgacttatcttcatggtataagggttcccttgctccaaagatcgaggtaatacagagtgcaatagaaaacaggcgcatcatacgatttaagtattatgctccgtccggagagagcaaccgaagggtagaaccatattatctggttttccagtggtcgagctggtatgtatgggggtggtgtttagaacgtaaagattacaggctgttcaaactgaaccgtatggattgtgttgttgaaacagaccgtggatttctgtgcagagatgtaccaatgccggatttgtcaaatgagaagatatttccgggtgggataaaggtaaaagctcttttcacaccgaatatgaagtggcggctggttgaagaatttggaccgaactgctttacagaaacagacgatggaaggctgctcttttcagcagactatacggatatggaaaaccttgtgacatggcttatgacatttggagcaaaagtagaggtgcttgaaccaaaagaagcacgggacattatccgcaggaatgcggaagaaacattaaaaatctatggaggattaggaaaatgacatttgattataaaaaagaatataaagaattttatatgccgaaaggcacaccgtctatcgtaactgttccgaaaatgaactatatagcggtaaggggaagcggcaatccaaatgatgcagacggagaatacaagcaggctatcggacttctgtatggaattgcatttacgattaaaatgagcaaaaaggaagatcatcagattgatggatatttcgattatgtcatgccgccattagagggattctggtggcagggggagcggcgtccgggggacgccatgctgcgaaccgaccgagccgacaggcgagacggcgtatccggaattgattatgctcgtaaggaagattttaagtggatttctgttattcgcttgccagattttgttaccagggagaatttcgactgggctgtcaggaaagctacggcaaagaaaaaacaggatttttctaaggttgagtttttttcctatgaggagggcttatgtgtacagtgtatgcatatcggagcgtatgacgatgagcctgctacggtagatgcaatgcacagatttatggaagaacagggatatacacttgatataacggatcagaggatgcaccacgagatttatctgagtgatgcgcggagagtggcacctgagaaatggaagactgtggtcaggcatccgataaggagggcttaaaggtatggaatatattagagttacgaaagaaaatcttgaaaaggagcacatttgctgtgccatttccgacaataaagatattcaggtatcatcaaagaaggcatggcttgcggatagatttgatgagggtcttgtgtttcttaagagcgtagaacgcggcaagtgctttattgagtacatacctgcggagtgtgcatggaatccaatcgaagcacctggttatatgtatattaattgtttgtgggtgtccggttctttcaaaggtcatggatattcaagtgacttactttccaagtgtattgaggacagcagagaaaaggggaaggaaggcctatgtattcttgcggcagcaaggaaaaagccatttctggctgatccgaagtttctaaaatataaaggatttgaagcttgtgatgaggctgataatggaatccagttatggtatctgccatttgaagagaaaactgagccaccggtgttcaaggaatgtgcaaaacaccctcatataaatgaacgtggctatgttctttattatacaaaccaatgtcctttcaatgcaaagtatgtaccaatcttggaagaaaccgctcagaagaatggcattccattcaaggctgtgaagatcgaaagtaggaaggatgctcagaatgtaccaacgccgattacgacttatgcgctattttgtgatggggagtatgttacgaatgagcagatgaatgataagaaattcttaaagctggtgggaagataggagaaaacaacatggcatatgctttacttttttacgatatgatgttgtatcgtattttatttttgagaaaatgcagatggtttccatttcaaaagaggtatggagataaaaagtgtcagaaattcggcatcaggcattgctgaccaaagaccgtatagtccaaactccacttgtaaaatagtaagaaattcttgtatttaagggaggcttggcaatgaacaaggattttggatgctactgtggctttcttgcagacatgattatgaaatatgcaccagagataaaagatgcatacaacatcgacaccttgcagcaatgtagggtgtttttctattacagaaagttcatcggctcgccaccgtgcaagaggtggacatacttcataaccgtatgcaagaggcaggaatgcaatttttgtcatgggttatgcacttaacctttgtaacacacatatttctattgtaccatataatcagaatataggaaaagaaggaatacatatggcacaggacagagttcggattgcggatgttgcagattcattaggtcttagtactgcaactgtctcaaaggtgattcacggaaaaacagaaaagatttcggatgagacggtaaaacgcgtccagcaggagctggagaggtcgggatatatcccgaatatggcagctattctgcttgccaggaataattcaagaatcatcggagtggtggtgaatgataatgaaaagtatgagggcagggttttagaggatggatttgttatggcttcaataaatgctctctcccatggggtaaatgaaaaaggatattttctgatgataaaaacgacatctgacatcagtgagattccggtgtttgcatctatgtggaatatggatgggctgattctgatgggtttttgtgaagcggattatgagaaactcagaaatcagatgcggatatcgtttgtagtgtatgatggttattttgaaaaatgttccaaggtggtcaatctggtcatcaatcattatgacggtggttatcaggcaggaagatattttagggagcttggacataaaaaagcgttgtgcatagcggacaattttatctgcatggataaagagcgcatcgaaggttttagcgaagcctttggaccgggagaaacattaagatggaaaataccaaggacagaaaaggagagaatgcgtttttatgaggataaatatcaggcgctgttagagaaaaatgttaccgctgtttttgcggtatcagatttctatgcacttgagtttatgaggtttttgcagggaaagaacattcggattccaagggatatccagataatcggatttgatgacaacatggcaagcagggaaagccatccttctctaacaacaattcatcaggaggcgtcccttagggcagaaactgcaattaagtgtcttgaggcaatgcgcgatggagcagaatgtgagacaaaaattgtgttgccggttgagttaattaagagagaaagtacgggggaattataatgtcgaagtttatgaaatcattgtgtaaaatagcaattcctgtcaccttgcaaagtatgctgcaggcatctttttcaattgtagaccagattatgataggacagttagtggagactaacatatcggcagttggactatgtggaaacttttcgctgattttttctgtagtgattggtgcagtgagtacggttgcggggatactgatcgcacagtttattggtgcggaagatacaaaagaggcatggtgcagttttgatgtgagccttattagcggaatggtaatagctgcgctgtttttgtttgcagcaggagtttttccctcgcagattcttgggctgtacacgagggatgtgagtattgtaaataccggtgcggtctatttcaggatagtagcgttctcctatattccaatggcggccggcaatattttatcttcgtggctgcgctgcagggagcatgccacaatacctttttgggcgagctttggggcagtcgctgtaaacacaggtcttaattatctgctgatatttggaaaattcggattgccatgtatgggaataaagggagctgcgatcgcaacactgatttcgcagttatttaatctggtatttattgcggttggatttgccttatgtatcagaaaggatgaagataaaccggtatggtcattgcgtttcagtaaaattactatcaaggattatctgatcatgattatgccgattctggtcagtgaatttttgtggagcctcggacaaaatgtggagtctgccgtctatgggcatcttggaatggcaaatctggcggcatacacacttacctgtccgatacaggggcttattgtaggagcgcttagcggattgtcggcggctgccggtgtaatggttggcaagaggcttggcaggaaagagtatgatgaggcttatacagaatcgaagaaaataatgtatgcaggcttaattggtgcggcagcagtatcgatattgctcattcttctggctggagtatataccgggctgtatcgtgtagatgacagtgtaaaagaacttggaaagatattgcttattgtatttgccctgtatgcaccggtcaaggttgaaaatatgatactcggaggcggtatcataagaagcggcggcaataccaaaatgattatgatgattgatattgttggcacatggtgcatcggaatcccgctgtgtctgcttgcagcatatgcatttaagtgggacatagttggtgtgtatacactgcttaccaccgaagaaatattcaggctggtggtagcgcttgttatttttaagaggcgtaagtggatgatcagcttatcgtagtgtgaggtgatggatatggatgatatactcaaacttcgcacttgaataagtgcctatgcaccttgaaaattcaataataactggcataaaaatagcatgaaaccatctggctttggtataattgagttgtccaaaaacaatcatacttccggaggctcatgctatgaataaaagtataacacaagcaactcaatatgtacataatggtacgcgaaaaccggatttagattactcctttgtcgctaaatgtttttttcgataggcagagggtgagaatccagtactcttcttaaaagccatagaaaaatactgctcagaggtataaccgcagtaatatgcaatttccgagaaagacagtgtggtgtccgctaaaaaggagcaggctcgctttaaacggagatttgctatatactgttgaattggtataccactgatttctttgaatatccggtacaggtatgtgcggtccagaccgattgtatcggaaacactttgaaccgtgatgtccgtatagtaggaatcttgaatgagagagattgcctgtgctacgtaatattcttttcgggacagtggctttatattttggttgtgctgtatcagcttggcacatatgccataaaactggctgagtgctgtatagcagtcagaggtagaagctgagttgagaaaaataagcggctgaatcatggaggttaattcttcgatagggttataatgtagaaccggagcgtgtcggcgaatgttgcacaagtgtataatctgtaacgcatcgatgccatcaaagccaatccagtagtatacccagggttcacatgcatcggactggtagcggatgggaacgtttgggattaaaagaaaacaatcaccggcagagagatgccaggtctggttgtgaacctggtaggtaccttttccttttacaatacaatgtaaaacatagtggtcgatgacggtctgcgcggagggctgtccctgcgttgtttcatgatagccacagtctaatatgtgaacggtttcatttgtagattcattctgtctaaagtagcaaatattcttctgtctcataatggctccttttaatagcaacaaaatatgaaaatatgacaacataattctcttttatttatatcaaaatatggtataaataacaatatcaagaaaagaaacaaagagattttgtgaaatatgtacgaaggactatacaggtaaaacaatatgaaaataacatattatggaacatcggcatcggaagcgtggcccgcattattttgtaactgtgaggcatgcgagctggcaagacaactgggtggaaaaaacatcagaaccagaagtcaggcattagtagatacaacattgttgctcgactttccaccggacacaaattaccatgcacagcagtatcatttagatttaaggaaagtggaaacactgttgattacacacagccatcatgatcatttttttccctatgatatttgcatgagaacagagaattatgcaacaggtttaagtgataagaaattgacggtatatgggaatgaagaggtcgaaagccggttttgccaggctgccaggatagatggcagtgtaagtaagtttgtaagatttcagcggttggaaccatttgattgtgtcaatacagaagatgggtatgagattacagctgttctggcggaccacaatcaaccagaaaagtcgttactctatctgataaaaaagggtggtaagcagttgctttatgcacatgatacgggaattttcccagaggttacctggaagtttctggaaggaaaacgttttgatttcgtaagcctggattgcacggcgttgacaagagactggaagaaggggcatatgggatttgaagcagtggatcaggtgagagaccgaatgacagaaatgaagtgcatagacacaaagactacattggtattaaatcattttgcacattttgataactttacacacgagaaaatatgcagaattgaaaatccaaagggatatgaaattgcatacgatggatgtacatttgttttttaaagaaggtgtaaattaagcgatgaaacgcttaagataaaaggaggaaaaaatatgttaagagggaaattaggaaagaaagcaatggcaatctgcctggcagcgagttcagtattactgatcgcttgtggtggcagtacagcacaggaaagtggaacaccggacagttcagcaaaaggaacagaggttgcttccgaggaggctggaacaaatttcgaaggaaaaacaattgaaatcgcgacttatttatcaggtgatacactgagtgcttataagcaggtgattgcagattttgagtcagaaacaggggtaaaagtaacattggatgaatatggtgatgattatgagagcactatgaagaccagaatggcttccaatgatttgccggatatttttgagacacatggctggtcattaattcgttacaaagaatacttgacagatttaagcggagaggcatgggcttctgagctaaacaatgcagcacttggcgttatcaaggactctgatgacaaattgtatgcacttatgaccacaggttcctgccttggaacagcggtaaacatgaatgtatgtgaggcagcaggtgtggatccctgggcaattgaaacatgggaagattttaacgcagcttgtgataaaatcaaagcagctggctatacaccggtagcaaattactttacatcagcaggagcattggcaaatgcaaacggttcctggttaagctatgaaggcgagcagtttaatgataacgaagcaatgctcaacggaacctgggactggcagaattttggtgtaatcttagattacttacagacctggtttgataacggatatctgtatgaagactgtggaaccatcaagcaggcagatgttattgaacgttgtgctcaaaatgaatgtgcatttgttgttggtattggaacatctttccagacagctgttgtagctcagaatccggaagttaaaatggcaatgattcctatctgtgcaagtaaagaaggcggagcacgtttctgcggtatcggtgaaggtgcatcttttggtatttggaaagatacggatgagatggaagtatgtaaagcgtttttaaattatgtttcacagaatgcagatggaattaatgcagcagcaggtgaaatcagtaccttaccatgtgaaactacaaaatcttatggtatgcagttaatggaagagatggaatctcattatccagatgtattctatgataatctttgggatcgtaaatatatgccatccggaatgtggagtgtattccaggttgcagcaggaatgttctgcgaggatcagtccgacgaaagcaaggcagaagtcattgaatacttaaaagaaaattatacagatttatatgaggcagcacaggaataataagcagcagataagttgggcagaaaggacgatccggtatggaaaagaagaaaaaatgggtattgttatctttgagtataccagcatttttactgatatttatatttatgattgttccactgggaaatgcagtacgcgtatctttctttaagtggaatggttactcacagaagatgaagtttatagggttggaaaattacatatcccttttttcagacaaggtattctggcgctctacatttaatacgtttatctatggatttggcagtacgctattacagaatatattcggactttctgccgcgctgtttgtaaataagcagtttaaaggaaggaattttgtacgactgatactttatatgccaatcatgatttccggtgttatcatgggtgcaattcaatattatgtttttaattacgataatggtgtcttgaacaatatgctgaaccttatcggaatcgaaaatatttattggatgaaaacaggactgggctccgtactcattattacactgataaacagctggcaggcaatgggattttgtatgctgatttatctggcaggactacaaaatattccgaaaatgtatgaggaggctgcgctgcttgacggcgccagtaagcgacaaatattcttcaaagtagatattccactgttaatgccggcaattacgacggctgttatcacaaacctgataggtggacttaagctttacgatattattgttacgttgacgaatggtggaccaaatcggaagtcattgtcattatcgtactatatttcattgctttacttcaatgatgaaaaggccggatattcggctgcagtaggaattgggttatttttgattatttttgcagttgcagttccgattaaccggtatttgagaagtaaggaggtggaatattgatgaaagctaccgcatatgaaaagggcaaaatgaagaaaatgtatgcccctaataaaaaagtgaaaatctggatctacatagtttccatttttctggtactgctgtatctgttaccaatctatgtaatgctgaaccagtcatttcgatacataacagatttgacaccgcgactctattttccagaaaaatggacacttgagaattatgcacaggcgttatttgaatcagatttatttattggatttaagaactctattgtgtatgtgattgaagtatgtgtcatcgaagttgtgctgggtggtttggcagcatatggacttgcccgggcaggaggaaaaatttctacggcacttagaacgtttaacatctgtattatgatgataccgagtttgtcgttgttagtaggtacctattctttgatggtgaaattccatatgattaataaaatatgggcgttatcgcttcaaacggccgcaattggtatggcgggaaccatgtttttctacacgtcatttatcatctcaattccaaaggatttggatgaagccgcagcaatagatggagcaggaatttttcgaacatttttccagattattctgcctcagctgaagccggttacagtgacgcgtctgattatgatagcagttggaacctggaacaattttgcaatgccaacctacttgctgacagacacgacaaaagcgaccgttatcatgacggttcgaaaagctttttacacggcagcaggggctgtgcagaatgtgccgctggcctgtgcagaatgtgtgattgcattattgccggttatcgtgttatatattctgcttcaacgatatattatcgagggacagttggactccgtaagtaaataatcaagacagatagaggggcttaagttatgtatcaatgggaaaaaggaatttcgttgagtttttttcaaaatgaacagggggaatgtgttggtggcgacaaggttgttcttgataaggtgcgttcctatggatttgattgtgtggaattatctttttcgcatgacgactatttcaaaaaatatcgttttacagagggcgataatgcagagcagctttttcaatactgtgaatcgataggattgaagatttggagtattcatttaccattttcagatgtatgggatttgtcatgtgatgatgcacaaaaggcattgcaggacgacgtgaaattgctggaggcagcaggtagggcgaatatttcggtggctgtcattcatccaagctttgagccaattgcggaagaagcgagaaataagcggctttccaatgcaaaaaagaatttgaaaatattaaatcaggtggcaaaagaaaatggcatcgtgttagcccttgaaaatttaccgcgtacttgtcttggaaatacgtcagaggaaatgctatccttgttaaatgaaacaggagctgcgtttattttcgataccaatcattccctgtcagaggataatgtcagctttttacaaaatatgatacagcacggatattgtccggtgtcactgcatatatctgattatgattatgtggatgaaagacatgatttgccgggaaatggtgtcaatgattggaagaagcttttgacgatgctgcgtgacggaggctacaagggacctgcgctttatgaaatacgacataaggtatcggcagagcgtacgatttccttggaagagattgcggataacattgcattactgataaacggagatatcaaataaaaaaacctcccattacacaatcacacaagtgtatgggaggtttttcatgtagtaagcgtaagacagggaaaaaggaggagaaaaatgcagacggcaatgatggtagtaaacacgctaaaggaactgaatataatatcgattagttttcgaattgtattagctgtgatttgtggtggagtgattggtgcggagcgcgggagagcgcatcagccagcgggaatgcgaacctatatgctggtgtgcctcggatcgacacttgttatgtcgacaggacagtatatgtataatacctttgaagcaggagatccggctagacttggcgcacaggtaatcagcggaatcggatttttaggagcaggaagtattattatttccggaaaaacaagagtcagaggattgacaaccgctgctggtttatggacagcagcaagtataggacttgcgctgggaatagggttttatagtgcaggaattctggcgactgcggctgtgtatatgattatgacacgattaaaaaagatggaatatcaaataacatctgatacgttttgctatggtgtttatgtggaatatacaggtgcgagcacgattgcatctataacgcaaaaaatatttgagagaggacttgaaatagaagaggtacagataggaaaacagggaaagaaaacgcagaaggcattgttaattttaaaatgtgtaaagaatgaaacgcgggaaacgatacaaaagatgttcgaagctattgaaggagttacttatttcaaatacttgtattaggtttgtgatttttcataaaaacaggaaactaattttgcgaaaatggtttcttgtgaaggaaaaatcacagtgctacaatgaaggaaacggaaaaagaaaaaatagtttccaacaatcggcgaacaatgaccgggaggctacactggagcagttttttcaacgaaatattctacttcaaaacaaaatatcttaccaggaggcactggatgaggtggtggagattttagtggacggaatttccaagcaccccgatacatttatatcacaaggagaagaggcagatgcccgtgccatttcgagtttcgtaatttaaatacaaggagtgacgactatgattagggagcagtatccattttttcaattagatacagaacataccagctattgctttcgagtgacggaaaccggtcaccttgagcatcttcattatggaagaaaaatcacctcgggagagaatcttacagaatcacttgcgatatttgcagaaaaacatgcttttgcaccggggaataccaatgtatatgacaaagagcatccggaattttccctggaggatatacggcttgagatgtcttcttacggaaagggagatatcagagaaccttttgtggaaatcctgcatggagatggcagctttacttccgattttcgctatgaaaaagcggaaattacgaagggaaaggcggagtttcagacgctgccggggtcttatgatgagaatgatgaagtggagcatttatgtgtgaccttgaaggatgcggcatatggattggtgctggaattacactattatgtatatgagaaatgtgatgtgattgccagaagcgcccggcttttgaacgaaagcgatgagacggtgcagataaagcgtttgatgagtacacagttggactttgatatggaaacgttagtatgcaccacattccatggagcctgggcacgggaaatgaagcgcacggatgtgtgcctgcatggaggaaaatatgtgaacgagtcttataccggcacctcatccagccgcaccaatccttttgtgatgcttgcggaaaccggtacaaatgaggacagcggcgcatgttatggtatcaaccttatatacagcggcaaccattacgaagcgatggaagtaagcggttacggggaaacgcgatttgtggcaggaatcaatccccagtctttttcgtggcagctggaaccgggagcgacttttgaagcaccggaggcagtcatggtatattctccgcttggatataatgggatgagccagtgcatgcatcggtttgtaagagagcatattgtgcgcggaacctggaagaagaaaacacgtcctgtgcttttgaacagctgggaggcatcctattttgatattaatgaacgaaaacttcttgctcttgcaaaagctggcaaggaggcaggaatcgagctgtttgtaatggatgacggctggtttggagagcgaaatgatgataaacattctctgggagactgggatgtaaatccgaaaaaactgccgggtggtttatccggaatctgcgaaaaggtgaaggcacttggcttatcgtttggtatctgggtggagccggagatggtaaatgtagacagcagactttacgaaagacatccggactggaccatcgagattccgggacatgcccattcagaaggacgcaaccagagaatactggatttgacacagactagtgttcaggattttatcattgcgaaaatgagtgaagtattctcatcggcggacatttcttatgtcaagtgggatatgaaccgcacctttacagattattattcccgcgcacttccggcaggacgacagggggaggtggcgcatcgctatgtgatggggctgtatcgctgtatgaaggagctgacagagagatttcctgagattttattcgaagggtgttctgcgggaggtaaccggtttgaccttggaatcttaagctatttcccacaaatctgggcgagtgatgatacggatgctctgtgcagagcagagatacagaatggatatagctatggctatcccatgtcggtagtgagtgcacatgtctcctcctgtccaaatcatcaaaccctgcgggtgacgcccctggaaaccagatttcatgtggctgcctttggactgtgcggctatgagtgtaatcttggtgatatgaaggaagaggagagagccgctgtaaaagcacagattgcgctttacaaggagtggcgggatgtactccaatggggcagcttttatagaggaagaagcttctatgacggtaagggagacgcaagctgtctgatgcaattgccgggaaatcaaatggagtggacctgtgtttcggcggatcagacccgggcagtaggaatgctgatgcagaagctggctgtaccgaatacacagtttcattattacaaacctaagggactggcaccggagtaccggtatcatttctacaatcgtgcactcaaatacaatgtgaaggaattcggagaccttgtgaataccattgcaccggtacatatccggcaggattcactggtgcacaacgtagtagcgaaatttgtgaagttggatggggagacagaagattattatgcatttggagatgcattgatgtatggaggtgtccgtttaaaacaggcatttggtggaaccgggtacaatggagaagtgcggcactttccggactttgcatccaggatgtactttatggagtctgtagaaaaagtacggtaagaggacgacggagggatggtgtgtcaatgattcaattaaaaaccaggtgggcagaaggaataacggcagaaaatgtacagcaggaatatccaagaccgatgcttgtcagagatagcttttttaatctaaatggtgaatgggagtatggaattagtcaaagcgcggaaatagagaagtatgatggaagcatccttgttccgttttcgccggaaaccatgctgtccggggttcagaagcttgtaatgccgacagatttcttgcggaacagcggatcagaaaccagaccaaaccggtagtcagcatggaatataaaaatgcggcaggaggaagggcgctggtacatacatttgtgaatacagagacgaaagaggcaggcgggagaaactgcatgattgcctttcaggatatctataccgtataggaaacggtgcaaacggtcggggtgaacgaatttcagggactcaatgtaccgttaattacgatcgagcaatttctggaaaacggaacgggggcagtggagtgcgacaacatccagggaggatgtctggcggcggaacacctgatcgcccagggatgcagacatctgattcatatcagcggcgtccatgagacggccatgccggcggatgagcgtgcggcgggattctgtgaagtgtgtgtgcagaaaaacgtgcagtatcaggtggtgggaacccatgcctatgagtacaatcatctggaataccacgaagtgctggaacagctgcttttgcagcatccggacacggacggaatctttgccagcagtgacctgattgcggcgcagctgctgcaggtatgcgcgaagcttggcagaaaagtgccagagcagctgaagatcgtgggatttgatgatgtaaatattgcatctttgaccacgccgccgattaccaccatacatcagccgatcaaagagatggcggcgaccgcggtggaactgcttgtgcgcgcaggggagggacaggtggtcccgagccgtaccacactcccggtgtctctggtagtcagaggaacgacagaaaggaagacggagggggaagatgacaaagcattatgatgtgacggcactgggggaagtgctgattgattttacggaaaacggcagcagtgcacaggggaaccccatgtatgaggcgaatccgggcggagcaccctgcaatgtgctggcaatgctgcagaagtttggacataagaccgcgtttttgggcaaggtcggagaggatatcttcgggcggaggcttgaaatcgtgctgaaggaggcgggcattgatactgcgggactctgcatggatccgacggtgcgcacgacgctggcgtttgtggagaaaaaagcggacggagaccgtgatttttctttttaccggaatccgggcgcggatatgatgctgcgtacagaggaactgcaggagcagatcttaaaggacacccgcatatttcattttggcacgctctcgatgacggatgagccggtgcgaagcgccacaagacatgccattgagaccgcaaaggcaaacggggcgatgctctcctttgacccgaacataagagagccgctctggcagtccatggaagaagcgaagagacagaccgcttacgggatggaagtgtgcgatgtgctgaaaatatcggacaacgagatccggtggttcaccggcgaggaggattttgaccgcggagtggatcagctttggcgggaataccacattccactgattctgttgtcgatggggagcgggggaagccgggcatactgcagcagccgcagagccgaacaacctgcatttatacaggcgggcacgatcgagacgaccggagcgggagacacgttcggtgcatgctgcctgcactatattctggaacacggcgtggcgggacttggcacgacggagctggaggagatgctgcgttttgcaaatgcggcggcatcgattgtcacgacacgacgcggagcgctgcgcgtgatgccggaaccggaggaaatacaggcatttcttgtgtaatagggaacttcattcctattacacaaaaaagctccgcggggatgcgcacctcgcggtgaggtaaataatgatttgcataccgcatcaggcagcctgccaaggcaggcgcaagtgtgcggcaagcgcacactttgttccagaaaaaagcatttgagcgacgccgtttcaggtatccctctgcagatattccatcagcttcctggcagcgatgctctccgggcggcttgtatcccggatgagacagatctcacgttccgggatcggttcgaccagacggatgggaagcacttcaccgcgcgcaatcggttcggaggcgagcgcttccgggtagaagccgatgccgagattgtgcgcgaccatgggcagaatctgatcggtcgtggaggcttccatgtccggtgaaaatacaagatgatgacttagaaaatactgggaatacaattctctcgtgccggttccggctccgagagagataaaagggacctccgacaggtcgtgcagactctgcatgcgggaggcaatagcggcataggaagaacctccgatcaggatttcgcgaaaggataaaagcgacgtcctgtgaagaggttttttgatgtcgatcggggtcgtcaccacggaaaaatcgacggtgccgtgcgacagggcacggatggcctgcggtgtggaatgattggaaatctgcaggcgcacatgtggataattgtggtggaaaagctccagtttgttcaaaagaaacaggcgcagagccgtctcgctcgcgccgatggtcacaagaccgctttcgagacttttgtcttttaagatttcctgttccccgagcatcagctgttcgttggcgatagcgacatgggagaagaggcgttccccctccggcgtcaggctgacaccgcggttggtgcgcacaagcagcttgcagccgagctcgctctcgagcagattcatgcagcgggagagattcggctggttgttcccaagaatctcagcagctttggaaaagctttgatattgtgcaacatagtaaaaaatgcggtagtaatccagcgtcatgatccgtgcctccttttgcactcttcgatatatgatattgatatatccaatatataaaatatactttttacatatctgtttccggtcagtataatacagaaggatcaagaaagcaagagagtttggagtgatacaggtgaaaaagggaacgttcacaggctggatgacacaggtacttccggaaaagcagatgtcggaagcgtttatcaacagtattttccttgcaatgtccggaggctttcaggatgcatacacctactttaccagagacaaggtgttctccaacgcgcagacgggcaatgtggtgttgatgagccagcattttatgatgggagagtggaaggacgggctgaagtatctgctgccgcttctggcattcgcgtttggcgtgctggcggcggagcggatacaggcgcagttccgttttgccaggcggctgcactggcggcagggaattctgctgctggaaattgcaatccttctgattgtcggattccttccgcagaccctcaacatgacggcgaccatcctggtgtcgttctcctgtgcgatgcaggtgcaggcattccggaaggtggacggctattcctacgccagcacgatgtgcatcggcaatctgcggagtggtacggcatcgctttccatgtatttcagggagcgccgtcccgagtttttaaagcaggctctttattattttggcatcatcctgtttttcgcactgggcgccggggcaggcggcaacttatcggttcgttacggggtacatgtgatctgggtatcaggcggacttctgatggtgagtgtgctgttaatgttcctggaaaagctgcgcgcatggaacaggtgagaacagacagaaaggggagagtgtgatggcaactatttttccaagggaagaaaaagcggagcagttgtttgagaagattctggaaaatccggatgcgtgtgagagactgaaggatacgttttatgagcattttccggaatcggaggatatggatgcgcagatgccggcggtatcggcgcagacctttacaagggcgttgtttcaggcataccagaacaaggatctgtcggcatttctgatggcgatctgcggaaacagcatgtttgacctgctgcgcaactcttttctgatcccgatccggtttaacgacaagggcaagacaaacccgatttttttgaccgatgaccaaggaatcttaagagagaagcttccggtgaacgtcccggacaaggtttaccagaagttcagcagaatctatcagcacagggagccgatcccacagatgcgggaatatctggcgtacggtttccgcgaggagcaccgctacggcgaggaggatctgtcggtggagagcgtggagatcggaagacatctgggaattctgctgctctatgcaatgccggaacatttgcaggagcatctgacggatgcgcaggtgtatgtccatgtatgggacgcgctgatgcggctgcaggatgtgctgccgcgcgcctttatgtattacgggaaaatgcaggtaaacgggcaggagaccggaagcgaggaactgggaattttccttccactgcgtcattttggcgatgccatggagcgcaacattgagcaggcagacgggattgcgctggggttccgggaagagatggaacgttatgtcagaagtgtctgaaaagggatgagaaaaatgaaaaagagtatgccgcgcattggcatgagaattataaaaacatcgatagcggcttttctgatattgttgatttttactgcggtaggggcaaagcgatcgccgttctacgttctgatcacgacgatcatctgtatccagccggatattgcaaacacaaaggacacggcattcaaccgtgcgatcggaacattgatcggtgcggtcaccggtgcggtggcgatgcttttggaaatgccgctcaagggtctgcccggaggcgaactgtggtgggaccttttaaacgcggtgatgatctgcattaccatttatctgacggtgctgctcggcaaacagtacattgcgttcatggcgtgcgtggcgtatttaagcgttgcggtcatcgcacatgacggagtatcgccgtatgaattcctgttttacagggtggtggataccttcctcggcgtgggaatcggcagcctggttggcagttttcacacacacgggaagaagcgcaacgatgtgctgttcgtggcggagctggatgatgagctgcgcagtgcgcaccggcagatcagcgaatttaacaagacagcattaaatcatatgattgacgagggcgcactttttaccatgattaccagacagacaccggcgtctttgattgcggaggtcgagcacttaaagctgcgcctgccggtgatcgcccttgacggagcggttctgtatgatatttatcagaacaggtatctgcatgcatgcctgatggagcacgatatgggaatccgtatccggcagcttttgacggagcagaaccgcgcatttttcaccaatgtcatcgtggatgacgtgtgggtgatttactataacgatctggtggacgaggaccagaaaggatacttaaagaaactccggacttcgccgtaccgcaactatatgaaacgtgcaccgcacgatgaagatcatattttgtatttcagtgtcctggacacgcacaaccggttgattatgctggagaagcagcttgaggagatgggattcgccgggaagctgaaattcctgttggaggatcacgtattcggggagaagagtcttctcaagattctgtcgattgaggcaagcccgcggaacatgcttgaccggcttatgaagatgctgcatgtgcatcacagcattgtctatggagacaaagactcggagacctgctgcgatgtggcggtggcggacagtgattttaaccggattgtgcagaacatccgcgcagactataccggaagaaaaagaaagacaagagtgtccaagaagctggaggacatccgcaattagaaagagaggcaattattatgttaacatcagtgactggaattaactggggcgatgaaggaaagggaagaatcgtggatcttctcacagaaaaggcggactatgttgtccgctatcagggaggcaataacgccgggcatacggtggtgacggatcagggaaaatttgtgctgaatctgcttccgtccggtatcctgcatccgacggcagtctgtgtgctgggaaacggtatggtgatcgatccggatcatctgcgccatgagattgcaatgatgcagtatatgaaagtaaaagtggatgcgtcgaaccttaagatttcagataaggcgaccatctgcatgccgttccatgtgagacaggatgtgcttgaggaggagcggctttccaagacgggttccgcattcggatcgacccggagaggcatcgcctacgcctacggagataaatatatgaaaaagacgcttcggatgggcgatctgctggaactggatgcgccgtccgtacagcatcgtttaaaagttatcatcgacagcaagaatctggtgctggagaatgtatacaatcaggagccgctctcctatgatgagattatggagtggtgcagaagccaggcagaatttttcaaagattatatctgcgacgtgggaacattgctcggtgctgctgccggtcaagggaaaaatattctgtttgaggcgcagcttggagcgctccgcgatattgattatggcatttatccgtttacatccagctccaatacaatcgcaagctatgccccgatcggtgccggtattccgggatgcgcgctcgacaacgtggtaggcgtcatgaaagcatattccacatgcgtaggcgagggaccgtttgtagcggagacggcgatgggcgaagcctggaatgaaaaattgcgggagagcggcggagagttcggcgcagcaacaggcagaccgcgccgtgtcggaccgtttgacgctgttgcaagccgttacggcatccggtgccagaaggcgcaggatatcgcactgaccaaactggatgtgctcggagcatttgataaaattccggtaattacgggataccgtctgcacggtgtgttgcttgattctttcccgacggacagcagactcgaggaggcagaaccggtgatcgaggaactgccgggctgggaatgcgatatttccggctgcagaagctggaaggatctgccggaaaatgccagaaaatatgtgtgcacactggagaaactcgtggatcatccgatttatctggtatctacgggagcagagagggatgcgtacctgctgcgtgagtgacaagaacgcctgcaaggacattttcaatatccggttttgtttttattacaggggagtgtaatggaaataaacgaaaaggacggggtgacagaaagagtttctgccgccctgtcttttcttatgacagaaaatatgttacattacatatcagtgttagaaacgagagcgataggagcagcggttatgagcagttatctgggatttgtgatcggcggctatcttctgggaagcattttatttgcttatgtgcttccgaagctgacccgccatatcgatatccgggagatgtcggaggacggcaatcccgggacctacaatgcgttctggtacggcggtgtgatctgtggaatctgtgtgctgctgctggaacttttgaagggattttttccggtgtggctgtgcgagcggaccgccggtctgcaatccctgtggtttgcagcagtaatggcagcgcctgtgctgggacatgcctattccatctatcaccgtggacgcggtggcaaggcaatcgcggtatccttcggggttctcttaggactggtgccggcgggaatctggcaaccgttagcgatgctggtgctgttttatctgctgttttcacttttatttaagatcaaaagccatgcgaggcggagcgttgtgacgtatctgtgttttgcagcgggaacctgtctcacggtggaggagcggtcggttctgatcggaagcctgctgattgccggaacggttatttaccggcacacattcggatgcccgggggagggaaaaaatgaacgtattgatcttatcatgtaatacaggcggcggtcacaacgcggcggcacgcgcggctgcggaggctttccgcgcgcacggggacgaggcggtggtcctggattatctcaagcttgcgggagagaaagtctcaaggacggtcggtaacgtctatgtggagacggtaaagattgctcctggtctgttcgggcttttatataagatcggcatgcttgtcagccggcttctccgccgttcgccggtctattatgtcaacgggaagatggcagtctacctggcggcgtatctgaagaaacatccggtggacgtgatcgtcatgccgcatctgtatccggcggaaaccattacctatatgaagcgaaagggtatgaagcttccgctcacggtggcggtgatgacggattatacctgtatcccgttctgggaagagacggactgtgactattatatgattccgcacgagagtctgatcccggagattgtgaagcgcgggatcccggaagagaagctggtggtgacgggtattccggtggcggcagcttgcagtgagccgtggagcggtacgccggaagaaagtgctgcggcggatacacatgagcacagcattgtgcgcaaaaaggcgcagcaggaggcgaaaaaaagtctgggactcgaagaaaaacagcggtatatccttgtggcaggcggcagcatgggagcgggatcgatcgaccggctgattccggcgttgctgaggcgcatacaaagggaggaacacctcattctgatctgcggcagcaatcagaaactagagcagcggatgcaggcacgcttcggcagagatgtgcgcgtgacgattctgggaagcgtcagcgacatgccggtttatctgcgtgcgtgcgatattatctacacaaaacccggtggactcacttccacggaggctgcggtgacggagatacccattgtccacacaaagccgataccgggatgtgagacaaagaatcggagcttttttgtcaaaaagggaatgagcgtgaccgcatacacggaatatggcctggtcagaaaaggaatgcagctgcttcataatcccgggaagagaaacgcgatgcagagggcgcagcaccggggaatggaaaagcacagtgcggaaaagatatatcagtttgtaaaagcaaagatatagcgggagagaggcatagcagatatgcctctttttatttattaaatttttttaaattgatccgtatactcttgtagaacaatggcattaagctggaagaggctgtacgccgggcgataagggaatgcatcacagagggaatcttaacagattttctgcggaagaaccgcgcggaggtggaaatggtgagtattctggaatacgataaggaatatgaggagaagaagctgcggcaggcagaatacgaagcgggagagcaggcaggtttgaaaaagggagagcagattggtatgaaccgcggtcttgcacaggggattgtcgagaccggatgtgcctttggcatgcccaaagagatgatactgaaccgcctgcaggaaaagctgcatatttcggcgcagagagcacaggagtattttgcgatgttttccggtcagcagccggtatagcgatcgcagatagaagaaggggctgccgcatgaagcgggcagccccttttgacgtgataagtaacaggaaaaaggattgtcctgtctctggattaagcggtatattttgcaagggttgccgcaacagcgcctgtgcctgcggtaagctcggtaaagtaatcgcataccagcgtatccatgccgagtgcgcacaggtcaacaccccagatctttgcgttggagaggatcggtgcaagcgttttctttgcgtcgaaagcctcgccgagttttacatcggcaacataggaagacgcttctgcaagcatcgggtccgggcttgggatgaatgcattgccgttgtcgtcaacacccatcaggtagcgcagccatccggcaaatacaagcggaatcagctttaagtcggcaacgttcaaagaaggagctgccgcataggctttgatggtctcgccgaaacggatggccagcttctgggaagtatcggttgcaatacgctgcggtgtgtccggcataaacggattcggaatgcggacatttaacacggtatcgatgaactctttcggatcgagaatgcccggattgatgacaaccggaagtccctctttatatccgatcacttcaacaagcttctttaaagaaggatttttcatctcctcggagattaagttgtagccgagcaggcagccgtaaacagcaagcgcggtgtggagtgggtttaagcaggtgcagaccttcattttctcgactttatcgacggtctcccgtgcggtaaagatcagaccgcccttttccagagccggacgaccgttcgggaagttgtcttcgatgacgagatactggcattcctctgcgttgacaaaaggcgccacataggtgtttttgctggtgacaaccggatccagttcctcgacgccgtccttctttaaaatctcctcgatggaagcgtccgggcgcggggtgatcttatcgatcatcgtccacgggaaagataccttgccggaagtcttcacataagcctcaaatgcctcatcggcaagaccgttctttacccagccttctgcaaatgccgtgatggctgccgcgagcttatctccgttgtgggagcagttatccatgcttaccatggcgatcggcttctcacctgcaaggaaacgtgcatacagaagagatgcgactttcccgatatagctggccggcttttgcggacctgctgccatatctgcggcaactgccggcatgaagctgccgtcagaaccgtagaggttgtaacccttttctgtgatggtaaaagttgccatctgcagggagtctgcggagaaaatctccttcaggcgggagaactgtgcatcgtcctcggaatcgagtgccagagactccatcacactgccgacaacggttttctcaacggtgccgtttgcctttaaagtgacaagaatgctgtagtcgtcatgcggatgattcattttctcgataatttcataatcgtaaccctcggcaacgacaagaccgcggtcaagatctcccttgtttaaaagatcctgtaccacatttgcctggaaggcacggaaaatgttgccggctccgaaatgaatccagaacggattctgctttgttctggcggcaaccgcctctctgtcatactgcggaagtgcgtaaccggcagcttcccatgcgttcttattttctaatcctttgttatttagcttcatagcgtgcagctcctttctcaattgcttcccaaagtccgttcaggtaggtggcgccaagtgcgcggtcataaaggccgtaacccggcatagcgacttcgccccagatcatgcgtccgtgatccggacggatcggaccgtcaaaaccgatctcgtagagggcacgcatgatttcatacatatcaaaagtgccgtctgaggagagatgtgcggcttcttcaaagtctgtcgggctgttgaatttcagattgcgcacatgggcaaaatggattcgcccctttaaggagcggatcatgtccggcagatcattctccagattggttccgtaggaaccggagcagaaagttacgccgttgtgcggattgtcgaccatgctcatcatgcggagaatgtttttcttgttgatgatgatgcgcggaagtccaaatacgctccaggcaggatcgtccggatggattgccatgttaatgtcatacttgtcgcacaccggcatgatgcgctccagaaaatacttcaggttggcaaacagtttttcatcgtcaatgtccttgtacatggcaaaaagctctttgatgtgcgccatgcgctccggctcccagcccggcatgatgctgccgttggtatccccggcgatggactcgaacattttctccggatcgagggcatccacagcctcctgggtgtaagcgaggacggtagaaccgtccggacgttttctggcgagctccgtgcgggtccagtcgaaaacaggcatgaagttgtagcatacgaggtggatatcttcttttccgaggttttccagtgtctcgatgtagtgatcgatgtagagatcacggtccggtgcgccggttttgatggcgtcgtggacgttgacgctctcgataccggcaatatgaagtcctgcagcggcaacttccgcctttaatgcggcgatgcgctctctgctccagacctcacccggtgcggtatcgtagagggtggtgatgactccggtcacgcccggaatctgtctgatctgctctaaggtaacggtgtcgaatttggaaccgtaccatcttaaagtcatttccatagtgtgtaacctccgttcttttctgctccgttaaggaagtgtcatattggatgatttcattatataaaatccgctccaaaagcaaattgaaagacttgttgcatacattgcaaaagttgtcatcttccgttataatcagggaagagtttgaaaaaatataagacgaaaaaggaaagcaacggatcgatggcggcatgaaaggagtgcccgaagaggaaatagcgcatgcagaaaaatttacagaccagattcagcaccagacagtacatgctgtcccgcgattttgaactatattattataatgaacattacacgtcaaaagtggatacgcacacacacgattattatgagttctatttttttatggagggggacgtctcgattgagattgaggggcagagatacccgctccgctatggggatatggtggtaattcctccgcaccgcaggcaccgtgccgttgtgcacaaccatgcgcaggcataccgccggttcgtgttctgggtcagccgggaatatgccagccggctgatggaactttctccggcatacggctacctgatgcagcgcgcggaagtgtccgggaaaaatgtgtttcacagtgatgtgattacatttaacgccacgcagtttaagatttttcagctgattgaggagatgcagatggagcgtttcgggagggaggcgcggataccgttgctggtcaacgatctgatcctgcacctgaaccggatggtgtacgaggaagaaaatcccgccaaggtaaaggagcaggatctctatcagaatctgatctattatatagaggagcatctggaggaggaactgtcgttggaaaaactggcaggagcctttttcgtgagccgctattatgtggcgcacgtctttaaggagcaggcgggaatctcggttcaccagtatatcttaaagaaaaggatgcaggcgtcccgggaggcgattttaggcggtgagaacatcagccaggtgtatgagcggttcgggttccgggactattccagcttttaccgcgcgttccgccgggaatatggcatgtcgccgaaggagtaccgcgaggagcgcctgcggtagccgctgaccgaaaaatggggcatgcctcgggcggttttcacggagcctgccggggagaagtgatctttacgggaatttataacaggcaatcacattccggcgcgaagcagcagggcggagtctgatcacaaaatacggactttctaacccagccgctttcgacaactgcgatgatccgcgtctttccaggattggagcactccgcgaatgtgtccgcaagccgcagacaattttaggacttacgtgcagcactttgcacaccgatgagcaaaacataaccgcgcgagaccgatgtttgagctgctttctgccttgtttttaatagcagaaagcaacgagtttcggctcgcgcggttttatcatgtctgtgaagaggtgtgcttagtgctgctaggaagtccgctcattgtctgcgggtttgtcggacacattcgcggattgttcaagcgtggcaaagacacggaatgaattgccgaaagcggcagggaagaaactcttgcattttgtttcaaagactccgtcccgctgcttcgcgccggaatgatatttcctattataaagcctatttctcccgggcaccggctccgcggaaatcccccggggtcacgccgtattttttccggaattcccggtagaagtaggacaggttgtggaagccggcggacagggaggcgtccagcgggggaagcccgtcctgcccgagcagctcggcagccttctccagacgcaggttcttgatgtaatttaagcaggaggtacccatgaagcgcttgaaaaaacgcatgaaatgatactcactgaaatagcacagggaagccagagcggagatggaaagctcctccgcataatgggcatcaatatactccagaactgtttttaatttggcggtatattccatgtggagccgtgtgtcctcatccgctgcgctgcagcaggggagaagcagggcaatcaggcgcagaaaatcagccttcagcagcagttcatagcccggtgcggcggcgtcgtgcagggcatccatatcgtcgaacagatcgtctaaggcagtgtgcagcggatgaagggcatcaaagaaaaaaggtgggatcagctttgccgtcgcaagcggcgtcagatactgcacggagcagatatctgcggtgcttgcgccgaggaaatgcatgtgaaaaacataagtctcggtgcaaagcgtctctctgggtgtcacggtgattgcgtgcagcagcgtcggagggatgaagatgagatcgcccgcggcaacgtcatagtgctgcagctggatctgataggtgcagctcccggagagaatgcgcgtaaattccgcttcctcgtgccagtgtgcgctgacggacgggtgcagatcgtcgagtgtggtgatatatttttgcagtggaaaaagctgttcaccgtgccgggcgtgttccttttgctccggcgccggaatggatgtcctgttcatgtgcgttcccctgatattaaatagcagtattgtgcaataaaaaagaaaatatagtgcaagatattacggatttctcttattataataacagtatcatacaaaaaggaaaagaaaaaccgtattgggaaaaaggagaatgtgcaatgaagaaaaaatggtggcacgataaagtggcatatcagatttatccgaagagctttctggatacgaacggggacggaatcggggatctgcggggaattatctcgaagctggactatttgaaagagcttggcattgacatcatctggctctctccgatttataaatctccctttgtggatcaggggtatgacatttccgactactacgcgatcgcgcaggaattcggaacgatggaggagtttgacgagctgcttgccgaggcaaaaaagagaggcatgtacattgtgatggatctggtggtgaaccactgttccgaccagcatgaatggttcaaaaaggcgctggcagatccggatggcgaatatgcagattacttctactttgtgaaggaaaaagacggcagggagccgagcaattaccgctcgtattttggcggaaatgcgtgggagccggtgccgggaacggacaaatattacctgcacatgttcgcaaaagagcagccggatttaaactgggaaaatcccgttgtccgtcagaagatctacgatatggtgaactggtggctggcgaagggacttgccggattccgcatcgatgcaatcatcaacatcaaaaaagacacggcattcccgtcattcccgccggatggagacgacggacttgcctcctgtgtgaagatggttgaggaagtgcagggagtcggcgcgcttttagaggacttaaaacatgcaacctttgaaaaatgggatgcatttaccgtggcggaagtttttaacatgaaggaggacgaactgccggagttcatcggggatgacgggcatttttccaccatgtttgatttttccgcacatgagctgacctacggagaacacggctggtatgacagcaaaccaatcgaattcaaaaaatggcgcgatacgctgtttgcatcccagttaaaattgcagaaggcgggatttgcggcgaacattatcgagaatcacgacgagccgcgcggggcgagtcgctatctgccggagcatgcaagaaatgaagccgggaaaaagatgctgggaaccacatccattctgctccgcggcatcccgtttatctatcagggacaggagatcggcatgacaaattgcatccggaacgacatttcggagtatgacgacatcagcacgaaggatcagtatcaggttgccattgacgcgggctgcagcagggaggaggcactgcgctgctgctacgagaacagcagggacaatgccagaacgccgatgcagtggacggatgatgagaatgccggatttacggacggaacgccgtggctggcaatgaatccgaattaccggcagatcaatgtcagggagcaggaggcgcggacggattcggtgcttgcctattaccggagactggtgcatctgcgcaaggcggacgcctaccgggaaacattcacctacggtatcttcgagccggcttaccaggaaatggcggatgtatttgcgtattaccgtgtgtccggggagagtgggcagcgcatactggttgcagcaaactttggaacggatgcggtttccctgacgcttgcctatccgtgcaggcaggtactgctgtcgaatctgagagcagagagcgcggtggagacggcatgtgaaaaagcgaacgcgctgacactcggaagctgtgaagtggcggtaatcgagctgggataggaatccggcgttagtaaccggatcgggatggaagtcagccggcggaagaagtgagccggaataagcgtcagccggcggaagaaatgagccggaaaatgcgtgtggagcggtgcaggaaatttttgcatcgctccattttttatgttatgataagtgcagaaaaacggcggaaacaggcagttttccgtaaaatgaaatgtcgcagcgggcagacagaagcccacacgcaggatgggagattgagatgaaagagagcatagattgtccgaagctcgttgagcagtcgaaaaaggtacagaaggggcagcactggctggtggaattgctggtgtttgtgacggtgtacatcattgcggcatttggagagatgctgattctgctgccgggagagcttgtgctgctgaatacgaacacggcatatcaggatgcggctgcctccggggatatggaacagctgtcggaggtgtcggtgcagattgcgggttcggatgcctacgcggtgttaaagcttttttccggaattgccatgcttctggtggtcgtcttattctgcaggaagttccagaagcgcagctttgagatgatcggttttgtgaaggagcacgcgctgcgggaatatgccattggactgggacttggggtggtatttgcggtagtcacggggggtatcgcggtggcggcgggaaaagcgaagctgtttaccggaacggcgccggggatgctggtgctgtttctcctgggatatctgatccaggggatggcggaggagcttttgtaccgcagttacctgatggtaacgatcgcgcggcgctattcgatgacggtggcggtgcttatcagtgcggtgatcggtgcgcttccgtacgcggcgggagccgtggaggcgccgcttgcatttttaaacggtatgctgttcggtattttcgcggcgctttatctgatccggcgcggaaatatatggggaatcggagcgtttcacgcggcgtggagttttgtgcgtgacattgtttttgggacaccggatcaggtggcgacggcggtagtgctgcttgtcggaatgatacttgttggaggaaaaagaccatgggggaaagcggaatcctgctgctgattttcctgctgcttctcggagcgatactggcggtcagcatcgttttgatccggaaggcggagcgtgagagggatgaggcgttgcagcatgtcgcggatgcaaggacggattttctctcccgcatcagcaatgacatcaagacgccgatgaacgtgatcatgggaatgacggcggtcggacttgaagagtcggatcacccggagaagatggtggaatgtcttggaaaaattgatacggcgagccggtttctgatggggcttttgaatgatctcgtggatgtttccatgattgaactggggagattccggctgcatccgaagccgtatgcgctcgaggattttatggaggcgatccgggatatgacagagccggagtgtgccaaaaaggggatcacatttcacatgtccggcggcgagaacagtctgaatgtcatggtggatccgatccggctggagcagctcttttttaatctgctggggaacgcggtcaagttcactccggaagggggagagatctcttttcgggtatgcaattatgcggttcacagcggtactttttctgcggattatgttgtcgcggacaccggaatcggcatgagcagggagtttcaggaactgctgtttgagccgtttacgcgggaaagacgggatgaggcggaacggcggcacggcagcggactggggctggcaattacacagaatattgtgcagcagcttggcggaagtattgcagtcacgagtgcgatcggcgagggcacgaaggtgaaggtgcatctggatcttccgctcgtggatattcagccgcagaaggaagtggcgagaggcgggggttccagacaggcgtttgccgcgctcggggggaagcgggtgcttctcgcggaggatcatccgctcaatgttgagattacgcggaagcttttggagcgccggggcgtggaagtcgtctgtgcggaagatggacggcaggcgctggagctttttatggagagggaagagcattatttcgatgcggtcctgatggatattgtgatgccgaagatggacggctttgaggcggcaaggcagatcagacgggtgccgcacaaggatgcgcagatgattccgattatcgcaatgagcgcgaaggatgcgcgcgaggatatggatgcctgtaaggaagccggaatgaacgactatcttgcaaagccggtggagccgcagagactgtaccaggtgcttgcggaatatcttgagaatccgatgtgagtttttggacagattgccgaaacggtcagatgtaaaataaaaataaaataaatgacgtgtattgacttttaaaaagaagttgatatattagtgtattagtactaaggatatactaaaaataagcgaaaggaataataatcccatgatgtcacaagagagtatgatgaagaagaaattggaaaacatgcatttaaaggaaaggatagactacggatatagaaaagtcattacaatgatgttgatctctggtctgctttctgttgtaattataggtgtattgtttgccaatatgatgcattatgttgagaatgttaatgtagcagaccaggcagtaaaaatctgcaggattaacgttaatgctgcagcaagaaatatcagagagatggcattaaatgaggatacatcctcttatgataactatgaacaaacagtaaaaagactgctttcagaagttgattctgaactgcagattttaaagaaaacggaagtcctttccgatgaaaattacgaggaatatgcaacggctctttctgactggggaaaaattggttattccattatagaagaaataaaaaacggaaacgatgagaatgccacagatgcaattcttaataattgtaccccggctttaaataaagtagtagaaattgcgataaaattagatgaactgacagatgaggcaagtagcgagacagtcagaaatatggtagtctgtacggttgcaggatttgttgtgattattgtctgcctggtttttgcatttactttgacgcggaaaacaagtaagagagtacttgaaacaattttggagccattacatgcgattgaggacgttgcaatggaattaacagaagggaatctgcacagtacgctggaatatcattccgatgatgagatcggaaaactggcacacagtatgcggaaatcaattcgtatactgggaacctatgtagatgatattgaccgctccatgaagctcttttcagaaggaaattttgatgttcatcctgaggtggagtggagaggtgattttgtcggtattttaaattcgtttatggcatttcaggcaagtatggcaggtacgatcaaaggaatccagaatgtttccaatgaagtttccggcgcagcagagcaggtggcatcaagctccaatgatcttgcagatggagctacaaatcaggctgcggtagtagaggagcttaccgcaactgttacaggtgtttcagaacaggtggaaaaaaattcacagtctgccaaagaaatcagtgtaaaagtggatgaacttggaaatgccatttcagaaagtaatggcaagatgcatgaaatggttgattccatgcatgagatcagcgaggcatcaaaggagattgataagattatcacgacaatcaacgaaattgcatcccagacaaatctgctggcactgaatgcttccattgaggctgcaagagcgggagaggctggaaagggatttgcagttgtggcaaatcaggtaaacgtattggcagatcagagcgcccaggcggcaaaggaatctgcgactctgattgaaacctctgtgaaagctgtggaaaagggaatggtgattgcgggacagactgcggcacaattagaggaggttgctgagaattccaaattaattacgactgaagttacaaatattgcagagacgttggagacacagacgacagaaattaagcagattaatgagggaattgagcagatcaatgatgtcgtacagacaaattctgcaacatcagaggaatgtgcagctgccagccaggagatgagcagtgaggcggaaagtctgcgtgaaatgatccgcaaattcaaagttgcagaagataaaaaaacggtgtaacaggtactgtttttaaaaacatatagaaacaaaaagcgcacccctgcttcttcgtaatggaagaggcaggggtgctggcatgtggaagacatctgctgtcagcccggggacgtgggaatcagtccgttccagaagaacacaggcttttctacggtactcatatgtaagaatcatccggttccgtaagtgttatcgcgttatttgtaagtgatatatgtgcaatatttacaaaaaacagggaaagattgcaaaataattaacatctatagacaaaaaaatgaaaaagtaggataataaaagaaataactatcaggaaggagtcggatgggtatgaaaaatgtgagcgtgcgttggaagatgattattcttgcgctgattacgctgattggaacactggcgatcggagttctggcagtgaaccggatgctggttatggaggagggatcagagagcgttctccgtacaagtattgaagatgattatgatgagaatatcaagaatcaggtggataatgcaatttccatgctggatgcggtgtatgcgggctatgaaaacggcgactattcctatgaggaggccgaaacgcgcggagcggatcttttaagggaactccggtatggagacggtggttatttctgggcggatacctatgacggagacaatgttgttctgctcggaagcgagaccgagggaacaaaccgtatggagacaaaggatgcggaaggttaccagatggtaaaagagattatacgtgtcggacaggagccggacggcggttatacagattatgtattcccgaaggaaggggagacggagtcctctccgaagcgctcctacagcagggcatttgagccgtttggatgggttgttggaacgggcaattatatcgattatattgatgagactgttgccaaagagacacaggcaatgaaggagaatgtaaaaagtgcactgcttgcgattatcggaatgggaagttttctggttgtgattgttatggcggtctgtctttatatggcgttttcactgagcaaatcatttcaggttgcactcacgtacatcggttatattacaaagggtgatttttcgcagccgctgccggtacagcttgagaaccgcagggacgactttggtattctcggcgagcgccttgagaatatgaagtgccagatcagagatcttatcagagaagtgaaaaatgagagttatgtaatcggggaggtcgtcgatacggtcaagacgaatgtgattacgctgaacggcaatatcgaggacgtttccgcaacgacagaggaacttgctgcaagcatggaggagaccgcggcatcctcggatacgattaagagcatgtctcttgagattgaagaggcagcaaaaaatattgcaaatcgttcgcaggatggggcacagcaggcagcagatatacacgagcgggcatcaaaggcacagaacgataccagagaacagcgtgagcatgcgagccggatccacaatgagatacgggagagccttacaaaggcacttgaggctgcaaaggtagttcagcagatcgaagtgttatcatcggcgatcatggagattacaaaccagacaaacctgcttgcgttaaatgcttcgattgaagcagcacgcgccggggaggcaggcaaaggatttgccgttgtggcaacagaaattggcggacttgcagatcagtccaagcagactgttacccagatacagaaggtgacggaggaagttacgacttctgtcgcacagctttcttccgatgcggagcagctgcttgcatttgtgggaaatgatgtcgtggcaagctatgacatgttcgatgcggtggctgatgcatacaaccaggatgcaggaaagattgatgcactgatcagcgatttcagcgcgacatcggaggaactgctggcatcaatcgatggagtgctggatgcgatggagggaattgcaacggcaacgaacgaaggtgcaaaaggaacgacagatattgcacaaaagaccgtggaagtcaaatccgaggcggatacggtcacagatgaagttggcagatgcgatcagacggcacagcgtctgacacaggatatctcagtctttgttgtggattagaaaacagttcattttatgggaaagatatgatataattcattttagcgacatcggagcataggaaaggatacttataagatggacgagaaaatgacaatggagatcaccaacgatagattagaggaagcgattaagcagtatgcggcggagcgcaccaaggagaaccttaccacggtgttaaacctgcttcgtccgaccaagctgtatgtgccggcaatgcttaaggcgccggatcagccgaccccgtgtttcctcaagaacaacaagggcgagcagttttttgtggcatatacttccaaggagcagatgccggaggagccgaagagccaggcacttcttttcatgccgttcccggcgtgcaacaacatcgtcgtgaagccggaactggagctgaccgggctggtcatcaatccgttctcggataaccttgtattaaagaccgaacttgtacggaagctgcatgaggcagatcagaaggcggcacagatgcggcaggtgaagatgacaccgcagcagtttaacgtgtttgtgaaaaagcaggtggagtttggagttctgccgaagcgcctgtatgcagagggagagacgtttgtccggaagctctgtgaggagcgcgaggcgttcgtgaaccagatttttgccgagacgtataaggagccgaagctctatccgtacacagaggcagactattcggttatggcgcttgacattgcggaggatctgacactgatccgcgtggatctgccggagaaagcactggcagccccgctttgctatcgtatctatattacgtttaatccgcagacgaagaaagcgggttactacacgattgagatgacggcggagaaggaagtgcgcgcattgggacagatcctgccggatggcaggcatgagagtctgggcgaggcgccggttgagggagcggagcttcagaagatcatggatctggcacgttatgacggcacagagatgacaagctaaggcataccgaagcgaaggcatatatgtcatatcgaaacgaaggcatacataaagatacaataagagacgcatgtccggcgggaaccgaggtgcgtctttttatggagaaggaagcgcattatttcgatgcgatcctgatggatattgtgatgccgaagatggacggctttgaggcggcaaggcagatccgacgggtgtcgcacaaggatgcgtagatgattccgattattgcgatgagtgcaaaagatgcacgcgaggatatggatgcctgtaaggaagccggaatgaacgactatcttgcaaagccggtagagccgcagcggttatatcaggtgctggcggaataccttgagaatccgatgtgagttttttgacaaaacgctgaaattgtcaaatgcaaaatctgaaattcggttgcgtttcctttttgacatagttataataatgtcagaaagaaattacacggtattttgcatacaattctatagtgtgagccaagagtgaaagagcaggccgggaataacagaaatgttactctgtcggtgtgctttttttcataggaaattacgccctatgaagaaataaagaatgtgcagcttgcgggattttttgacttccgctatgggaaatatcattatggaaatgatgcgccaggaatgccatgatgcggcaggggagaatggggggagtgcagacaaaagatgaagcagcaattttatgacgcgattgtggacggaccgattatcgcggcggtgaaggacgagacgggggtggaggtctgtatacagaatgatatccgcgtggtattcattttgtatggagagttgattaccatcccggatattgtgcagcggttaaaagatgccggaaagtttgtcattgtacatctggatctgatcggggggcttgcggtcagggaggaagcggtgcgttttatacggtatgggacggcggcggacggtattatttccacaaagccggaaatgatccgttatgcgaaggagctggatctctgtacggtatttcgcatatttgcgattgattccaaggcgattggaggactggaacaccacggtatggagtttgcagatctaatcgaggtgctgccgggcattatgcctaaaatcataaagcatatagcagggcaggcagcagtaccggtgatcgcaggaggtctgatctcggagaaggaggacgtcatgcgggcactggatgcgggagcgattgcgatttcaacgacaaaccaggcagtgtggaaaatgtaacggatacagtgcatcaggagaagggggtacgggtatgtgttattcaactaagaaaaaaattgcggattgtgtcaggcagctgatgaagcgcaaggagatatccaaaattacgatcggggacatcatggaggcaacggggatgagccgccagagtttttattatcattttaaggatatttatgatgtgctggagtggatcggctgtaatgactttaaggatcagctgcagggacagtatgacagtatggaaaagtgggcatgcgatctgatggaggtgctgcagagggagcgcagcttttatgagaagctggcgaacgagctcgcgtggccgatgatcgtgcgtggtgtacgcatggcgttggatgcgcaggtgcgccgtctgctgcttggcgagaatccgggcatgtttgaaaagcatcctgaggaactggaggcggtgacgagctttctttccacatccatctgctactatatgattgattttgtatattacagaaaaacgttatcgggggaacaggtaaagcgggatgtgcagtttatgatgcgggcgattgcaaaaacggacgcggggcttgccgtattgctcccgcgcaccgcagtattgtaatgctattctgacaaaattaaaaagtaccggtaagctggtctggcttaccggtacttttttacttttgcagctgcatctgcggttctaagagagaacttctttggtggcgatcaggtcgacgccggttcctgcaatatctttcagcaggacatctccgatgtgtaccggagccgtcaccgtcagcgcgttgatatatttcatgatctcgaagatcttttctttgggaatatcctgtgcggtcttgacggataccatcgggatggagccgccgcggacacagacggtgcttgtgacgatgcgcgtcggatgtgtgacttcctttgcggcatagtcagagccgcgcttgcaggtatttccggtgatggagacaacatttccgccatccatggtaactgtgatggcacagcccagcgggcagccgatgcatgtaagatttcttgtttccatgtgttacgcctcctcttctattttgatggtaatgtgatccaggtcactcattgcttccagaacggacttctgcagctttacctgctccatctcgccgggagccatgacaggacgcttgcggcagataatccgctggtcgtttaagtaggtggaaatataacagttcttgtatacaccgccgacgcggaaacgcacggtcagctcgtcgtccatattggcgacatgcagcgtttttggaacggtatagcggacgccgtcggttgcgacgatggggatctctttgccggaatcagcatgatcgcccccgcacttgatatattttgcggcgttctttccggcaacgccggcttcctcggatacatagtccacgagatcatgaacgtgaagaacattaccgcaggcgaaaacgcccggaatatttgtctcaaggctttcgttgacagaaggaccggaggtgaccggatttagctcgacgcccatagagcgggaaatctcattttccggaatcagaccgcaggagagcagcagtgtgtcgcattcgtagtcttcctccgtgccgggaatcggcttgttgtgttcatccacctgtgccagtgtgattccctccacgcgctctttgccgcggatgtcaacgacagtatggctcagctttaacggaataccgaaatcgtccagacactgtacaatgtttcgtttcagaccgccggaataaggcatcagctcggcgacgactttgacttcggcgccctctaaggtcatacggcgtgccatgatgaggccgatgtctccggagccgaggatcacaaccttgcgtcccggcataaagccctcgatgttcaccaggcgctgcgcggttccggcagagtagatgcctgcaggacggtagcccgggatatttaaagctccgcgggaacgctcgcggcagcccatggcaagaatcacggtctttgcgttaatgtggaacagcccgtcggtgcggttcatagccgtcacgatcttatcggaagagccttctgccagagaaatatccatcaccatcgtgttcagacggtattcgatgttcagatcgagagcctgattgataaagcgtctggcatattccgggccggtcagctcctccttaaaggtgtgaagaccgaaaccgttgtggatgcactgatttaagatgccgccgagttcgcggtcgcgctcgagaatcaggatccggtcgatgccgttatttttggcggaaacggctgccgcaagaccggcgggacctccgccgacgatcacaatatcatatgaagtcataataatcctcctttttccttcaggttctgtctttgctcagaccgacgaccatgttggatgagccgccgtttttcgtgatttcaagctgggagataccaagctcacgcgccaggatttccatggtgcgcggcgagcagaaacctgcctggcagcgtcccatgcctgcacgggtacggcgcttgacgccgtctaatgaccgtgcgccaagcggacggtgaatggcgtctaagatttctccctcggtaatcatctcacagcggcagataatatttccgtaagctggattttcgcggataagcgccgcataatcttcctcggagagtgttttcggattgagaacgccctttcggctgccgttccatgccgggtttttctgtgcgtgaagcagcccggatacaatctgcgctacgcgctcgccgatcgccggggaactggtgagtcccggagattcgatgccggagcagtcgacaaagtgtggagcatccgccaactcttcaataatgaattcatggttgtcctcatgggcgcggtttccggcgaaggacgtgattacctgacggaccggaacggaaggcacggagcgtcttgctgcgctgcagacatggtcaagtccctggcgggtggtgttggttgcctccttatcgtcgtgatcgtctgcggtagggccgatcagcgtattgccgtgaaccgtcggggttacaagaatgcccttgccgtatttgcccggaagctggaagatggtcttgtcgaccagaccgccggttgttttgtcgagcaggcagtattcgccgcggcgcggggtaatgtggatcttcttgctgctgaccatgttgtgaaaaacatctgcatacacaccggcagcgtttaccacgcagcgggtcaggatgtaaccgcggttggtggagagttgatagccgtcgtccttgcggcagatgtctgtcacttctgtgttaaaacggaattcgacgccgtttgtggcagcattttctgcgagtgcaatgttcaaaccgaacgggcagacaatgccgccggtcggacagtagatggcagcgacgacttcctcggagaggttcggctccatctcatgaacttcgtgtgcatctaagatccggatatccgggattttgttggaaatgccctgctcgtagagggcttccagcttcgggcggtcctcctcggagaagcagacgatcagggaaccgtttctgcggaattcaaaatccagctctttggagagcggttccatcagttcatttccccggacgttcatctctgacatcagggttccgggtttacagtcgataccggagtggacgatggcgctgttggctttggaagtgccgcagcagacgtcctcctctttttccacaacacaaatggagagattgtatctggaaagttcacgtgcacaggcgcttccagagacgccggcaccaatgatcactacatcatacatagtttttcctccttaaaagagccatgcagatcatacatcatttctgatgtgttttctgcctggctctcttctctgacattcaatctatagttttaaaaaataagtccatataccagtacggcagccaatgcgccgaggatcggtccgacgatcggaacaacgagtccgtatccgaaatcagaggaaccttttccctgaatcggaagcactgcatgtgcaagacgaggacccagatctcttgccggattgattgcatatccggtcagaccgcccagagacataccgacagatacgataatggcgaatacgagaaattttccggtgccgtccgccagatccggaacctgtgccagacccttgatggcaaatacgagtacaaaagtgccgacagcctcgcttaagatattgcgcgggatgttgcgcactgcaggtgccgtacagaacacgccgcgcttcgttgccgcgtcttctgttgcgtcaaactgatctttgaacagcagatatacaaggcatgcgccgcagaaagcaccagccagctgtgccacaatatatcccggtaccatgctccatgcaaaactgccgtcagcagcaagcgcgatggtcaatgcagggttaaagcttgcgccggatgccgcgccgaagataaaggcgggaaccagtacggcaagaccccaggcaagtgtgatctggactgcaccggcacctttcatgccggatttgttcaggttgacattggcaacaacaccgtcacctaacaggatgaggatcatggtgccgacaaactctgcaatatatggtgtcataataaataccccctcttagatattaaattgtgtgttagtcttccttcgcccagttgaacgaataagtaacggctttcttccacatgcggactttcttgttacgctcctcgtcggtgatctccggtgtgaaggtgcggtcgattgcccagttctgaagaacatcctctttgcttgcccagtagccgactgccagtccggcgagataggcagcacccatggctgtggtctccacgcacatcggacggttgaccggagcattgctgatgtccgcctgcatctgcatgagcagattgtttgcgcttgctccgccgtctacctttaatgctgcaagatcaataccggaatctgctttcattgcagccaatacatcattaacctggtaagcgagagactctaaggttgcacggataatatggtatttattcacaccgcgggtaatgcctacgatagttccacgtgcgtattgatcccagtacggggcaccaagaccggtgaaagcaggcacgacgtagcagccgttggtgtctttgacttttcttgccatgtattcggaatccggagaggaatcgatgaagcgcatctcatcgcgaagccactggatggaggcacctgcaacgaagatggaaccctcgagtgcgtagtttacttttccgtcgagaccccatgcgatcgtggtaaccagtccgttcttggagaatacaggtttttcgccggtgttcataagtaagaaacagccggttccgtaagtattttttgcctcaccggcggtgaaacaggtctgaccgaacagagcggcctgttggtcaccggcagcaccggcaatcggaatcgggcctccgaagaataccgggtttgcttcgccgtacacgcagctggatggcttcggttccggcagcatacattttggaatattcagttcttttaaaatatcttcatcccactccagggtattgatgttgaacatcaaggttctggaagcgttggagtaatcagttacgtgaacctgaccctgtgtcagtttccagatcagccatgtctccacggttccgaagagcagctcgcctctctcggctctctctctggcgccttcaacgttgtcgagcagccattttaatttcgttccggagaagtaggcgtcgatcaccagtcctgtcttctggcggaaggtatcaaccagtcccttggcttttaaggaatcgcagtattcggaagtacggcggcactgccatacgatcgcgtgatgaatcggttcgccggtgttcttatcccatacgatggtggtctcgcgctgattggtaattccgattgccccgatatcggctgcagtcgcgcccacatttgccattgcctccttggcaacttcaagctgtgtggaccagatctcctccgcgtcgtgctctacccagcccggcttcgggaaatactgtgtaaattctttctgggcaacgctgcacatttcacccttctcattgaaaagtatgcagcggttgctggtggttccggcatcgagtgccatgatgtactttgccatgtaaagtccctccattttcttagtgtggaaaccggccccacccggttcccctctggttgtatgagtggcggtctgatgtgccgctcaccgtttgtggctttagtgtaactgcgttgcgggtgaatgtctttagacagacttctgtgattgtaaaagaggagtcctgcgtttttacatatatgcaatattgacaaaaaacatgaatagattgctaaattattaacaaatatagacgattagtggggaatatacgataataaaagaagtaagcacaggaaggagtcggataggtatgaaaaatgtgagtgtacgttagaagatgattattcctatgaggaagcggaaacacgcggtgcagatctgctgcgggaactcaggtacggggacggcggatacttctgggcagatacctatgatggagagaatgtggttctgcttggaagcgcgacggaagggacgaaccgcatggagacgaaggatgcggatggttaccagatggtaaaagagattatccgcgtcgggcaggaaccggacggcggatatacggattatgtattcccgaaagaaggtgagacggaatcttctccgaagagatcctacagcagggcatttgagcggtttggctgggttgtcggaacgggaaactatattgactatatcgatgagactgttgagaaagaaacgcaggcaatgcgggagaatgtaaaaacggcactgatcgcgattatcggaacgggcagtctgctgattgtgattgtcatggcggtctgtctgtatatggcgttttcactgagcagatcttttcaggttgcccagatacagaaggtgacggaggaagttacatcttctgtggcacagctttcttctgatgcggagcagctgctcgcctttgttggaaatgatgtggtggcgagctatgatacgtttgatgaggcggcagacgcttataaccaggatgccggaaagatcgatgcactgatcagcgatttcagcgcgacatccgaggagcttctggcatcgattgatggcgtgctggatgcgatggagggaatggcaacggcaacgaacgaaggtgccaagggaacgatcgatattgcacagaagaccgtagaagtgaaatccaaggcagatacgtgatctgctccacatcttagaggagatggaagaagaacttactcatgccggatgacgtcggcatactggccgcgcaccacggtaagcagggaatccggattgaccgtgatggaggtgccgatgcgtccgccgctgatgtagatcttgtcaaaagccgcagcgctctcgtgcacgatggtcgggaactgctttttcatgcccagaggagagcagccgccgcggacataacccgtgatggcagtgatgtctttgacgtgaatcatctctacggatttttcgccgacggctctggcggcggcttttaagtccacctcgtccgcgatgggaataacgaatacatagtattgcctgctttttccctgcatcaccagagtcttgaaggactgttccaccggggcgccggtcgcctcggcggtgtgcagtccgtcgataaattctccacactcataatttaaaatttcgtacggaatcttatttttatcaagaatgcgcatagcattcgtctttacttcttttcccataaaatattcactcctttgtttctttccggaaaatatgtcctgtgaaggaaaaacgctccgcgtggattgcactgcggcgggacatatgattcattgtgcccatagtctagtggaattgtgaaaaaaagtcaagcgggacagatcgggctgaatgggaatagacaaagccgccgcattgtttcttgaaactgtggattgaatagagtataatgcagaaaaagtgacagagaggtatgtgatatgaaagaaacattaaagcggatcaaggcagacatcatagtctcggcgctgctttgcattgcacttggcattgtgcttctggtatggccggctgagacgatcgatgtattctgtaaaatccttgccgttggattgatcattatgggaggcgtcgacatcgcatcctattttatgaaccgcagtattcatccgtttgcgggagcattgggactgattgtattgttaatcggaatctggattttcctgcgcccggagagcattgtgagcctgatcccgattgtgatcggcgtgatcctctgcgtacatggaatccaggatctgaagcttgcgatagaaacgaagcgcaacggttatgagaaatggtggagcatgttaatcattgcagcggtcagcctggtgttcggtgtgctctgtatcgtgaatgcgttcggcatggtaaagctggcactgcagtttatcggaattgccctgatctatgacggtatctcggatctgtgggtggcaaaccgcgccgtgcatgcggcaaagatgatgaagcaggaagcggaagccgtggatgtagactataaagagatataagatagcgtctcttccacgtttggacaatccaacgggtgcatgtccggcacaccggagacaatgggcggactttttagatttgttaagagatgtcaacacaatttttaattttttttgcataagaaataggcctgattattcaggcttttttcttatgcaactatgctatattcttatatatttccatcactcttgcataatagatttgcaaaaacttatttaaaccggctattttggcttgtttcctactttttccttcattctcttttttaattataaaactcaaacttcgcacataaattttagctatgcacattgaaaattcaatatctggcagttattcagttgtcagtgttcagcctttatgcagcctgcagtcgtattttcatcatagtaggaagtgcatccataaatgcattcgccaattcattgattttttcgtctgaaagttcagtgttatctgaaagcattgttctgaacatttgaagcagcatttgaaaagcctgtatccatgtgatatcagacatttcgtcagaaaagtataaaaagagctccccaagtgaccggttatcattggattcccggctttccagtgacagcatcctatatcgggtgaaaacaactgcggtatgcgcagtcattgcatcataggacagagaattacattctctgctcaagttaaggtagcttttgcaaaattaggtgtgttttttcctgtaagcagactcatatacatacttctgttggagaaaatcagcagaaacatgtattgaaaaatctccgttaccggagtgcctttccttttataggcattggcagctttcaaggctgaggaaatatgaaaccttgtaaaaaatcgtttgatagatttagaaatctgcttatcattttgaggcgcttgtgttatacttttattcatagcatgagtctccggtttgtaattgtttttttggcaactcaattataccaaaaccattggtttcatgctatttttatgccagttattattgaattttcaaggtgcataggcacattttaatgtgcgaagtttgagtaatttaatactttagtaatagatttttccaataaagtatgctatcttagtacgatatatggatagatatacgtgataaaaagaacaataatttacaaaggaagggaaaactatcatggaaaagatcaaaaagcgtataactaacttaaaggttgcaggaaaattaaaagtatatcgaatgacagtgcttgttatgacattatttttagtattggtggcactgatctcgacattagtgatccgtttaaatatagagaagatcacggaggtctggtctccgtcattggaatatctgcaggatttagagacaatgactgcgaaatacagaatcaaacagtatcagcatctggtagaatcagatgcagcagtcatgaactcctgcgaagaagaaatcacgaagctggagagtcagattgaggataccggtgcgaagctggatgcaataatttctgcagacagcaaagctcaaaaaggacgggatgattatgatgtagcaaacgctgcatgggaaaaatacagggctgcttcagatgaaattctgcagttgagccgtgaaggtaaacagcaggaagcatcgaagctgatgaccggagaggtgtatgaagaatataaggcttttgctgagaaattaactacattatgtgaaaagttccaggtagaattagatcaggcaaagaccatggctaatgtatgcactgtaatcatatttattgtgatcgtggcagcgggtcttgcgattgctgtagtgacgacactgatcggagggatcattaccaattccattacagagccggtagaacagatagaggcagcagttgccagcctgcgtaagggcgaactgtctaatgtagaaatgcttacctatgagtctgaggatgagtttggcgataccatcaggaatctgaaagaagccatgggtattctggcagattatgtcagcgagatctctgtggaggtaaaggcaatagcgcagggtgacctgaccagaaatggtgatgatattacagatttcctaggcgatttctcggaattgaagacatcactgctgtatattctgaaacggtttaacagtaccctgaccgagatcagcaatctggcagaacaggtatcatcgaattcatccgaggtggaaaatgcatcaaaatccctggcggacggtgcaacagagcaggcaggagtcatcgaggaattgaatgccaccattgatgcggtcgtggatctggcagaagatacagcgaaggaaacacagagcgcatctgcacgtgtaaaagcctctgcaaataaagcgaacgaagaaaaagaaaaaatgaatgagctgctcacggaaatggagtacattacagaaatctccaaggagatcggtaatattatcacagatatcgaggatattgcatcccagaccaacctgttatccctgaatgcttccattgaagctgccagagcaggagaagctggaagaggttttgcggtggttgcagatcagatcggcaagctggcagcagacagtgcaaaatccgctgtaaatacgagagagctgatcgataagaccttagtggaaatcgaaaagggcaatacgattacaagaacaacagcagaatcattcaatcagatcattgaagatatgaagtcctttgcagagcttgcagagaacaccatggagaaagccaactcccaggcagagtccttggagcagatcggtcagggaattgaacagctgtccggcgtagtacagggcaatgctgcatcctccgaagagaatactgcgatcagtattaatctggcagagggagcagccaagatgcatgaccgcgtgaatatctttaagctattctagaaaaatggcaggaatagagtgaagctgtcgtaaggaaggttcttgttgtgattaatgatatatttaaagtgtttggagagcagacagcagaaatcttatttgagatcgttacggaatgtatggatgattatctgtatatatttgatctgcaggataatacctttgagatttcacagtcagctgtgaatcggtttaatatgtcggaaagtgttctgacagatgctgtaaatgaagttatgaaggtagtatatgaggaagaccgcaggatgcttgcaaagcatcttgctgatatatgcgaaggaagagaaaaggtacataatcttcattacaggtggcttgataaagaaggtatgccggtctggattaactgccgtggtatcgtgatcagtgatcagcagggaaaggcagagtatctggtcgggtgtctgaatgagaccggcaacaagagaagagccgataatgtcacaggactgcttggcggtccggaattccttgcttacctgtgtgcacaaaaagaacccattaccaagggattttttatgcatgtaggaattgatgattttggagcgatcaatagctccagaggagctgattatggtaattatatcctgaaaagcgtagccggctgtatgaaggaatgcctttcagacaagcagagaatttaccatctggtagcggatcagtatgtgatcgtggatctggaagcttcctccgcagaagacgctgtggcactgaaagaaaagattacagataaacttcaaaatttcatagtagccgaaaattatgaagctatattttctatttctattggtgttatagatgcagcaacattttgtgagggaaccgaagaatgccgcaaaaagtttgaatttgccttgaaacaggcaaaaggcatgggtaaaaatggattctatttttttgacaaggatgactatgaggtctttttacgaaaaggaagaatcatagcaacacttcgtaatgctattgtgaaccattatgatggctttgaagtatactaccagccgatcgtggactgtcagtccgaacagatcattggagcagaggcactgatgcgtttttccatgataacggaagaagggcgggagtttgtttcaccgatggagtttatcccattattggaagagaccggattgatcattcccgctggaagatatattttgaacgaagctgcagcaatgtgctgtgaaatgcagaaatatattcctgacttccggatgaatgtaaatgtatcctatgttcagatactgcaaggcaatgtggagcgggatattctggatgcaattcaaaaatattcattacagccggaatgcttatgtgttgaaatgacagaaagcggatttatggatatgacaccttcgttctgcaaatttcgtaaaattctggacaagaacgggattccctttgtgatcgatgattttggaacaggatattcgaatcttcattgtatccgtgatatgaatccaagttacgtgaaaatggatagggattttactgccaaggcgatgaacagtgacagggattatgaattatataaaaatatcatccccatggtacatagtattaacgtcaggatatgcgcagaaggcatcgaggaaaaagaatggcttctgaaaatgaaagaaatgaaggttgattatctgcagggatattattttggaagaccatgtggaaagaaacagtttctgcagcaatatgtcagtggcatcaacgttaaataaagagagtaaggcagactcagctatgcggggctgccttattttatggtcttatcagaaggatggatccataacggcttctttcagtttttccaggtcattggcatcagggtgagacaatgcacagtcaaaattctggatcaatacatcaagatttgccggatgagcaggagcttccttcattttcaagtagcgttcccagacagactgcggcattctgccctgacacatatactctccgacgataacattgcttgcgtcaatgatagagcagttcggaagaagggatcactgtgtcggacacaccgaaatactcacattcatcctgaggtaatgccccgtggattgcatcagccagcatcttggtattacctgttaaactgctataaacgatggaatattttttattcatcgtggatgcaaacatccggctggttagaaatgccacattttatgaaccgaatatccagctgtatttccagctgaaatcccacgatgtgtgcttccaataatattacttatcactgaaaggcagacgtgtacctggtgcggattttcaccccgcaatctttccgtcctctatgagggacagaaacaccggcaccagttcgggatcgaactgcgtgccgctgttctttttcagttcacctgccgcgtagtcgatcgagcgttcctgcttgtaggggcgtctggccgtcatcgcgtcaaagcagtctgcaatggttaagatacgtcccatgaggggaatttccgttccttttaatccgcggggataaccggttccgtcatagcgctcgtggtgggcgacaactgccgggatcacgtaatccatgttcggaaggtaacggatcatcttaatggaattctccacatgcgttttcatgatcgtgtattcctccggcgtcagccccgaggttttctttaagatatgctcagggatgctgatcttgccgatgtcgtgaagcatgcctgcaatccgtaccacctcgatatcattgtcgctcataggaagcgcttctgcgagcatgaccgcatattttgagacattcatggaatggatgaacgtaaaattatccttggcgtcgatggcggcggtcagcgcatagatggtcggcgccacccgctcgtaggcggtgcggatatccggattctgggagcggttctcaagacctttgcggtaaacgatgagatggccttttccgtcaagctttccaaaatagacagcctgctcgacattgtggattaactctctgccgtcgacagaaatatccggaaacacggagatgccgcaggtgatggtaatttcccacaccatgtctgacatgctgccttttgtcagaacctccacgagagactgggtaaacgctttggaggctgcgacgtcactgccgtgtcttaagatgagaaattcgtccgcactgaaacgaaatgccatgtcgtccgcatccagagcagagagaatgatcttggcacagcgctggattaagtgatcgccctccttggagccgtaaagttcattgtaaagcttaaaatcatcgatatcgagcatgattaatgagcacggcgtaccggagaggcagagttcatcaattatctcaaacgcatgcttgcggttgtagagtgccgtcagatcatccgtgatggaggctcggtaggcattcatgtagagattcgcgttgcgcagtgcgtgggtggcataaaaaccgatcttgcacagcgcggacacctgatctgcggacagaggcatgtgattgtgccgcgcgatgaagagaaagccaatcagcgcccggttgtacttcagacaatagacgccgatgatattctgctggatcagccagctgcgcgtatggctggaaatgccgtcaagcgcagctggcaggcctgcgcccggcataaacggaatgtagctgtctgcgttcaaaagctgttccaaaagaatgcttgaatcgagaaaagaatctttttcccaggtgatatcgccaaaactgcgtgtgacgtggtaggaaggactgacatcgtcacggatcgtgagcagcagaccgtccggagacagcagacggacggctgtgtctataatagaatcaaagatttcgtccgggtgaatcgtgctgatgacggatgacaggaattgatcgatgagaacagtttgatcgctcataaggctcctttgtatatgataaatgaaaacatcttgagaattcagaatcattatactataatgaaaaatgcatggcaatagtgggaaatacatagaaaagccatagaaacagggatattttcatgcgtagagaagagtttaaaatggagcgcaccggactgcttgagatcggcgatgtgcttccgattacagaggggaagctgcccaattcctattactatacactgggcaaggcgtacgcgatgtcggcgaactatgtggtaagccagcgcatcaagtcgcgggaaggcacagtggtagacgtcaaagagaccccgaagggatattttgttacggttgaatttgatgagtaaaagcgctaaaataataataatttagcggaaaggaagcacaaatgcgttatttaccgacgagcagactgacgccgggaatggcactggggcaggacatttatgacggggcgggaagacttcttctgggaaggcatattctgctgacagaagaacaaatttcaaatctggaattccttgggttcccgggtgtctatgtggacgatgagttttcccgggggattgagatacagcagattgtcagcccggaagtccggaggcaggcactgaaaattgtatatgatctgtttcacacggatatgcggaagcaggaaccgtcggaagcggagtttaagctgcgcaaaacggtggagtctgtggtcgatgatgtgatatgcaatggagacatcatgtgcaatatcatggacatcaagagttatgatgattatatctattaccattccattcatgtgggcatcctttctgtggtagtcggcgcacggctggggcttccgcatgatgagctgtgccagcttgcagcggcggcgctgctgcatgacattgggaagcggtttatcgatcatgacatcgtgcggggaggtaaggcgcaccgcagcgaaaaagagcaggaggtctatcggagccatccgaagatcggtgcggaatatctgcgcgagacatgccgattttccgcggatgtgtatgagggaatcatggagcatcacgagtgctacaacggcgaagggtatccgcttggcaaaaagggcggcgagattcacctgtttgcccgcattatccggattgcagactgttatgacgcaaaggtttccgcgtttccggcacagaaatcactgtcgccgtcggaggcgttagaatatgtgatggcgctgggcgaccgctggtttgacccggatattgtggctgtgttcgcaaggaaagtggcggcgtatccgatcggctgcgaagtcgaactgtccaacgggcagcatgcggtggtggcacggaattttgagaatttcccgctgcgtccgctggtgcgcgttgtggagacgggagagatgttgaacatgcgtgacgatgaaaaagcgagggcggtaactgttgggagactcatagtgcgatagagcacctggggcgagagggagttatgactggacagggaaagagtgcgattgatacacttttggcagagagctttaaggaactggcgttaaagcagccaatagagaagattacaatcaaagagattacagataaggcgggcgtgatccgcccgacattttacaatcattttcaggacaaatatgatctgctggagtggattatcgacagggaactgctggaaccggtggaaccgctgatccagaacgggatgatcaacgaggcgctggtgcttctgttcagcgggatcgagcgtgagaaggagttctacacgaaggcaagccggctggaaggacagaattcattcggcagcattgcacaaagctgtgtggagcgcgtgctgctacaggtcatcaaaggacaggcagagggcagaaaaagccggtacgtgtggctgacaccagagcgtatcgcggagtattatgcacagtccatgtgctatgtggtgatcacctggatcaagtccggaatgacgatatcgtccagggaacttgcagaaatctataattacatgatcaagcggtcgatgacggatattctgacagaactgtaattgcggacagaatacaaatgaatataaatgtatagatagttatacatttcgggtcgagtgtataataacccgatacacggagaaaagattgaatattttcatattcagtcttttttttatacaatgcttttatggaaaggagagagggaccatgattaaatttggaaaagcggtcgtcaagctgcgaataccgattttgattctcagtattttcttattgataccgtcggcaatcggatattttaacacgagagtgaattatgatatcctgacatatctgccggaagagattgagacgatgaaggggcaggatctcctgcttgacgagtttggaacgggagcattctcgttttgtgtagtggagggtatggacgcgaaggacatatctgcaatgcgggagcagatggaggaagttcctcacgtaaaatcagtgatctggtacgattcactggcggacatcagcattccgatggagatgctgccggatgagatctatgatttctttaataatgatgagaaggacagcaccttgctcgcagtgttatacgatacatcgatgtccgcggacgagacgatggatgcgattgaggaactgcgcggtgtggtaaaagatcagtgctatatcagcggtatgtcggcagtggttacagatatcaagaatctgtcgaacaaggagaccccggtctatgtgctgattgcggttgtactggcagtcattgtcctgtcacttacgatggattcggctctggcgccgattttctttttgctcagtatcggaatggcgattgtatacaatctgggtaccaatgttttcaagggagagatttcctatgtgacacaggcgctcgcggcggtcttacagctgggtgtgacgatggattattccattttcctctggcacagttacgaagagcagcaggagcgttttcagggagataaaaaacgtgcgatggcgcatgcgatttctaatacgatcacatcggtggtcggaagctccatcacgacggtggctggtttcgtggcactgtgtttcatgagctttacacttggtatggatcttggaattgtcatggcaaagggtgttgttctcggcgttatctgctgcgttacggtgctgccgtcgctgctgcttgtatttgacaaggcgatcgagaagacgaagcacaaggttatcatcccggatctgggacggattgcagactggatcgtgcgccattacggcgtattcctgatcgtatttctggtggtgttggccccggcaatctacggctacacacacacggatgtgtattacgatcttgcgggaacactgccgaagagcttaagcagtattactgcgaacgataagttaaacgaagactttgagatgggtgcgacgcacatgatcattgcggacagcagtctctccgcaaaagatgccagcgcaatgttggatgagatcagcaaggtggatggcgtgaagatggcgcttggctttgactcgctggtaggaccaggcatcccgagggagtttatcccggatgacgtaaaagacgtcttgatcaacggcgattatcagatgatggtggtcggctcggaatatgcggttgcttctgatgaagtgaacgcgcagtgcgaggagatcaacaatatcatcaaaaaatatgattcctctgccatgttaatcggtgaggcaccgtgtacgaaggatctgattgagatcacggatgaggactttaagacagtcagcatcgtgtcgatcggtgcaattttcgtgattattgcactggtatttaagtcggtatcactgccggtcattctggtggcggtcattgagttcgccatttttatcaacatgggtattccggcatatacgcacacgacgctgccgtttatcgcttctatcgtcatcggtacgattcagctcggcgcgacggtcgattatgcgattctcatgacaacaaagtacaagaagcttcgctacaacggagcggacaagaaggaagcgattgcgacggcacttcgcagttccatccagtcgatcattgtcagtgcgctcagcttctttgcagcgaccttcggtgtcggcatgtattccaatattgatatgatcagttccctgtgtattctgatggcacgcggagcaatcatcagtatgtttgtcgttattttcattctgccgtccatgtttatgatttttgataaactgatctgtgcgacgagcatgggatttcgcaataaaaagggcacgacggtgaatgtgtcggaaaacaatgtatcggtacagtaacgggaaaggaaggtaaaaaccatgaaattaccagagttaaaatcaaaattcaaaaatagatatgcaatccgcattattgccggagtcctggtcgttacgcttgttgcaacaggttcctccgtctacagtgtgaatgcggcaaaggcaggcagcgctgccacagagaacgtggaggagacggaagtttctgaggaggcggaagatacggaagatgccgagagcagcttaaaggatctgctggataacggaagcaaagtaagcgagaaagagatcggaaaagaagagacagtatatgtcatcgccgacaataccggcaaggagcagaaaatcattgtctccgatcatctgatcaacaacgatgacaaggatacgcttgaagatgcatccacattaaaagatattgaaaatgtaaaaggcgatgagacttttacacaaagcggcaataaggtgacatggcaggcagacggcaatgacattttctaccagggaacgtcagagagcgagctgccggtgacacagaagctgacctactatctggacggcaaggaagtgacgccggaggagcttgccggaaaatccggtgaggttacgatacggttcgactatacgaacaaccagaaagtgacagcgaagattgacggaaaagacgaagacatctatgtaccgtttatggcagtcagcggcatgatcctcggagatgaattctcggatatcgaggtggaaaacggtaaggtgatctccgacggaagcaacaatgtcgtagttggctatgcacttccggggctgaaggaaagcctgaacgtaaaggacgacgatttcgacggggatgtcaccattccggattacgtggaggtaaaggcaaaggttgagaacttcaagcttgataccacgatgacggtggttatgaatgcagcgaacttcatcagcgccgacagcgacaatgacacctcgaagctggatgaggtatttgacacactcacagacgcgatggatcagctgaccgacggctccgcagaactggcagacggcgtagacaccttgaagtccaagatgggcgactttaaggacggtgttggcaccctgcagtccggcgttcatgcatacacggacggagcgggaaaaatcgcaagcggtatcacgcagctttccgacagcattccgacattatctaacggtgtcggcacattgaacagcagtgcggcaacgattgcggacggcgtagaactgttagacaatactttaaagacttccttcaccgatcaggagaaggcagcgatgcagacacaggcatcgtccgcagtggatgcacaggcagagacgatcaagaatcgggcatccgctgcagtggacagccaggcagaagcgattaagagccaggcgtctgcagtagtggacagccgggcagatgagatcaagagtcaggcagaagatgcggtggatggacgggcagatgcaatcagaagccaggcgacacagatggtagacggtaaggcagatgatattaagaatcaggcgacacagcaggtaaccgcaaagtttgataatggcaagtatgatgaggtcaagaatcaggcggcgcaggagatcggcgcgaatatgagcagcatgacgggcaccctgacatcttccgcggatgtgcagaccctgattaacggagcggcgtttgcaacgatcgcggcgcagtatccgacagagacggcagcagagattcagacaaatcatgcagctgagatcgcagccgcacagcagcagattgcagcgcagtttggaaatacaatcacaactgcgatgggcggagcggtagataccctggcacagggcgttgcaaatgcagcaaagcaggcagcactggaagcagccggagaggcagccttaggcggagcgaagatcgcagccggggaagcggcggtaaccggagcgaagctggcagccggagaggcagcggtaaccggagcgaaggaggcggccggggaagcggcggtaaccggagcgaagatagcagccggggaggcagcagtaaccggagcgaaagcagcggccggaacggcagccgtgtcagcggcagaacagacaaagtccacgatggcggcaagtattgagcagcagagctcgggcggatacagtctggtaaccggagcgagagcactggctaatggtacccagagtctggcagatgcggtaccggcactgacatccggtgtggcgcagcttaagaacggaagtgcagaactggtttccaacaatcagaagctcaacgatggcgtcaacgcgttaagtgatggtaccgacgcagtgatcgacggtgtggatcagttatcggacggcgcacatcagctggcagacggaatcgttaccttcaacgaggagggaattgagaagatcttaaattcctaccacggtgatattgagcctctgatggatcgtatccaggcggttctggatgccggtgaggactatcagacctacacggatattgcggacggcgtgaacggaagcattaagttcatctacaagacagatgcggtgaaagaggactaatgaaaattgtctcaataaatccgtatttgttctggaaatattgtaagaagagagtataataataaggagtcatgtgagggaggacggaaatgaactggatagagaatgttctgattatagcgggagtgtcgcttgatattttcgcggcgatggagtgccagggcgcattggtcgcaaaagtggacaaaaaacagttgtccgtcatctgcgcgttgatcgctgtatggcagctttgcgcgctggcgctcgggaactatctgtccggtctcctttacagaaatgagctggcacacgatgagaattttgtaggacttgtgattgcggcggtgatctttttcggactcggcatccgtctgattgcgaaggcaatcaagaacgaatgggtcaatgagcgccgggaggagagccttgatgtgaaaaagttcctgaggatgactgcggtgacaagcatctatacgctgcttgcggggatcgcattcggattcctggggacgaacgttgcgctgatgctgatcatcatcgtatgtatgacgattgcattcgttgtgcttggcgtgtatacgggttatcatctgggatttcagcacaagacaaaagcatatgtcggcggagcgcttctgctttggattgccggcatcgatgtgattgtaagacacatcatgtgctaaaaagagggagagtatttcaaatagaaccagagacggttggggagctgtctctggttttttctgatcggggtgcgtttactcgccgttgaaagaatcggtgtgatacagtataatattctaggaagaaagtattacgtttcgtaatgaggggaaaagatggagaagatcagacatgacagcagctatgaatggctgagtggcgaaagctggaaggagtggagcgcgagcttcttttcgatgggctggaagatctggggcgtggtgttaatcacagaattgtttttgtttctgttttttaagcccaccgcggactgcggcagactgcgctatggatggctgttcattgtgcgaccgagcggactgcagctgttgcttctttttgtgtaccgcctgctgaccggcagacagaagcgtgtatacagcagacgggcgatggcgggatgcgccatattcctgctgacatcctacgcggctgtgatggcgtgggtgcatacgagcgtgacgctgatgccgatggttctgttgctgccgatgctgctgacgccgctctacaaagaccgggtcatgacgcttgtgcaggcggcgctgctcgttgcagcctatgtgctggactgtgtctattttatacctgccagttcttatttcccgctgacaaccccgtttattgagggcagcatcttcgtgggaacggtgtgcggtatgctggtggcgctggaactggtcaatgattcggcgatcgtgaacgatgagcgttccaagcgggattccctgaccaagctctacaaccatgaaagcttttatgaggagttagagtattaccagagaaggtacgaggagaaccgggagcgtttttcgcttgcggtgatcgatattgataattttaagaatgtcaatgatacctacggacatgcgtttggagatgtcgttttaaaagaagtggcagacatctgcgccagacacaaaggcgcggcgggattctgtgcccgctatggcggcgaggagtttgccatcatatttaagggagcgggagtcggacaggcggaagagatggcggagcagatccggcaggagtttgaacagaaaatgtttacaacgccgcagggggagcggtcgttttccgtgagcatcggtgtggcggagtacgacagggcttatccgggtgccagcgcgttttttgaagtggcggacgctgctctttactgcgcaaaaagagagggcaagaatcaggtgagacgatgaaagtattgttgacggcggtgaatgcaaaatacattcactcaaatctggcagtgtacgatctgcgtgcctatgcggaggcttatggcaccggcggggcgcaggtggagatcggggaatatacgattaaccatacgatagactacatattggaaggaatctataaggcaaagccagatgtgctttgcttttcctgttatatctggaatctggattatgtggaacagctgatggacgagtaccacaagatctgtcccgaagtgccgatctgggtcggaggcccggaagtgtcttatgagacggaggcgtttctaaaagcgcatccgcaggtgaccggggcaatggttggcgagggagaagagacttttctggaactgtgtgagaactacgcaaaagcgggtgccggagcgaaggcggggaaggtggatttcccgggaatcaagggaatcatgtaccgtgccggagagagcctcgtaaaaaccggagcgcgcgagccgctggatttaaaccggattccgttctgctacggagccgttgaagatttccggaaccgcatcatctattatgaatcgagcagaggatgtccgttccggtgcagctactgtctttcctcggtggaaaagacactgcggttccgggatgtggagcgggtgaaaaaagaactggcattttttttggagcaggaagtcgcgcaggtgaagtttgtggaccgcacctttaactgcaggcatgaacatgccatggagatctggaagtttttaatcgaacatgataatggcgtgaccaacttccattttgagatatctgccgatcttctgacggatgaggagattgcgctgatcggtcagatgcggccgggactgatccagctggagatcggcgtgcagtccacgaacgacgccacaatcaccgagattcaccggacgatgcagctggatcgcctgaaagcggtagtaaggagcatccaggaaaaagagaatattcacgagcatctggatctgatcgcaggtctgccctatgagggctatgagacatttgcgcgttcgtttgatgagatttatgcgttaaagcccaatcagcttcagcttggattcttaaaagtgctaaaaggttcttacatgtatgagcatgccacagagtatggtctgatctaccgcagcagaccgccgtatgaggtgcttaagacaaactggctggggttcggggagatccttcgcatccggcaggtggaagagatgctcgaggtgtattacaacagcggacagtacgccacagcaatccggcttctggagacgcagtatgcgagtgcgtttgccatgtttgcggaactgggaactttttatgaggagcacggttattttggaatgggtcattccaggatgcgcagggcggagatcctgctggaatttgcaaaagagcgtaagccgggactgcttccggtgcttggtgagggtctggtatatgacctgtatgaaagagagaatctcggaagcagaccttcgtgggcagcagatgcgaatgaatggaaacagattgcgcgccggtatggtaaaaatggaaagcagtcgcacattgagcggtttttctaccggttttccggccacaggcaggataccgcatcgctcccggagaggctggaagaaccggtctatgtgagatttgactataccggaagggatccgctcgatcaccaggcgcggcatgaatatctggagccttccggggaataaccggaaagaggggagaatagattgttagaggattatgtggtcattgatcttgagatgacgggattgaatgcgaagacggatgccattctggaagtgggagccgtgcgcgtcagagacggcagacagacggaaacgtatggcgctattttaaaatgtgggcgggaattgtcagagcgcgtggtagaactgacgggcattacgccggagatggcggcaggcggcagggagccggaagaggcgatgcgggaattttttacattcctgggggacgatgtgctggtcggccagaatgtgatttttgattacagctttctgaaacagtggtcggtcaaccacggtcaggcgtttgagcgaaatgctgtggataccttaaagctggcaaggcgcttccttccggcggagcagaaaaaggacctggaaagtctgtgtacctatttcggaatcgggcgtgagcgggcgcaccgtgcgctcgatgatgcgatggcgaccggaatcgtgctggagagattaaaacaggagtacggtacggcacagccggaggcgtttctgccgtatgcgctctgttaccgcacaaaaaaacagacgcccgcaacggggcgtcagatggatggcctcaagaaatatgctgcgcattacggcatcccggagacggagatcccggagcagatgacgcggagtgaggcgtcgagactgcttgaccgctggatcgccgtgcacgggcggatgccccgggattaagcatttactttttcctcaagcatggcgacgatggcgttctgtctgggggattccagtgctctcgcggcgatgagaagacggtcaagtgcgtcggaatccctggcgtttagataatagtctgcgagcatccggtagttcccactgtgatcggacccgcagctgatgccgtactcgagaacccggactgcctccgcgtcatgaccgagctttttcaaacattcggcgtactcatagatggtgcggcagagggtggtgtagttctcgtcacaggcgcagagcgtttccagattggcaacgccgtactccagcttgagatcggtgttggtcttgccgccgaggtttaagattttctgtccggcaagcgattggagagtctcctcatatttttttaattcgggattgtcatagatacccattggaaaatcggcaagaggtatggtaatatagggaagcccgctgatgtccttgcggcgtgtgtggtttgcttcgttctcgcggttccagaagctctcggcagcggcttcttcggcagcggtgcttttatggcgcagataagcaaacatacatacaaaaaagataaaaagtcctaaaaaaatcatgagaatcatcccttcttgtggtatagtgtaaaaggttcgcgcggtatccagggcgtgaacggaaaggtggtagaacgaaatgtacgattttggtaaaaaaaagaataaaaaactgcttgcaggaatcatcattgtggttgtggcagccatgcttctgacaacggtgcttgcagcgttattataagtgtattccgccgttttgctttcatgtaaaatatactaaaaatcccagagtgagtcaaacatattcgtgtttatgcaccttgaaaagaaaggcgcgtatgggctataatgagcggaagcagagtatatgcttggcaaaacaggcgttagcagagcagagaacagatatttcagagggaagaatatgaaaaagggaacaggttttttgacattgtttgggggtgcagtggcactttacgcattgctggcggcaccggtttccatgagggcacaggagacggagacgattgaggacggtgtctatatcggcaatatttatgtgggcggcatgacggaggaagaagcggtcagcgcggtagaagcgtacgtggagagcgcagattcggcggagatgacattgaagaccggcgataaaagtgtatccgtgacggcagctgatcttggaatatccttttccaacttaaacgtggtggacgaggcgatagatgtcggcagaagcggcaacctcatcaagcggtacaaggacaagaaggatctgcagcagggggacaaagtgattgcactctcactggatgtggattccgatgcggtggcatccatcctttccgggaaagcggcgcagctgaaccaggaggctgtggataatggtctggttcgtgagaacggtgcgtttaagatcattaagggcgagcagggcatcgaggtcaacgtggaggattccattgcggcgatcgagaactatatcagcagtgagtgggacggtggcaacgccgagatcgagctcgtggcggaagtggtggagccgcgcggcagcgaggaagatctggagcagatcacggatatgatgggaagctatacgacgaattacaaggattccggtcagaaccgctgcgacaacatctccaatgcaaccagcaagatcaatggtacactgctttatccgggcgaggaattttccgtctatgaagcgatcggaccgctggatgcggcaaacggatacgaactggcaggtgcctacgagaatggtcagacggttgagtcctacggcggcggtgtgtgccaggtatctacgactttgtacaacgcagtcattctggcggagcttgagatcacgcagcgctcgaatcattccatgatcgtaagctatgtgaagccatccatggatgcggcgattgcaggcgattacaaggatctgcgttttgtcaataatcaggacattccgatttatattgaggggtacaccgagggaaagaatgttacctttaagatctacggacacgacacgagaccatcgaaccgcgttgtgacttatgagagtgaagtggtatccgagcaggatccgggcacgcagtatgtggcgaccggagatccggcgggttatatgaagactgcgcagggcaagcatatcggctatgtggcaagactgtggaaagttgtcatggtagacggtgtggaggagagccgggagatttttaataagagtacctacaaggcgtctccgaagattgtaaacgtgggaacggcatcagcagatccgaatgtgtctgcggtgattggcgcggcgcttgcgaccggggatgaggcaaccatcaatgcggcggttgcaccttatgcggcgagtgcggcagcaatcttaaatccggcaccggtagaacagccgtcgcaggaagaacaggcgattactggaacggtggatgagagccagatcacaggcggagaataaaagtataagagattgtttaaggctgcctcagaagagacagccttaagctgtaaataaacgggagaacacagatgaagatcggaaaactgccggagagcgtactgaagcgctccgtattcaaacaaatacataccagacgccccgaggttgtcttaggagccggcgtcggagaggactgcgccgcgatcaagctggcagaggatgagacgcttgtgatgtccacagatccgattaccggaacggcgaaggacatcgggacacttgcgattcagattacagtgaatgatctggcaagcgcgggggcggagccggtgggcgtgctgctcacggtgctgctgccggagagcgtggaggagcccgaactgcgtgccatgatggcacaggtggaggaagcctgcgccaaggcaaagatccaggtgatggggggacacacggaagtgacggcggtggtcaatcagccggtgatctccgtctgcggtgtcggcaaagtgaaggatggctgtctgatctcgaccggaggggcgaggccgggtatggatattcttgtcacaaagtggatcggaattgagggaacttccattatcgcaaaggaaaaagaaacagaactaaagacaaagttctcggtgccttttgtcgagaaggcaaaagcactggatgcttatatatcggtacaatcagaggccgcagtcgccgtcaagtctggcgttggtgcaatgcatgacgtcacagagggcggaatattcggtgcgctctgggaaatggcggaagcatctggcgtcggacttgaaatcgatttgaaaaagataccggttcgtcaggagaccattgaggtctgtgaatttttcggaatcaacccctaccagctgatttccagcggctgtatgctgatggcggcagaggatggcaatctgctggtaagagaactggagaaggcaggaatccctgcaacgattatcggaaaggcaaccgcggggaacgaccgcgtccttttgaacgaggaggaacgcagatttttggagcctccgaaggcggacgaattatataaggcgatataaaggagaagaagcgatgcgtgaaaagattttgacatttatagagaagaacagccggattgacttaaaggagcttgccattgtgctcggtgtcgatgagacaacggtcatgaatgagcttgagaaaatggaagaggagcacattatctgcggctaccacacactgatcgattgggacaaagcgggcattgagaaggtgactgcgctaatcgaggtacgtgtgacaccgcagcgcggcatgggctttgacaaggtggcagagcggatctacaactatccggaggtcaattccgtttacctcatctccggaggctttgattttatggtgacgatcgagggaaagaccctgcgcgaggtttcacagttcgtgtccgataagctttccccgctggattccgtgctcagcacgaagaccaacttcatcctgaagaagtataaggatcatggaaccgtaatggcagagcagcccaaagatgaaaggatagagatgtaagatgagagatccgttaaataagacaatcacaacgatccagccgtctggtatccgaaagttctttgacgtcgtccatgagatgaaggacgcgatctctctgggtgtcggcgagccggattttgataccccgtggcatatccgcgacgagggtatttattccctggaaaaaggaaagacacactatacatccaatgccggactcaaggaattaaaagtggagatcgaccattatctggaccggcattacggggtgtcctatgatccggatcatgagatcatggtgacgatcggaggcagcgaggcgatcgatgcggcgatgcgcgccatgcttgatccgggagatgaggttttaatcccgcagccgagctacgtgtcctacgtgccgtgcgccgtgcttgcaggaggcgttccggtgatcattgagctgaaggcggagaatgaattccgtctgacgccggaagcgctggaggctgccatcacaccgaagaccaagcttctggtgatgccgttcccgaataatccgaccggcgccattatggagaaaaaagatctggaaaagatcgcggacatcgtaagagagcacgacctttatgtcatcagcgacgagatatactcggagctgacgtatctggagcggcatgtgacgattgcctccctgcagggaatgcgcgaccggacgatcgtgatcaacggtttttccaaatcccatgccatgacaggctggcgtctggggtatgcgtgcggaccgcgcatcatcatcgagcagatgttaaagattcatcagttcgcgattatgtgtgcgccgtccaccagccagtatgcgggcgtggaggcactgcgcaacggagatgaggatgtggctgccatgcgcgaggagtataacggcagacgccgctatctgctgcaccggtttaaagagatgggattgtcctgttttgagccgtttggcgcattttacgtgttcccgtgcatcaaggagttcggaatgacgtccgaagaatttgcgacggagctgctcaatcagcagaaattagccgttgtcccgggcactgcgttcggagactgcggagagggatttgtgcgcatttcctatgcttactcgctggataacctgaagaaggcgatgaaccgcatggaggcgtttatcacagatcttcgcaagagatcataagaaaaagggaggagggcgtttcctcccgaatggagactgacatggcaaagctgaatgttgtattatatgagccggagattccggcaaacaccggaaatatcggcagaacgtgcgtggcgacagggacaagactgcacctgatcgaaccgctgggattccatctggatgagaaagcaatcaagcgtgcgggcatggattactggagtgaactggatgtgaccacctatgtcaactgggaagatttctgcgagaagaacccgggcgctaaaatttatatggcgacgacgaagggcagacatgtatacactgaggtatcctatgagccggactgctacattatgtttggaaaagagagtgccgggattccggaggagatcttaaaagccaatccggacacctgtgtgcggattccgatgatcggcgagacgcggtcactcaatttatccaattcggttgcgattgtgctgtatgaggcattgcggcagaatgagtttgaccacatgaagctgcagggcgagctgcaccggctgcgctgggaagattagagagggtacagatgggaattatcaaggcaagacagttggttcatgaatatatcagacgcgatgaggagggcaatgtggagtccatctccacagcgctcgaccacgtcgatctggatgtggaagcgggagattttattgccattttaggacacaatggttccggcaaatccacgcttgcaaaacacattaacgcgctccttctgccgagcgaaggctcgctctgggtggatggcagggatgtcacaaaggaagagaatacatttgcggtgcgtcagactgcgggtatggtatttcagaatccggacaaccagatcattgcgagcgtcgtggaggaggatgtcggcttcggaccggaaaatatcggcgtgccgacggatgagatctggaagcgcgtggaagaaagccttggtgcggtagggatgctctcgtaccgtcatcattcgccgaacaagctttccggcggacagaagcagcgcgtggcgatcgccggggtcatggcgatggaaccgaagtgcattgtgctcgacgagccgactgccatgcttgatccgaacgggcggaaggaagtcatccgcacggcgcatgaactgaaccggaaaaaaggcgtgacgatcattttgatcacacattatatggaggaagtcgtggacgccgacaaggtgatcgtgatggatcagggaaaagtcgtcatgcagggaacaccgcgggaagtgttctcccaggtgggaaaactcaaggagtacagactggatgtgccgcaggtgacgattttagcagatctgctgcgccagtccggcattgatgtacccgtcggtgtgctgcaccgccaggaacttgtggacgcgatccttcgtgtggcacagatcggagagtagaaatgtcaattattttagataaagtgaattttgtatatagtgaggagaccgcgtaccagattcaggcgttaaaggatgtgaaccttgagattaaggacggacagttcatcggcatcatcggacataccggttccggcaagtcaacgctgatccagcacctgaacggtctgatgaaggcaacctcgggaacgatctattttcatggacaggatatttatgaggaagattttgacctgagagaactgcgcaaccgggtgggactggtgttccagtatccggagcatcagcttttcgagacgacaatttttgatgacgtctgctttggtccgaagaaccagggactttccaaggaagaggcgggactgcgggcgtttgaggcactgcgcagtgttggtatgccggaggagctttattaccagtcgccgtttgatctctcgggagggcagaagcgccgtgtggcgatcgccggagtgcttgccatgaagccggaggtgctgatcctggatgagccgaccgcgggacttgacccggcaggaagagacgagatcttagaccttgtggcacggatgcaccgcgagcgaaacatgacggtcattctggtgtcgcacagtatggaggatgtcgccaagtatgtggagcgcattatcgtgatgaaccatggacaggtgatgttcgacgacacaccgaaggaagtgttccggcactataaggagctggagacgatcggactcgcggctccacaggtgacttacctgatgcacgaactgaaggagcacgggctttccgtggatacggaggcgacgacggtggaggaagccagagccagcctgatgcaggcattgacgggaattgattccggcaggagcgatattcaccggtaaggtgtgccgcggcaggaatcattttacggaggaaagagtcaccggcgggcgccgatgaagaattccggtagggaggaagtttatacatgttgagagatattacactgggccagtattatccggcagattctgtgatccataaactggacccgcgtgtgaaactgtttagtacaatgatctatatcatatccctgttctgcttccgtggcgtggcagcgcttgcgattgcaacggtatttctgattacagtcataaagctgtcgaaggtgccgtttaagttcatggtaaagggattaaaagcaatcatgatcctgatgttaatcacggcggtgttcaatctgttcttgacgcccggtgaggcactggtgagtgtctggcgttttacgatcacgaaggagggtgtgaccagcgcggtgctgatggcgatccgcctgacctatctgattctcggaacctcaatcatgacgctgaccacaacgccgaaccagctgacagatggtctggaaaaagcgctgatgccgctttctaagatcggtgttccggtgcatgcgattgcaatgatgatgtcgattgcactccgctttattccgattctgattgaggagacggataagatcatgaaagcgcagatggcacgcggagccgattttgagagtggcaatctgttaaaaaaagtcaaaagcatgatcccgcttctggtgccgctgttcgtgtcagcattccggcgcgcggatgatcttgcaatggcgatggaggcgcgctgctataacggcggagagggcagaacgaagatgaagccgctgcgctatgagggacgcgaccgcctgtcctatctgatcatgtggctgtatctggcgctcatcattctgtgcagaatctttgtgccgtggccgcaataaagctgcaaggagaaatggtttggagaaagaggtaaaacgtgtaaaaatgaccgtggcgtacgacggcacgaattataaaggatggcaggtgcagcccaacggaatcacgatcgaggaagtgctgaaccgccatctttcctcgcttttgggggaggagatcgcagtgaccggcgcaagccgcacggattccggcgtccattcgctgggaaacgtggcaattttcgatacgacgacgcgcatgccggcggataagatttcgtttgcactgaatcagcgtctgcctgaggatattgtcgtgcaggggtcctgcgaggttcctgcggactggcatccgcgctatcagaacagccgcaagacatatgagtaccgcattttgaaccggacattccgtatgccgacgagacggctggatacttatttttaccaccacagcctggatgtggagaagatgagccgggcggcggtgtacctggaaggggagcacgattttaagagcttctgtgcggtcaatgcgcaggtgaagaccacggtccggacaatctatgcgtgcagcgtcacaaaagcggacgacatcatcacaatccgggtgaccggcaacggttttttgtacaatatggtccgcattattgccgggacgctgatacaggtcggcggaggtcagatcgagccggagcagatagagcagatcctcgcggcgcgcgacagggaggctgcgggaccgaccgcaccggcgcacggactgaccatgatgggaattgaatatatggaagaaaaagatattgacacgcaaggagtcgtgtaatataatatttaagtctgtgatagtgaataaatgtcattccaaagccccggagtgccatttaactataaacaatatgacatggaggacagtgtgccggacattcacgctgcctgagatgaacagcatttttctaggaggaataacgatgaagacttttatggctagcccagctaccattgatagaaaatggtatgtagttgacgctgaaggtatgacattaggacgcctggcatctgaagttgccaaggtattaagaggaaagaataaaccaatctttacaccacatatcgatacaggtgattacgtaatcgtagtgaacgctgagaaggtaaaggttaccggtaagaagttagatcagaaggtttactacaatcactctgattatgttggcggtatgaaagagaccacattaaaagagatgatggctaagcacccggagagagtgatcgagcatgctgttaagggaatgcttccgaagggacctcttggaagagagatgtatacaaagttattcgtatacgcaggtccggatcacaagcacgcagctcagaagccagaagctttaacattttaatgaggaggtaaaagacattggctaacgcaaaatattacggaacaggaagaagaaaatcatctgttgccagagtatacttagtaccgggtacaggtaaggttacaatcaataaaagagatatggacgaatacttcggattagatacactgaaggttatcgttcgtcagccgcttgcagttacagagacagctgataagttcgacgtattagtaaacgttcgcggtggtggttacacaggtcaggcaggagctatccgtcatggtatcgcccgtgcattactgaacgtagatgctgattacagaccgatcttaaagtccgctggattcttaacaagagatccgcgtatgaaagagcgtaagaaatacggtctcaaagcagctcgtcgcgctccgcagttcagcaagagataatcgactgcccagactatatcaaaatggttcaaaaagcccggaaaatcaaggttttccgggcttttgctatatctaaacgggctgatatggtttgaccaaatttggcaaaacgagagccgatttcacccaagttttagtggttaaatataggacaaccggcaaaaatggggtcaaaaaacggccttagtggttaaaaaataggacaaccagagagcaatttcgggggtatttttgagggtgatttggcactctcagacaccggatttttcgctggagggtttggcataatctgaccaaatctgaacaattaaatacgattctaatgcaggcactcagtaacaaataactgggtgcttttttgtttcagagattccggcattagaaagggccgtcactttatgattttgaagtggcggctttttctatttccagaaacaacagcaacaatcagaaatgaggtgaagtcatgaacacacaaatcatcgccatcgccaaccagaaaggcggcgttggcaaaacaacaacctgtgcgaacttgggaataggtctggcacaggccggaaagaaagtgcttctgatcgacggggacccacaaggaagcctgacaatcagcttgggaaatccgcaaccggacaagctgccatttacactgtcggatgcaatgggcaaaattctgatggatcatcctatacgccccggagaaggtattctgcatcatgcagaaggcgttgacctgatgcctgcggatattcagctttccggtatggaggtttctctggtaaacgccatgagccgtgaaacaattttacggcaatacctggacacactgaagggacaatattcccatatcctgattgactgtcagccctcgttggggatgcttacggtcaatgcgctggcggctgcgaacaggatcataattcccgtgcaggcagagtatctgcctgccaaaggactggaacagcttctatctacggtcagtaaggtgaaacggcagatcaatccaaagctccagattgacggtatcttgctgacgatggtggataaccgcaccaactttgcaaaagagattgctgctttgctgcgggacacctatggaagtaaaatcaaagtctttggaacggagattccacactctgtccgtgcaaaggaaatcagcgcagagggaaaaagtattttcgcccatgaccctggcggcaaggtggcagaggggtatcgaaatctgacgaaggaggtgttgaaacttgaaaagcagcgcgaaaaaagtagagctggcatcggtagatgatctgttttctacggaggagagccgtgccgatgctcagagagaaaaagtagtagaaatcccgctgtcggaactgcacccgttcaaaaggcatccattcaaagtcaaggatgacgaagcaatgatggaaaccgcagacagtatcaagcagtatggtgtgctggttccagcaattgcccgccctgacccggagggtggttatgaactggtggccggacacagacggcacagagcaagtgaactggcagaaaaagagaccatgccggtaattgtccgtgatctggacgatgacgctgccacaattattatggttgacagcaacctgcaacgagaaagcctgcttccaagtgagagggcctttgcctataaaatgaagttggaggctatgaagcaccagggagagcgagtggatttaacttgtgcccaagttgggcacaagtccgatggtagaaaatccagagatattttagctgaacaggttggacagagtaagaatcaaattcagagatttatccgtctgaccgagctgattccagaactgctggacatggtggatgaaaagaaaattgccttaaatcctgcttatgagctgtcctttctcaaaaaggaggaacaggtagacctgttggacgcgatggacagcgaacaggctaccccttctctttctcaagcccagcggctcaagaaatacagtcaggaggggcatctgaccctcgatatgatgcgtgtcatcatgggtgaggaaaagaaaagcgatctggaccgagtgacatttacctctgacaccttgcggaagtattttcctaaaagctatacgccccagcggatgcaggaaaccatcatcaagctgctggaggcatggcagaaaaagcgtcagagagatcaggaacgatgaaaggagccgcctatgaaagatatttcagcaagggagctgaaaggacataacattcttgccgtggaacgctttgaggacagcacccgatggatgattgagtttgttgttctccatccgtgtagtgcttacgggagcagaggtgatgaaatgcgtctgtttcttgcagaggacagctatcagaatgctctccaagaccagcagcgccggaaaatcaaaatcaagcggtatgcccgtgttgttgagggacacatcctcgactttaagccgggaaagaaacgcacaagaaaatatagagaaagttgaacgccacaattctttgatttgggattgtggctttttttatatccaaaagtcggaaggagtgaggtcgatggccgtttttcgcattgaacggacccgtgattatactgtgatgagcaatcatcatttacgaaatgcaaacctgtcgttaaaagccaaggggctgctttccatgatgctgtctttgccagaggactggaattacaccacccgtggtcttgcaaagatctgtaaggagggcgtggatgccataggcgctgcgttgcgggaattggaggccgccggttatattgtacggcacaagttgcgtgaccggcagggacgcatcagcgatacagagtatgtcatatacgagcagccacagcttagaaaaccggatacggattcaccagatacggaaaacccgtatatggataaaccggatacggaaaagcccgcagaattaaatatagagaaatctaatactcaaaaacaaaatatttatggatcaagtaccgattccattcccttccgggattgcgcggcagattgtctgccggaacggaaaggaagggatgcgatgtcactcacagagatagagagttatcgggaattgattcaggagaatatcgggtatgaatacctgtgtcagcagtatgaaacttatcgggaggatttggatgagattgtggagctaatcgtggaaacggtctgtgcaaagcgaaagaccacccgtattgcaggaagtgattttccgcatgaaatcgttcgttccaggttcttgaagctggataactcgcacattgagtttgtcatggactgtttacagaagaacaccacggaaattcgcaacatgaagcagtatcttctgaccgttctgttcaatgcaccgaccacgataagcaatcattacacctcacaagtaaatcacgatctgtatggcggctggtaaatggtcgcttttttattgcccggaactgccgggagaaaggagcaagcatgatgtctgagggaaagaccatagggcagctgatggaagaaatgcgggcaaaggcaggagcgcagaattatcacggtcatggatatatggatctccagcgttttgcggaggacacccggcacatgattatttttgatgtgctgacgaacgattcccctgttggctggaaaggcgaacgaacccgcctgttcctgtcggatactggttatgaaaaagcactggatagtcaggaaaaggggcagattaagattttgagccacgcaaaggtacgtcagggcaatctgcactatgaccgttctgaccagttacgctaaggagggtgatatgaagcgttatcttctgcggcggctggtggttccgccttagcaaaaaaagagattccctgcaaacttcgtggaaaggaggcgagaaaatgcaggaagaagtggaaaacagaactttgacgctggttgtcagtggaacaaagtttaccggcagaatgtttaaggctgccataagcaagtacatggcacatcgcaaggaaaagaagctggaaaaacagagaagccgtgatgcgccggttgttccgcatggaaaacagactgtgaagcagcttgtcgggcagaatcagggaatatccaacattgagatcacagacccctctatcaaggagtttgagaaaatcgcccggaaatatggtgtggattatgcggtgaaaaaggaccgcagcagttctccgccaaagtacctgatttttttcaaaggccgtgatgcagatgctctgacagcagcttttacagagtacaccaacaaaaaggtcaaaaaggcaacgaaaacagagcgcccgtccgtactggcaaaacttaaccagttcaaagagatggttaaaaatgctgtggtggatcgcaccaagcgaaaggagctggaacgatgaaaaagacattggacatcaaaaagctcattttgctgaatatgccgtatatcctgatgggactgtttgctaccaattttggagaggcatggcgaatggcacaaggggcggatgcttcagaaaagtttctttcgctggttgctgttctgcctggggcgctgcaaagtttctggccaagcctgcatccattggacttgttggtagggctgtgttgtggaggcagtctgaggctggcggtgtatcttaaaagcaagaacgccaagaaatatcgacatggtttggaatatggttcggcccgctggggaacccgtgaggatattgcaccttacgttgatcctgtatttcagaacaatgtgattctgacgaaaacggagagcctgaccatgaacagccgccccaaggaccccaagactgccagaaacaaaaatgtactggtgattggcggctccggttccggtaagacccgattctggctgaaacccaacctgatgcagatgcacagctcctatgttgtgacggacccgaaaggaacaattctggtggagtgcggaaaaatgctccaaaggggtgcgcccaagctggggaaggacggaaagcccatgaaggataagcacggcaaggtcatttatgagccgtaccgaatcaaggtcctaaataccatcaacttcaagaagtccatgcactataacccctttgcatacatccactcggaaaaggatattttgaagctggtgacaacgctgattgccaataccaaaggcgaaggcaaggccggagacgatttctgggtaaaagcagaaaccttgttgtactgcgcgcttattggctatatccattatgaggctccggtggaggagcagaacttctctaccctcattgagttcatcaacgccatggaagtccgtgaggatgacgaggagttcaaaaaccccgtagacctgatgtttgatgcactggaagccgagaagccaaatcactttgcggtgcgccagtataagaaatataagctggccgccggcaaaacagccaagtcgattttgatttcctgcggtgcgcgtctggccgtatttgatattgcggagctgcgcgaggttacatcctacgatgagttggaactggatacgctgggagacagaaaaacggctctgttcctcattatgagtgatacggatgacagttttaactttctcatttccatgtgctacacccagttattcaacctgctttgtgaaaaggccgacgatgtgtatggcggcaggcttccggttcatgtgcgctgtttgattgatgagtgtgctaacatcgggcagattccgaagctggaaaagctggtggccaccatccgaagccgtgaaatctctgcttgtctggtgttgcaggcacagagccagctcaaggcaatttacaaagataatgccgataccatcatcggcaatatggatacttccatcttcctgggtggcaaagaaccaacaacgttgaaagagctggcggctgttctgggaaaggagaccatagacacttacaacaccggagagagccggggacgggagacctcccactcgctcaactatcagaaattaggaaaagagctgatgagccaggacgagctggcagttatggatggcggcaagtgcatcttgcagttgcgcggtgtgcgtccgtttctttcagacaagtatgacattaccagacaccctaatttcaaatacacagctgatgcagacaagcgaaatacttttgatattgaagcatttttgtctgccagactaaaactcaagcctgatgaggtctgcgatgtatatgaagtagacacggagggcgtgtaatacggttccgctgagaaaggagtgatcgtatctatttgccgcaactgcctctgttgaggccattggcgtacaaagcgggcaatcatcaacaaaataatgaaaaaggaggacagccggaatcaggctctcatatatcgagggcagattgttccggcttttgtgcgcttatgaaacaaacctaactaatcattcaaatgattccggctaatattatttatggcattttttgaacaggcaattaccgttcttcagactctcgttatcgctctgggtgctggtcttggtatctggggtgtcatcaacctgttggaaggttacggcaacgacaaccctggcgccaatgctcatgtacggtaaggaagcaagcaaccgaaaacaagagatagaccgccagcactacactattccgaaccaaagaccaaaagataagcattgtgggaaaatctaaacttttggattttcctacaatgccaactacggcggaatccctcccactccttatatctttctgtatacattgaatttgtatttagtaaaatgcagacaacaccacggatcggcttttggctggacaattccaaccaaacaccacagcagacagcagaaaacattctgaacgctaggaagccggtatgattgttacatataaggggaagaaaaatttcttttaggtacttgctttcctaaaactgatgtgatacaatgatttaatccagaaaaggagtaaaaaatatgcggcaaggtattcttaaataaaactataatcaaatagtgggaacaaaggattatgatagctccttttgtaggggcttagttttttgtacccaatttaagaatacttttgccttatcaattttgacatatccccaaaaacagcaatcacaaacaggtgtatgctgtatatgtgtatgtccgcaacttataatccccagtggtaaaagtattttactgctggggatttttatgccctttggggctgtaaagggaggacaatcacatgaaaataatcaatattggaattcttgcccatgtagacgctggaaagacgaccttgacggagagcctgctatatgccagcggagccatttcagaaccggggagcgtcgaaaaagggacaacgaggacggacaccatgtttttggagcggcagcgtgggattaccattcaagcggcagtcacttccttccagtggcacagatgtaaagttaacattgtggatacgcccggccacatggattttttggcggaggtgtaccgctctttggctgttttagatggggccatcttggtgatctccgctaaagatggcgtgcaggcccagacccgtattctgttccatgccctgcggaaaatgaacattcccaccgttatctttatcaacaagatcgaccaggctggcgtggatttgcagagcgtggttcagtctgttcgggataagctctccgccgatattatcatcaagcagacggtgtcgctgtccccggaaatagtcctggaggaaaataccgacatagaagcatgggatgcggtcatcgaaaataacgatgaattattggaaaagtatatcgcaggagaaccaatcagccgggaaaaacttgcgcgggaggaacagcagcgggttcaagacgcctccctgttcccagtctatcatggcagcgccaaaaatggccttggcattcaaccgttgatggatgcggtgacagggctgttccaaccgattggggaacaggggggcgccgccctatgcggcagcgttttcaaggttgagtacaccgattgcggccagcggcgtgtctatctacggttatacagcggaacgctgcgcctgcgggatacggtggccctggccgggagagaaaagctgaaaatcacagagatgcgtattccatccaaaggggaaattgttcggacagacaccgcttatcagggtgaaattgttatccttcccagcgacagcgtgaggttaaacgatgtattaggggaccaaacccggctccctcgtaaaaggtggcgcgaggaccccctccccatgctgcggacgacgattgcgccgaaaacggcagcgcaaagagaacggctgctggacgctcttacgcaacttgcggatactgacccgcttttgcgttgcgaagtggattccatcacccatgagatcattctttcttttttgggccgggtgcagttggaggttgtttccgctttgctgtcggaaaaatacaagcttgaaacagtggtaaaggaaccctccgtcatttatatggagcggccgctcaaagcagccagccacaccatcgatatcgaggtgccgcccaacccgttttgggcatccataggactgtctgttacaccactctcgcttggctccggtgtacaatacgagagccgggtttcgctgggatacttgaaccagagttttcaaaacgctgtcagggatggtatccgttacgggctggagcagggcttgttcggctggaacgtaacggactgtaagatttgctttgaatacgggctttattacagtccggtcagcacgccggcggacttccgctcattggccccgattgtattggaacaggcattgaaggaatcggggacgcagctgctggaaccttatctctccttcatcctctatgcgccccaggaatacctttccagggcttatcatgatgcaccgaaatactgtgccaccatcgaaacggcccaggtaaaaaaggatgaagttgtctttactggcgagattcccgcccgctgtatacaggcataccgtactgatctggccttttacaccaacgggcggagcgtatgccttacagagctgaaaggatatcaggccgctgtcggtcagccggtcatccagccccgccgtccaaacagccgcctggacaaggtgcgccatatgtttcagaaggtaatgtaaagatacataatcgtcaagacggcaacaatcagaagttatggagggtaacaatggaatatagtaaggaagatttaatggaagcaaaaaagcaaatttggggagtgggagagaacatgggaacagaggaaagtaaaaaaatctgggaggagaacgcacaattttgggataatgcaatgggtgacgaatctaatgaatttcacagagaggtagtgcgtcccaaagtaacggaacttctatctcctaatcctgcggattacattttggatattgcgtgtggcaatggaaattattcttcgtatcttgcacaaagaggcgcttcggttgtcgcttttgattacagcaaaaaaatgatagaattggctaaaagacggcaatcacaatatgcaaaacaaattgaattttgtgtggcggatgcgaccgatagaaaaagtatattagaattaaaaagaaatcgagcctttacgaaagcagtttctaatatggcaattatggatattacggatattgaaccacttcttatggctgtttatgaactgttgcaggaaagcggaatttttgtctttgcaacgcaacacccttgttttgtcacgttgactgaaaaatatatgacaccgcacagttactatgatatagcgattgaagggcaaccgaaagagcagatttattatcatcgttccatacaagatatttttaacctttgttttagagctggatttgtcattgatggattttatgaagaatgttttaaaaccaacaaagaaattcctatggtaatgatagtaaggcttaagaaggtaaaacgtgatagcttaaaataaattcaagttgatatttcacttattttaggaaatttaataactgttatagttgattatcaaattcctcacaaacccttgaaaatactaagtttgtagcaagtgaactttcccttactctttcccttgtattatattctctcattggttttcatgaaccttaatatgggaaaaattaagggaaagaaaaattcgtacatagtataacatataacaataacgacatggtgaactgaatgaaatgttttcgatatttaactctgtaaatgattattaaaaaatggagataagatacaatgagaacaatttatgcagaatacaacataaaccacgatagtattgatgtttacacaagtgccggatatatgcttcgcattaattgttgggaagctgaaaaaaatttaaaaaccacatatggatcagaatgtgcgcttacttcattggctgtggatgagcctttggaatatgcaagattatatcttgatggcaatttacagatgtgggtggatgcagaagattcacttgaattataggcaatttaaacaaaagtttatatctgattttcgattatccatatgaacactttactttcaagcattttgagaaatatagaaaaacgctaattttaccactaataaatgagccttgatatgacactaaaaacaatatgggagatagcacaatatctgtgtatctcccgtttttcatttttgtaatataattacttcactctaatttttatattttcttatttttcaataatcataggacttatttctaaatctgccatagactgctttgtttggtatggctttcgggatatgattacacacatcatagtgtggatagtaatagagcataaaacatgtagagtaaggttgctacaactcatattgccatatataataactaatgacatcgaaaattaaagaaattgattagaaatagatttttgtttgataatcttaaatcagatattcacaatggaggcatatttatggcgcagagtattttaattgtagacgatgaaaaagaaattgtatcaatgctgtattgctatttcagcaaacttggatatacggtatatactgcaacagcaggaaatgctgcattaaaagaagtagaaaaaaaacctgacattattttgttagatgtcaatatgccagatatagatggatttactgtttgcgaaaggatacgggattatgtttcatgccctataatttttttaacagcacgcattgaagatagtgataaaataaaaggattttctattggcgcagacgactatgtaataaaaccattttctgttgatgaattagaagctcgcattgcagcacatcttcgcagagaaaaaagacacaatatatcttcaaaggtgcaatttgatgaagatatggttatagattattcctcacgtattgtgttttatcataataaggatatggcttttaccaaaaaggaatttgatataatatctttcctttcgcaaaacaaaggaattgtttttgaccgggaaactatttatgaaaaagtttggggattagacggcattggtgataatacagttgttacagaacatatcagacgtattagggcaaaatttttatctttaggcgatagaccttacattgaaactgtttgggggtgcggatatagatggaaaaattaaagagaagcagattgttcaatcggttaaatagcatgagtattagaatgacctttgttctttatgctttgttttcgttgttgattggaataattatttgtatacttttaatttcaatggttgacagatacagaataaatttaaactataagtatgaaaatctgtcaacgaggtatgatataccggaaaatggctcatttaccgccacttatagtaatgaccaaacaaaatacacaatatttgacacgaaaggaaacgagatatgcaagttcaatgttgattatcaaaaagaacgcccagtacacgaatatgtctatccgaaccatgtttcatatatcgaagttttacctaattttacaaaccgggataggcttattgacagtgctttaggttcattaaatattgcaattattcctatcgtattatctattagtatgatatgttgtgtaacatttttttataaaaaaaaattatcgaaacctattaagctattaactaatgcgtatcataaaattgaagcaaatgacttagattttacgttatcatatccattaaatgatgaaatggggaaactttgtcatgcctttgaaaaaatgaaagactgtttgtcgaaaaataatgaaactatgtttcgacaatttgctgaacagcgccgtctaaatgctgctttttcgcatgacttacgcactcctttgactttactaaagggtcatgctactatgctgctttcctttattcccaaaggcttagtatcacaacaagaaatattagatgaaatatcagtaatgtcaaaaaatatttcacgtcttgaaaaatatgtaaatgctatgacgaacttatacaggttagaggatattgatattccacgacaacagattacatttcattcacttattgataattttaataacacagcagaagcactttgttatgacaaacatttttcaattactacaagcggtaataatataaccttgtttatcaatttagatacagtcatgcagatttatgaaaacttactctctaatagtattagatacgcaaaaagtgatattgctattagcgtagtaatagagaatgataatttagttatatctgtttcagacgatggttgcgggtttaaaaatattgatattgaaaaggcgacattaccattttataaatcatcgaaagatatagctactgaacatttggggttagggctgaatattagtaagattttaagtgaaagacatggcggaaatatccaaattgctaataataaagcagggggagcatgtgttacagtgaaaataaattgcaatgaaagttgattgaaaatagacattttattgctattataaatttaaaagaaaggagataaggacaaatgaaaaaaataatatgtatgtttctaaccttattgttattggtgtgtattgttgggtgtagtcaagcaaaggacagtgataatcatgtagtacaagattattccgaagaatatgaggtttctccttatggaagtgaagaagcgcttgacactttgggcgatttgaagatttcaatgagtacagaaaaggatttagacttaaagcacctttcatttctaatagaaaatacttctgataaagaataccaatattcaccagattattttgaaatagaagctgaacaatccggcacttggtatcaacttaaacagcttgatgacccctcaaagagcaatgaaaaggattgctttattaagcctaacgaacgattaacattagaaattgatgttaaaagtttttatggagaattgcctgctggacactatcgtttgattaaacaatttgcgttctttgaaagtgaaagagattgggattacgatacatataatttatcttgcgaatttacgataaggtaaaaattctctacttcataagcatgaaaaaaaaccgcttatgaagtagaaagttctcatgccattttaacggcggttttgaaataacaatcaaaaccgccgttttcttttgtaaaaatgagaatacggagggtgtgttaaagtcgccctttttcaaggatacggtggtatcaaggaggtattgccatgtccttttttatgtaccatgtggagcatatttatgtctaggaagaaatacagtaaagcattcaaactaaggcttttaaaaaagcataatgaaacaggcatatcctactagaaattggaaaaggataatataatagcaggggacgatgtgtgtttttatcccctgcttttatacgttttttatcatattttgattaatatagcttggtatttaactgatttttcaaataacatctaagtccaacatatactccttgcgaaagtacaaaaagcaatagaagatttactgacagtgtttttttgatggattctccaaaataaatgatgacagcagcacttgtcagtatcatcagtagagtaataaaatcccaacagtttttcttatataattctataacctttatttctatcagtatcaccagtatccctgttcctgctacgcatattccgacaaccaatatcagcaataaccaatatatgattccggctataaacgcatttggaattttggtactaatctgtgccgcagaatgtccggcagcaatcgtccatccgataaaagtttgtatgaatgacgctgcatcatggaagaatgatttacaatcggaaaggaacacatctgactgtactgcctgaaaaagagtggttgtcagcgaataccatgcaagaaggaacaaggttgtttggaatattaccgtttttgctttatactgtcctgcaagtcgctctttttgtgtttcgtatttcgctttttcattctgataggctgtccggtcacaggcttcacatttttcatagagcaccggcttttctaccggtatctctacgattttctgatgtgtccgggcataatcccgttgttgtgttaagcatcgtattttatcttgacattcccctatcgtgacgtttgcgcttcgcagcttctctttctcgatctgcaatgctctgtctgccagcttcaagtcgttctttaatgcttgaatattcccggctctgttctctttgtttaatttctcgttcaaggtcagagattcgctgagctgcgtcttcagttccacgataagctgttctttctgttctagttcttcttgtatctcctcggtcaagagcagaagttcttccaactgttcggcgttctttgattctctggattcgttcatctatatcacgtcctttctctatctgctgttccagttcagcaattcggtgttctgtttcagtaataaactgttttcgctgttcagcttctgtgccaatttctgccattgctgattttcgttttccaaaagctctatcttcgttttctgttcttccatcttggaaagcagttcctcggtatttggcaaaatgttgagcagctcggataactcgttgtttaatttttgtaatttctgattctgtttttgcataagagagagttgagtgtcccggttctgcatttccagaatcatttctgccattaggttctgctgttcttcgatttgaccaatcatggattccattaagggtataatttcccggctttcttctaatgtcatttaatcgctccttccataatgataatgcacccgatactttcccaaaggtgtttagtatcttttgcaataacgtgttttgttgttttatgatttgattttccgctactttccacgagccttttatttcctgcccggcaaaaaacttttgttcaatctttcttgcgtcagctccttcatggatggtaggaatctggagttttccctgcttttcataagaacgatgatcgacctgattatgcaaaggcagatgttcattacatacctttgcccattcactccgccacagttcacaattttttggattgttccatccagtagcatcggtcagcacccgtttccattgcaggcggtttcttgctccaatcttctgaattccgttttcgtctaatacagggatacggattccatgacggtcagggtttttcttatcctgccaccagttcggatgggattcatcaatcacgatatttccgcttttatctctgacaaaatcccaatctttgacttctttcttcccccaagaatgatccgggttaaaagggcgcattgtcagaagcagatggacatgggggttgccatcccctttgtcgtggatactccaatcagcacacattcccttatccacaaatgtttttttgatatagtcggctgtatattgaatctgttcctgtctgctccattctttggggagggcaaattcaaatgacctgccaagttgggcatctgcacttttttcaatcttcaatacctcattccataaccgttgtttctgaaatgtgattttaaatttttctaaagcagcttctttatcttctgaccttttgtatcggacagatttttgaaagcgttttatattttcttctggtactatctgccattcaggaggtgcgttttcgcacatcatcagactggtgtagaccacttcttttttagaagtgtaataactgattcgcccggtttcctcgtttttcatcacatccccattgagatatgcggaagcggagataacagatttccctttacttcgtccgactattttgattgtgtaatgaaaaatcgccatgtctggattccccctttctgcacatccggcatagatttccggcaacattgctttcagttttagaaaaagcagtattgccggaacgccctctgcgtaagagtgccctgcgcatagcagcctgcatggaatgcgcccctctggcgaagagtgcctcctgcggcatgagcaggtctggctgaaagccccgccgacggaacgagcccggcaagcgtgagcgaagaccggttgccacttgtggcaaacttattgggacgacctctggttgtccataagtgcgcccccttcatgaaaaagcaatgaagggaatgaaaaactcatccccccccgccattacacttcctccatatcggtatgtgtttctttctgcattgcctttgaaaaaaatttcccattggcttcctgctttttcagaaaaccaatcagctttgggatgtcctcttcctcgataggcgcaccgagaacggattccaccgcaccgccaacctgacagagcctatgggttcgttttttactttcttcggctttctttcgtttcagaagttctttcttctgtgctgcatatcgttttgctttttcaaggctttcctgttccttcttttccatttcaagcattcgttcttcataactttttgttgattttgccatgattacattcccctttcttttacaaacataagttctcggttgcgtatcagaagaagcacatggtataatcttcttgcgtgtaggtatatcatggcttcggtctgatagaacctttggcggtttctttggaagccgcctttttaatttgccgcagttcttgttacggcttttacatttcctctatccctcaaatcacgaccttcattcgcttccataaacatttccagaatatcggttttaatcaggactttgcgaccaacctttaatactggaagtttcttccattctacaagctgtcttaaggtgtttctgccgattcccgtatagtcagcagcttcttcgatggataatgcaatttttctttgcgtcatataatcacctccttataaattgcattatgcaattcttgtgatgtaagtatatccttttcatatctttttgtcaagcgttacgaaatattaaaaataatttttaagttgcatattgcaattacagaaaaacaatgctataattcatacataccgaaaaaggaggcagtcagcatgaaagataaagaactacgcaagctgataggcagcagagtaaaacagcgccgtctggaattgaatctgacacagccttatgtcgcagaaaagatgggtgttaccgcttctacaatcctgcgttatgagaatggttcgattgacaatacgaaaaaaatggtgctggaaggtctttcggaagcactccatgtatccgtggaatggctcaaaggggaaacagatgaatatgaaaccgacattacggataagagagaattacagattcgtgatgcgatgggagatattctggaacagttaccgcttgcccttaccaaagaagaagatgctttttcaaaagatttattactgctgatgttaaaacaatatggtctgtttttggattccttccagttcgcctgcaaaaacttcaagggaaatgctggtcagacggatattgccaaaacaatagggtttgaatcgaatgaggaatataatgagattatgttcttaagggaaatcactcataccatcaatgcttttaatgagatggcagacattgtaaggctctattccaagaaaccaaaaacagcagaacaaaggcttgcaaatcttttatcagaagtcttatacgaagattccgaatcggtatagtaagacaaccggagttatgatatacttacacgcacgaagcatttcatcagttccgattgtctaatatcgaaaggagacatacgattatggcaaaaggatctgtaagaaaaaaaggaaagaaatggtactaccgcttctatgtagaggacgcaagcggcaatcttgttcagaaagaatgcgttggaacagaaagcaaaagtgaaactgaaaaactgctccgtcaggcaatggatgattatgagaaaaagaaatttgttgccaaagcggataatctcacagtcggacagcttttggatgtgtgggcagaggaggaattaaaaacaggtacgctcagcaatggtacggtggagaattacctcggaacaatccgaaatattaagaaacacccattggcagaacgtaaactgaaaaatgtaacctctgaacatttgcaatctttcttcgatttgctttccttcgggggagttcatcccgatggaaaagagagaaagggttacagcaaagattacatccattctttttccgcagtcatgcagcaatcattccgctttgcagtatttccaaagcagtatattacgttcaatcctatgcagtatattaaactgcggtatcagacggatgaagtggatttgttttctgatgaggatatggacggaaatgtccaaccaatttcacgagaagattatgaaagactgcttgcttatctgcaaaaaaagaacccagccgcaatacttccaatccagatagcctattatgccgggcttcgtattggagaagcctgtggtttggcatggcaggacgtaaatctggaagaacaatgccttaccataagacgcagcatccgatatgatggctcaaagcgcaaatatatcatcggaccaaccaagcggaaaaaagtaagggttgttgattttggagatacactggtagagattttccgtaatgcccggaaagagcagttaaaaaatcgaatgcagtacgaagaactttatcacacgaactactacaaagaggtcaaagagaaaaacagagtgtactacgaatattattgcttagacagaacgcaggaagtcccggcagattataaagaaatttcttttgtctgcttaagaccggatggttgtctggaacttccgactactttggggacggtatgcagaaaggtggcaaaagcattagagggatttgaaggctttcatttccaccagttacgtcacacctatacaagcaaccttttagcaaatggagcagccccaaaagatgtacaggaattgttgggacactcagatgtcagtaccacaatgaacgtctatgctcactccacaagagatgcgaaacgaaaatcggttcggcttcttgataaagtggtaggcaatgactaaaaaatttcccttatttcccttgtgattatctcataagggcaaaaataagggaaactacatatcatttcactaatgaacaggcgggaaagcctgtaaaatagggaaagttagaggaataattatataaattcaagtttgtcagcttcacatcgggtcaacttgccccgaacttttacaattaaatacccgccgcccacatagcggcacaccgagcaggaaatctgaaaaaggtctcctgctttttttctgccaaaatgaggtggtaaaacgccaccccatccaccaattaccgaaaggagggacacgaaatgccctgcccacacaacgaaatcacgattgttcagcgcagccagcgacagtctgcggttgccgccgctgcttaccaaagcggcgaaaagctgttctgtgaatacgaccagcaagtgaagcactacccggaaaagcgtggtattgtccacaatgaaatcctgctcccacctaatgccccacaggaatatgcagaccgcaatactttgtggaacgccgccgaagcggtggaaaaacaatggaactcccagcttgcaaggcggtgggtgcttaccatccccagagagataccgcccgaccagtatgctgtccttgtccgggagttttgtgagcagcagtttgtttccaaaggcatgattgctgattttgcaatccatgacccccatccgccgggacacaatccccacgcccatgtcatgctcactatgagggcaatggacgaacatggaaaatggcttcccaagagccgcaaggtttatgaccttgacgaaaacggggaacggataaaacttccgtccggcagatggaaaagccacaaggaggatacggtggattggaacgaccagaagtattgcgaaatctggcggcatgaatgggaggtcatccagaaccgctatctggaagccaatgaccgcccagagcgtgtggacttgcgttcttatgccagacaggggcttgatattatccctactgtccatgagggagctgctgtccggcagatggaaaagcggggtatccagacgaacatcggcaacctgaaccgggaaatcagagccgccaaccgcctgatgaagtccatccggcagcttatccaaaacctcaaaggctggattaccgagctgggagaaaaacggaaagaactgcttgcacaaaaggcggcggaggaagcgacacttcttcccaatctactgatgaaatatatggagatacgaaaggaagaacggaaggactggacgaggtctggacaaaatcgggggacttcacaggacttaaatgcagtcagcgaagccctgtcctatctccagcaaaaggggctttccactgtggaggacttagaagcatttctggaatcttccgggaaatcagccgcagattaccgcaatcagatgaagccaaaggaagcccgaagcaaagtgattgacgggattcttgccagccggacagactgcaaggaatgtaagcctgtctatgagaagtaccagaagatattttttaagaaaacaaaggagaaattcaaacaggaacactcggaggttgcccggtatgaaaaagccgccacccaccttgccaagcacccagatgataaggacagtacccaaaaggagctgcaagaggagcaggaaacgcttctggaagaaatcgcagagttgaaagtaccactgaccgaggtacaggaggatttgaagaagctgcgggacatccgctactgggtacggaaagccacacccggcacagaggaaagtaaagagccgcctaagaagcagcccatcaaggaagtcttgcaggataaggcagacgagaaaaaggctcaaagaaccgccccggcacaggcgaaacacagacaacaggatatggaactttaacaggcacttgccattttcaatcagagaatgtcaggtgcttttcttattttcaaggagggatagatttgaatgtatttgaagctgtgaagcagtccgtcacaacaagacaggctgcggagcattatggaatccatgtaggtcggaacgggatggcttgctgcccgttccataatgataaaaccccaagcatgaagctggatcggcgttaccactgcttcggctgcggtgcggatggggatgtgattgattttgccgccgccctgtatgggctgggaaagaaagaagccgccgtacaactggcaaatgactttgggctttcctatgaggactggaaaccgccgggaaaggcaaaaaagcccaagccccggcagaaatccccggaggaacagtttcaggaagcaaagaaccgctgcttccgtatccttgccgattatctccacttgcttatggcatggagaacggaatatgccccgcactccccagaggaagcctttcatccccggtttgtggaagccttacaaaagcaagcccatgtggaatatctgctggatgtgctgctgttcggggagacagaggaaaaagcggctttgattgcggactacggaaaggatgtgatacagcttgaacagcgaatggcagagcttgcagccgcagacgcagcaagaactaaaaaacaccatgaacgccatgcagccgccccagagcattgaggaaatcaaggcggggctggaaaccaccgagaaaggcggtgtccgccagagcatacggaactgcctgaccgtattccagcgtgaccctctgctttccggggctatcgcatacaacatcctgaccgaccgcaaggacatcataaagcccatcggttttcacagagaaagcacagccctgaacgatacggatatgaagtatctgcttctctatctggaagaaacctatgggcttaccaatgagaaaaagattgataatgccatcgggattgtggcgaatgaaaacaagtaccatcccatccgggactacctaagtgcccttgtgtgggacgggacagaacgaatccgtttctgtctgcggcactttctgggggctgacgcagacgattacacctatgaagcgttgaagctgttcctgctgggtgcaatctcacgagcctttcagccggggtgcaagtttgaaatcatgctttgtctggtaggcggtcagggggctggaaagtccaccttcttccgtctgctggcagtccgggacgagtggttctccgatgatttgcggaagctggacgatgacaatgtgtaccgtaagctgcaaggtcactggattatcgaaatgtcggaaatgatggcaaccgcaaacgccaagagcattgaggaaatcaagtcatttttaagccgacagaaagaggtttacaagataccctatgaaacccacccagcagaccgcccccgtcagtgcgtgtttggcggcacttccaatgcccttgacttcctgccccttgaccgttccggcaaccgccgctttatccccgtcatggtgtacccggagcaagccgaggttcacattttggaggacgaagccgcttccagagcctatatcgagcagatgtgggcagaagcgatggaaatttacagaagcggcaggttcaagctggctttcagccctgccatgcagcggtatctcaaagaacaccagcgggattttatgccggaggacaccaaagccgggatgatacaggcgtatcttgataagtacaccgggagcatggtctgctccaagcagctctataaggaagccttgaaccatgcctttgacgagccgaagcaatgggaaatccgggaaatcaacgagattatgaaccagtgcatttctggctggcggtacttcccgaacccaagaatgttttccgaatatggcagacaaaagggctgggagcgtgaaaacccggcaacggactccggcaacccgtctgaaaaaacgatggacggttttgtggaggtcacagaacagatggagcttccgttctgaaaatggcagcccgttgcaccccctgttgctatcccgttgccgagccggttgccggggaaaatcccgaaactatcggcttttctcccctatgacaaccaaaacaacagaaaaataaaagaaaagtataaatagtaaccatcgccagattgagattgtttgcaaggtcttttgaagcccgttgccggacttcgttgccgacaccctctgtctggctattttcatgtatggaggataactgcctatggcaaaaaacaaaacagagattcatgttacaacggtatttgacggggaactggacgcaaccgatgtgttcgtcagcctgatttcccagaaatacggtaagacaaatacgaaagaatatcttgctaaaaggaaagatatgagctataatgaagatgaggttcaaaagagccagataccgtctggattgtgtgggtaaatggctatgatgaacgaaatggaatacagaacaatcggttcggcacttgccgggggctatcgtgcagcggtctattgcaggctgtcaaaggacgatgaccttcaaggcgaaagtgccagtatcgcaaaccagcgtgatatgctggaaaaatactgcgaaaagcagggatgggaggttgtggcagtctatcaggacgatggtttcacaggtcttaatatggagcgtcctgatttacagagaatgttgagagccattgagcgcaggcaaatcaaccttgtcatcacgaaggacctcagccgactggggcggaactatctgcaaaccgggcatttgattgaggattttttcccaagaaacggtgtacgctatatcgccatgaatgacggtattgacaccctgcgtgataacaacgatattgccccgttcaagaatatcctgaacgagatgtacagcaaggatatttccaagaaagtccattcctcttatcttctgaaagcgcagaaaggacagtttaccgggtgtcttgccccgtttgggtatcggaaagacccggaggacaaaaaccatctgctcattgacgaggaaaccgccccgattgtgcggctgattttcggatatgccctgaacggtcatggtccgaactatatccgcagacggctggaggaagaaaaaatcccctgtcccacatggtggaaccgggaacgggggcttcgcaatacccgcaccaaatgggaaaagaaagacccggaaaacgggcggtatatgtgggacttctccgttatcaaagaccttttgatgaatcccgtctacaccggggcgattgcttcccagaaaaaggactaccgtttcaaaatcggcacgattggggaaaagaagccggaggactggattgtggtggaggggcagcatgaaccgctgattgacagcatgagctttgacattgtgcagaataagctgaaatcccgccagcgttcgggacagaccaatgaaatcagcctgtttgccggactggtaaaatgcggcgagtgtgggaagtcgctgacgatacgctacacaaacgcaaaacatccccagcggatttattcctgcaagacctacaacgcctttggaaagaaccactgcacccagcaccggattgattatgacaccctttacagccatgtgctgcggaaaatccgggaatgtgccagagctgccctgatggacggggaagcggttgccgaccgcctgaccaatacctgtgaagccgagcagcgggaacagcgggaagcaatggaacgctcccttacaagggacgaggaacggattgaggttctggacaaaatggtcatgcggctttatgaagatatgattgcagggcgtatcagtgagcagaatttcaacaccatgctggaaaagacacagaccgagcagacggagcttaaaacaaaagtgtccgagggcagaaagcggctgttcgatgaagtccagcttgccaatgatgcaaaacaatgggtggaagccattcaggaatacgccaacatcacagagctggacgcagccacccttaaccgcttaattaaagaaatcgtcgtgcatgaacgcattgacgaagataaaacaagacacatttctatcgaaattcattttaatctcaaacccatcccggaggtggaacaggtcactgcctgacctgtcccgccgggacggttctcttaacaacaccatatagattttttgtacgccgccgcccgccatcgagcagagttttacacctaattggggataaaacagctcatggccggcgccggtgtagccgtagtcggcatggtccttgtacctctgctctccgggctgttctctgtctaagcgttcctgcatgaaatccttgccgctcccgcagttctgcgggggcggcggaaaggaggttgacaccgtatggatttcttacttgaagccctgacaaattggctgaaagaaatgctggtgggcggtattatgagcaacctttcggggatgtttgacagcgtaaaccaacaggtcgcggatatatccgtacaggtaggacagaccccacagggatggaatggcagtattttcaatatgattgagaatctgtcaaactccatcatggtgccgattgcaggtgtgatcctggctatcgtgatgaccgtagacctgatccagatgattgcagacaagaacaacctgcatgatgtggatacctggatgattttcaagtgggtgttcaaatcagctgccgccatcctcattgtcacaaacacatggaatatcgtgatgggcgtctttgatatggcgcagagcgtggtggcgcaggcggcagggattatcaattcggatgcgtccattgacatttcctcagttatgaccgatctggaaccgaggctgatggaaatggatttgggaccgctgttcggactgtggttccaatccctctttattggcattaccatgtgggcgttgtatatctgtatctttatcgttatttatggccgtatgatcgagatctaccttgtaacttcggtggctcccgttccaatggctgcaatgatgggcaaagaatggggcggtatgggacagaattacctccgatccctgctggcactgggctttcaggcgtttctcattatcgtctgcgtggcaatttatgctgtgctggtgcagaacatcgctatggaagatgacatcatcatggcaatctggagctgcgtgggctacactgtactgctatgttttacgctgttcaaaaccggcagtctcgccaaatcagtctttcaggcgcactaaaacggaaggaggtttccacattggcttatgtacccgtacccaaggacttaacaaaagtcaaaacaaaggtcatgttcaatctgaccaagcggcagcttatctgcttcacgggcggagcgcttattggcgtaccgcttttctttttgctcagaaaacctaccggaaacagtgtagcggctatgtgtatgatgctggttatgctgcccttctttatgctggctatgtacgaaaagcatggacagccgctggaaaagatcgtgggcaacattctcaaagtagctgtgatccgtcccaagcagcgtccctaccagaccaacaacttttatgccgtattaaagcggcaggaaatgctcgataaggaggtgtatgacattgttcaccgcaataaaaaaatggctgcatcggatgttcggaaaaaccgaggaaaaaactgtgcagccggtaaagacaaagaaaaaactgtcccgcgccgataagaagcagatcgaagcggccattgcccgcgctaaccgcacggacaaaaaaggaaaatctgcgcaggacagtatcccttatgaacggatgtggccggacggaatctgccgcgtatcggacagccactacacaaagaccatccagtttcaggacatcaactatcagctctcccaaaacgaagataagacggcaatctttgagggttggtgtgatttcctcaattattttgatagctcgattcatttccagctgtcttttttgaaccttgcggcatcggaggagacctttgctaactccatttccatcccgccccagagggacgcctttgacagtatccgcgaggaatacaccacaatgctgcaaaatcagctggccagaggtaacaacggtctcatcaagaccaaatacctgacctttggtatcgacgcggacagcatcaaagccgccaagccccgtctggagcgtattgagaccgatatacttaataacttcaagcgtcttggtgtagctgccagaacgctggacggtaaagaaaggctttttcagcttcatgcggtattccacatggatgaacaactcccgtttcagtttgaatgggactggctggctccttccggtctgtccacaaaggattttattgcaccaagctcctttgagttccgcaccggcaagcagttccgtatgggtaagaaatacgggactgtttcttttttgcagattctcgcaccggaactgaatgaccgtttgctggctgattttctggatatggaaagctcgctcattgtgagtatgcacattcagtcggtggatcaggtgaaagccatcaaaacggtaaagcggaagattaccgacctggaccgcagcaagatcgaggaacagaaaaaagcagtccgtgccggatacgacatggacatcattccatctgaccttgctacctacggcagtgaagcaaaaaaactcttgcaggatttgcagagccgcaacgagagaatgttccttttgacctttctggtgctgaacacagcggacaatccccgtcagcttggcaacaacatctttcaggcaggctctattgcccagaagtataactgtcagctgaccaggctggacttccagcaggaagaagggctgatgagctgtctgcctctgggtatcaatcagattgagattcagcgaggactgaccaccagttccacagctatctttgtgccctttactacgcaggaactgttccagaacgggaaagaagctctgtactacggcatcaatgctctgtccaacaacctcatcatggtggatcgaaagctgctgaaaaatccaaacggcttgattttgggtacgccaggttccggtaagtccttcagcgcaaaacgagaaattgccaactgctttttgcttaccagtgatgatgtcattatctgtgacccggaagcggagtacgcacctcttgttgagcgtctgcatgggcaggtcatcaagatctcacctacttcaaccaactatatcaatccgatggatctgaatctggactattcggatgatgaaagcccgctgtcactcaagtctgactttatcctcagcttgtgtgagctgatcgtgggcggtaaggagggcttgcagccggtgcagaaaaccattattgaccgttgtgtacggctggtttacaacgaatatctcaatgacccaaagccggagaatatgccgattttggaggacctttataacttgctgcgggagcaggaagaaaaagaagctcagtacattgcaacggcattggaaatctatgtaacgggttctttgaatgtgttcaatcatcagagcaatgtggacattgataaccggattgtctgctatgacatcaaggaactgggcaagcagctcaagaaaatcggtatgctggtggtacaggatcaggtgtggaaccgcgttaccatcaaccgtgccgctcacaagtctacccgctactacatcgacgagatgcacctgcttttgaaggaggagcagaccgccgcctatacggtggaaatttggaagcgattcagaaaatggggcggtattccgacaggtatcacccagaatgtcaaagtgcgcccagatagggcgctgtgcaaagcagtctaaggtactgccgcacacggcagtgtgcgaaacaatctgccttaccgactaaggagaaatcctttacgggaacagcgcatggcagaaaaaggaatagtcaccaaaggacttaggtgcgactgttttctaatgttaagaagatatgaggataagattgggtttatcgaatgtaaggttccagttcctgttttttgcaggtgtgggaaaagtcctgaaacccatgtcataacgctgtcacgtcatctttcacggcgggacaactgccaacacgttatgaaacaggcgtgagaacacgtcacaacgaaccgaaagcatatccgacaatcttcactaacctatgcacagtgctaactggggattgcctaagtctggctcatttgccggatatggtaacggaggctccatagtagtccgagagggataacgacccttacatggcgaagggagccagttagtaacatctaaaatgtaagaatgaaagggaggagaaacctcaatgaaaccaacacctgaaattttagagcgtattgaaaagtgttccagcgaacacaaagacggcgtattcacaagactttacagatacttacttcgtgaagatatttactacgccgcctatcagaaactttatgcaaacaaaggtgcaacaacacagggtatcgacaacgataccgcagacggtttcagtgacttctatgtaaaagagttaatccagtcactaaaggacggaacctacaaagccaatcctgtaaggcgtgagtatattccaaagaaaaacggaaagctccgtccgctgggtatcccgactttccgtgacaagctcctgcaagaagttgtcagaatgattttagaagctatctatgaacctgtctttgacagccactcccacggtttcagaccgggtaaaagctgtcataccgcactccgtcagatttcttctgacttcacaggcgtggtctggtttatcgagggcgatatacaaggttgttttgataacatcaatcacgaaaaattgattgagattttgagcaggaaaatcaaggacagtcgttttctgaacatcattcgccagtttttgaaagctgggtatatcgagaattggaaatacaacgccacttacagcggttccccgcagggtggtatctgttctccaatacttgcaaatatctatctgaatgagctggacaagaagtttcgggaaatcgcagaacgctttgataagccgaggtctgcatatcagacaccggaatatcatgcggcaagcaaagaattaaaaagactgtcttattggattgaccataccgctgatgaagcggcaagacaagaactgattgaccagcatagggcacagaaggaagctatgagaaatctgccctgcaaacctgccgacaacaagaagttcacttttgtccgttatgcggacgattggctggcaggtgtgtgcggcacaaaagcggaatgtgaggacttgaaagccgaaatcgctgaatttctaagcacagagctgaaattaactctaagcgaggaaaagacgctgataacgcacagctccgaaaaagtccgtttcattggatatgatatttgcgtccgcagaaatcaggaagtcaaaggtcacagaatgaaaaacggaacgtggagaaaatcccgtaccctgcacatgaaagttgccctgtctgttccccatacggaaaagattgagaaattcatgtttgcaaagaaagtcattcgccaaaaggaaaacggggagtttcagccgatacaccgagccggacttctcaaccttgcggattatgagattgtggaacagtacaatgccgaagcaagaggattatgcaactattacaatctggcttgtgattatcacacgctggactacttctgctatcttatggagtacagttgcttaaagacgattgttaataagcacaaaaccagtatccgcaaaatcattcgccagtataaagacgggaaaacatggtctgtcccttatgaaactaaagcaggaacaaaacgtgttcgccctgttaaaatcgcagattgtaagcgtggcgaagcgagtgacatcatttatcagagaaagaaattcagctggaaaaccactattagacaacggctcaatgccagagtttgtgaactatgtgggtgtaaagaagccgatttgtatgaggttcacgttatacggaacttaaacgaattgggtaattctgattgggaaaccgtgatgaaaaagaagcggcggaaaacgcttgttgtttgtagcaagtgccatgaaagaatacacagacactaatcaatacgttaattactaatggggagccggatacttcgagaggagtaagtccggttccgagggagggtgtaggaaacctaccgccaacggcggcaaggcgcctttaccctaccctacgaccttttgagcagccgcgaggtggaaaatatctttgaaaattctgacttcgtgtatatgctcaaccaggcaggcggagaccgtcagatcctcgccaagcagctgggtatttccacacaccaattatcttatgtgacccactccggtgagggcgagggcctgctgttctatggctccacgatcctgccgtttgtagaccacttcccgaagaacaccgaactttaccgcattatgaccaccaaacctcaagaattgaaaaaggaggatgaatgattatgaaccccaacattttgaataaaaacccgctgatgttttttgacagggcggtaaatgcccagcgcagccagctgcttacggtcatggccgatgcggtaagtgagtgccgcacggcggcagatcaggcagccgaactgaatgagaccggtcaggtggggctgctccgtctggcagaggtctggagcaccatccgtgccaaagaaggtatggggggactggttctggaaggaaccgaagcgaagattctgtccgatgtggtggcacagttttatgcctacctgtccggctgtatgttcaacgatccggtgggaatggccatttatgcagagctgcactacatgatgtcctccctcatgctgggagaatggtttgaataaggaaccgcgcctgcgctttactgatgaggaacggtctgaccctgcactggaaaagccaatccgtaaagcggagaaagctgcggccagagcagataaggcgcaggccaatattccgaagaaaaaggtcaggcagacggtcattgacccgaataccggaaaaaagacctcgaagctgacctttgaggacaagaaaaagccaccttccaaagtttctcaaggagtcagggaagctcccgtccatctggttgcgggcaagctccacaaagagatccgggaaacagagcaggacaatgtgggcgtggaaagcgcccacaagtccgaggaagcggtggagactggcgcttatctggtgcgggagggctatcgcagccacaagctgaagccgtaccgcaaagcagcacaggcagagcgtcaactggaaaaggcaaatgtaaatgttctgtaccagaaatctttgcaggaaaatccccagtttgccagcaatccgttttcccgctggcagcaaaagcaggccattaaaaagcagtatgccgccgccaaacacgccggtcagactgccggaaataccgcccaggctgcatccaaaaccggaaaagccgtaaggacggtaaaagaaaaggcacagcaggcaggggcgttcgtcatgcgccacaagaagggtttcctgatggcaggggttttgttcctcgttacctgtatgctgatgaataccatgtcctcctgctccatgatggcgcagagcatcggttccgttctctccggcaccacttatccgtcggatgacccggaaatgctggcagtggaggcagattatgcagccagagaagtccagttgcaggaggaaatcgacaacattgaaagcagccacccagggtatgacgagtatcgctatgaccttggtatgatcggccatgaccctcatgagctggcagcatttctgtctgccgtcttgcaaggttacacccagcagagcgctcaggcagagctggcgcgtgtgtttgcagcacagtatcagctgacgcttactgaggaagtggagattcgctaccgcacggagacctccaccgacccggagaccggcgagaccacctcagaagaagtcccctatgagtattacattttgaatgtgaaactcaccagcaagcccatttccgctgtggcgtcggagttactgaccccggagcagatggaaatgtatcaggtttaccggcagaccatgggcaataagccgctgttgtttggcggtggttcccctgacatgagcaattccgaggacttgaccggtgtgcagttcgtaaatggaacccgtcccggaaatccgcagttggtggagctggccaagcgtcaggtcggcaatgtgggcggctatccttattggagctggtatggctttgacagccgcgtggagtggtgcgcctgctttgtatcctggtgttataaccaggctggaaaaagtgaaccgcgctttgcaggctgtgagtggcagggcgttccgtggttccagtctcatggacaatggggtgcaagaggctataacaatctggctcccggagatgcaattttctttgattgggatttggatgggacagcagaccatgtgggtatcgtgatcggtacggatggcagccgtgtttataccgtggagggaaattccggcgatgcctgcaagatcaaaagttatgacctgaattatcaaagtattaagggctacggcctgatgaactggtaacagactttgtggaaaggagtgaacggttatggcaaaaaacaaaattgaacgtatcgaccaggaaattgagaaaacccgtgagaagattgcggaatatcaggaaaagctcaagaccttggaagcacagaaaacggaggcagagaatctggaaatcgttcagatggttcgtgcgttacgcatgactccagcacagctgaacgctatgctttccggtggaatgaaccacggcagagatacagcactgtcggaatcaaataatcaggaggctaccgcttatgaagaataaaagaatttgcaaaacactttccgccctttgcctgacaatggttgtggcatttggctttacaatccctgctttcgcacaggggtcagaacaggctccggcggcaccggcagaggattctaccaatgacagcaatgtgattgtggaagaaacagaaccggcaccggcacttacaccggaggggaatgcggcattggtggatgattttggaggcaataagcagcttattactgttacgaccaaagctggaaattacttttacatcttgattgatagggcgaatgaggacaaggagactgctgttcactttctgaatcaggtggacgatgcagaccttgcggcgctgatggaagatggaaaaaccaaagaggagatgcctgcggtatgcagctgttcaacaaaatgtgaagcaggggcggtcaatacggcctgcccggtctgcgcaactgataagagtaaatgtacgggcaaagcaccggaacctccggcagaaacatcggagccggaaaaggagaagcctgccggattgaacccggctgcgctggtacttttgctggctctgctgggaggcggtggcgtatttgcctacttgaagctcgttaagaacaagcctaagaccaagggcaatgacagtctggacgattatgattatggcgaggaagattccgaggaatgggaaaccgaggatgaggagtcggacgaaccggacgttgacgggggcagcacagaagaagatgacgaggacagcgtgaaatgacccgattcacagacagtccctatgaacgcatgatgacacgcaggccggagggcgggaaggaaacttcccgtcctccttctttaccccacagccacccctgctatggttgcgggaattatggaagaccctgcgtaggtatctgtcaccgggaaatgtcccgatggctcaaagagaggaggaaccatcatggctcaacataaattggtaattgccgaaaaaccatcagttgcccagagtttggcggcggtgatcggcgcaaccgtccgtaaggacgggtatctggagggcaacggttggcgtgtcagctggtgcgtgggccacctggccggtcttgcggatgcagacagctatgacccaaagtatgccaagtggcgatatgatgatctgcctatcctgccggagtattggcagatggtagtgggaaaggataagaaaaagcagtttgatattctgaaaaagctgatgaacgccccggatgtgacggaggtggtaaatgcctgcgatgccggacgcgagggtgagctgatcttccgcagcgtctatgagctggcgggttgccagaagcccatgaagcggctctggatttccagtatggaggactccgccataagggaaggctttgcaaacctgcgccccggtgcggactatgacggacttcgggatgctgccctctgccgtgccaaggccgactggctggtggggatcaatgccacaaggcttttttccgtgctgtaccaccgcaccctcaacatcgggcgcgtgatgtccccaacgctggcactgattgtccagcgagaagctgaaatcgacacctttaagccggttcctttttataccgtggcgctggagctgcccggtcttaccatatccggggagcgcatggcggataaagctgctgccgaacagctgaaagaagcctgtcagggtgcaaatgtcacaatcaaaaaggtggagcgcaaggaaaagtccgaaaagccgcctgccctctatgacctgactaccctgcaaagagatgccaaccgtctgcttggatttacggcccagcagaccctggactatctgcaaagcctgtatgaaaagaagctctgcacctatccccgtactgacagccgctatctgaccggtgatatggcagacagcctgccggtgctggtgaatctggttgccaatgctatgccgtttcgcaaaggaatctccatttcctgtgactcccagacggtcatcaacgataagaaagtaaccgaccaccacgcagtaatccctaccagaaatctcaaggatgcagacctttctgcccttcctgcgggagaaaaagcagtgctggagctggtggccctgcgtctgctgtgcgccgtagcccagccctatatctattcggaaaccgttgtgattgcagcgtgtgccggtggggaatttaccgccaaaggaaaaacggtgaagtatcccggatggaaagcactggaggacgcttaccgtgccaaaacgaaggatgcagagccgaaaaaagagggcgtagagaaagccctgccggagctgactgaaggacagaccctttcggtttctgcggcaatcgtcaaagaaggcaaaagcagtccgccccagcactttacggaggacaccctattgtccgcgatggagactgccggaaaagaggatatgccggaggatgccgagcgaaaaggtctgggcacaccggccacccgtgccggtattttggaaaagctggtatctgccggttttctggaacgaaaaaagagcaggaaaacggtgcagcttctcccttcccacgatgcagtttcccttatcacagtcttgccggaacagctgcaatctccgcttttgactgccgagtgggagtaccgtctgggcgagatcgagcgcgggcagcttgccccagaggagtttctggccgggatcagcaccatgctgaaagacctggtgggaacttatcaggtcatcaagggaaccgagtacctgttcactccgctccgtgaggtggtgggtaaatgccctcgctgcggcgttgaagttgcagaactgcaaaaaggcttcttctgtcagaatgattcttgcaaatttgcaatctggaaaaacaacaaatggtgggctgccaagaaaaaacagccgaccaaggctgtggtgtctgcgctgctgaacgatggccgtgtccgtgtgacggggctatattcggagaaaaccggcaagacctacgatgccactgtggttttggaggacgatggacagtatgccaacttcaagctggaatttgaccggcggaaaggaggcagccgatgaagctctctttagtggaacgggaaaccattctcctctataaccaggcagaaccaatggctgaggtctacactcacgatccccgtctgatggagaagctggaactgctggcaaaaaagcaccccgaccagattacccgaaaggacgcccataactttaccgtccccaagcggtgtgtatcagtccgggagccatacagcgccgagcgtcgcaaagctgccagtgagcgtgcgaaagccgccggataccagccccctgtgaaaaagtccggcagttaaaggcacatggcagagaatgtatttgaagcggtcaagcagtcggtcagcaccagagaagcggcagagttttacgggataaaagtcagtcgaactggcatggcctgctgtccctttcacgatgataagaaccccagcatgaaggtagaccagcggttccactgctttggctgtggtgcagatggggatgtgatcgactttaccgcaaagctctttaacctctccccaaaagaagcggcagagaaactggcacaggactttggcctgatctatgatagtcaggccccgccccgcaggagatatgtccggcaaaaaaccgaggcacagaagtttcgggaagatcgacagcgctgctatcgtgtactgtctgattactactatctgctgaaaaaatgggaagccgaccgttctcccaggacaccggaggaagaaccgcacccccgctttgtggaagcaatccagaagaaaccctatgtagagtacctgctggacctttttctttatgaaagtgaagaagaacaaaaggcatggattgcagaacacacagcagaaatcacacacttggaaaggagattgaaaatcatggctgagaataaacccaccaatcgagaacggctaagggaaatcacagatggtatcgagcagggtatcaaagaactgtttgaaagcgaaaagtatatgcgttatctgtccgtcatgtcccgcttccaccgctattcggtaaacaacaccatgctcatctatatgcagaagccggacgccacattggtagccggatacaataagtggaaagaccagtttgagcgtcatgtaaaaaagggcgagcatggcattaccatcatcgctcccacaccgtataagaagaaaatcgaggagcagaagctggacccagataccaaggctccgattctggataaagacggaaagatcgtcacagaggaaaaagaaatcgagattcccatgtttcgtccggtcaaggtctttgatgtgagtcagaccgacgggaaacctttgccggagcttgcttcctccctttccggcaatgtgccaaattatgaggcattcatggaggccctgcgccgcagcgcaccggtgccgattacttttgaagcaatgtccgccgatacggacggctatttttctgccgatcatcagaaaattgccattcgtcagggcatgagtgaggtgcagacagtttcggccacggttcatgagattgcccacagcaagctccatgaccctaaaaaatatgaaatgctaccgtcatggaaggttgtgctggagagtgaaggtggaactaagcatgatttcaagttggattttgccacagaaaaagaagccgaacagtttgcttctgatatggattggcgctatgtggacgaaaatcagtttgaatggcgtcttgcagttgaggaagatgcaaccgcagaaaaacaggtaatcaaaaaccgtcacacggaagaagtggaggctgaaagcatctcctatgcagtctgcaaatattttggaattgagacaggagaaaacagctttggctatattgccagttggagtcagggcaaggaactgaaagagttgagagccagtttggagaccatcaacaaaacctccggcactttgatctccgacattgagcgccactataaggaaatctgcaaagagcgcggaatcgaccctcatgcaaaggtagagccggaacccgccccgatagagcagccagaagatgccgctaaggtatctgatagacagcagaccggcgatctgacctactatgtagcagagtgcatggaatttccaaacctcggagaataccacgataacctgtctttggaggaagcaatccgcatttatcaggagattccggcagaacgaatgaacgggatcaagggcattggttttgagctgaaagacggaagcgactatgaaggaccttttccgattttgaccggccagaccattgacctggacaccatacaggcaatcgactattaccgtgataatcctctggtgcaaaaagcggtaaaggaactggctgcggcaatgccagaaatggaagtgctgggggcggacgccaaccagcaggaggctttgtttctgattgacgatgccacctatcttcatatccagtcctgtgacagcggctgggattataccctttacgatgccgcgtccatgaaagagctggatggtggtcagctggatatgccggagatttcccgcatgaaggcagttctccagatttgtgatgataacgatttgagcagcaattcagtaaagtatgcgcccctgtctatgattgaaaccttgcaggacgctgcctatcagcagatgcaggcagaggtcagtcagatgactgcttcttttcagctgccggaagcacaggagcaggcgctggatgaataccccatgcctgatgagcaggtctccacaccggatatgcaggaatacggctacttctatgatgggatgctccctgtcaccagagaacgggcgctggaactggatgccgctggtttgactgtctatgtgctgcatgaggacaatacggagagtatggtatttgactcgcaggaaatcatggatcatggcggccttttcggtgtggatcgtgaggaatgggagaaaagccctcagttccacgaaaaggtcatagagcgccaggaacatcagcaggaacgggaacaagcatttctcgctcagaacagagattgctttgccatctatcaggtgagccgtgacgatccgcagaatgtgcgctttatgaatctggactggctaaagtcccatgatatttccatagagcgcagcaattatgatctcatttacactgctccgctgagggagtctggcacggtaccggagcagctggaaaaactatatgagcagtttaatctgcaaaaaccggcggattttcacagtccttctatgagtgtcagtgacatcgttgcgatcaagcaggatggtaaggtatcctatcattactgtgacagtgttggctttacccagatccccggattcctgccggaaaatccgctgaaaaatgcggagatggccgtggaggacgattacggcatgatcgacggtatcatcaataatggcgtaaaggaacctacggtagcagagctggaacagcaggcccgcagcggtcagcccatttccctgatggatctgactgccgctgcccatcgggaggaacgggaaaagaaaaagtccgtcatggagcagctgaaaagccagcccaaggcagaacacaaaaagatagcgccaaaaaagagtgcggaaagggagatttgatatgggaaactttacttttgaggaaatgaacctgatgtgcatttacaataccggcagccgcaccggactgatcgacagcctgcgtgagatgcgcggcgagctggccccggaggaaaccgagctgcgggagctgaccgacagcgcccttatgaagctctgcgtgatgaccgatgaggacttttcccagctggagctgtacccggattttgaccagtaaatttatcgtgtaaaaaatatagtgagagaaattgtctgacggataagcgatttctctcactttcatcacaatatcccactatacttagagagatggatgaagtataatctaagcaacaaatttgaagtttcgattgagaataaatgacataattcctaaagaatattggtggctatgtggtaaaaatagggatacttggaattggtaggattgaataatggaatgtaaggtatacaagtttgcacatattagtaaaaaagaaaaaagaaaattacgaaaagcatattatcggaaacaatggtttgatatttcaatttcgtatctatttatactgatgtcatccggtaaggcctttctttcgttaaaaaatggtgcattgtgggtgttggtatggtatacatgttctttattattatcatgttatgcatatgtaaatcaaattgaatataatgtcggtagaaaaagagcgaaacattattcaaaaaagcacccgaattgtacattgcaaaaatcagttagatttagtccagaaattggaggctggaatttattggcaattcaatttctatgtgctcttcctttaacaattggtttgggaatatttgctttcgtatatcaaagttttttttatgaaacgtatatgatgaaatataaagatttttgtataggacttgcactcgatacatatgttctagtgttttttcttatttatttcaatggtttttggagtgaattgagagatatacatggagtgaagaataagattaatgcattcttagttacatttcctggttctaagtgtaaaaatatcatagtacatttagctgccattgttatttgtgtatttgcgttaaggcattatctgctaaatgaattttcaggactatttaatgaagttgtaagaaaagtaattggtatagtgtatatattgtatatgattcttccaatgaaagaaatcaaggattattttcgtgaaataagcaaaacgagaagaagctagtattatttaataaagtcatgctcggttaattgagttatagctttttgtattccaaactatccaaaatgtgtgcagtttgggagcgtaaaattccagtttgtttgtgcattgatgattatcttgaacttaggaggtgtttaatgaaaacggttcttttacatgggttgggacaaactgcacaggattggaaagaagtagtccaacaactatcaatttccgatgtcgattgcccagaacttttttcttcagcagaagatgaaatatcatattcgcagattttgggcgatttagaacagcggtattcagaagtaaaagagccgcttcgtatctgcggtctttcgttaggtgcgcttcttgcgattgattttgctattcggcatgaagaaaaagtggcttcgctgattttgattggcgcacaatataaagttccaagtttactgatagattttcaaaatcttatcttccgttgtatgccaaacaaggcttttgaaagtatgggactatcaaaaagcagcaccataaaattggctcactctatgcggtcattggattttacttcgcaattaaacaatattcgttgtccagtgacaattttgtgtggcaaaaaggatactgccaatctaaaggcttctaaaagactaaaagaattgctacccaaagctactttgcacatcgttccaaatgcaggacatgaactcaataaatatgcaccaaacacgattgcagagatattaaataactaaaatgtaatattcacagtttcacccagcaggaaatctttttggtttcctgcttttcttttacccaaaaaccgaaaggaggacagaataccatgccaaccaaagctgaactatatgcacagatggcggagaaggtggcaacacagctcacggggagctggcaggaatgggcagggtttctcactactgcttcccgcctttacaagtacccgttccatgagcagctgatgatctatgcccagcgaccggacgccaccgcctgtgcggagtacgatttgtggaatgaaaagatgggccgttatgtaaggcgcggttccaagggaatcgctctagtggatgattccggggacagacctcgcctgcgttatgtctttgacatttccgacaccggaacccgtgaacattcccgcactccctggctgtggcagttggaggagcgccatctggattccgtgcaggccatgctggagcgcacctatgatgtttccggtgatgatcttgccggacagctcacggaggtagccggaaaattggccgaggaatactggacggagcatcagcaggacttcttctatatcgttgacggttcctttttggaggaatatgatgagtttaacatcggagtacagttcaaggcagcagccaccgtcagtatcacttacgctttgatgtcccgctgtggactggagccggaacgctacttcgaccacgaagatttcatggcgatctttgatttcaatactccggcaaccatcggagcgctgggaacagcggtcagccagatcaaccaacaggtgctgcggcagatcggcgttaccgtccgaaatgcagagcgcgaagccaaccaagaaaggagcaagcaagatgaacaatcccatgacctacatccagaacggagactatcagattcccgacctgaagctgagccagcagccggagaaacccctgggcaagtacggcaggatgaggaaaacctacctgaaagaacaccgtcccatcctctacaaccagatgttgctgagcgagaagctgtacccgcacctcatcgagatcgacgagaccgcccagagcagactggaacagatgatgccccagctggcgaaagaagcgggagccaccgaggaattgaaagccagcgatcccatgaagtgggtggggctgatgaacaactgcaaagcccaggcagaggagatcctgatggcggagcttatcaacagctgaccctaaacctgttcctctccgaagcggaacagatccaatccatagatgaagcagagaatgtagcgcatacatcctctgctttttcttttgcccaaaatgatattgaccatgtgctgcgtttgggcggcaatacagaccgccagagggagcgtgtggttgcagcctttgaaaagcagaaaaccaccgctgagattgccgagatactgaaaacgctgtaccacggcggtaacggccttggcagtgtgagtgcatggtatgccgaggatggtatccatctttcccacgggaagtctgtccgttatgacaggtctgcccaggtcatttcctgggagagcgccgcagagcgcatcggggaacttttggaaagtggccagtttgcctccaatgtggagcttgcagaagcggcaggctatgaacgctccctccttgcagaaaaactttggcatctgtaccacgatttcagcgataaagccagagattccgggtatctgtcctgtctgtccggtattcagagaaccgggttcccagaagaaactgcatggcttgccgagcagctgagtgacctggctttccgccaaaccctaaaggaagaatacgctgccttctggactgcctatcagcaggatcgtgacctgttgcgctttcattaccataggccaagggaaatctgggagaacctgaaagaccttgacctgccccgcaggactttttcttcggacctttcccaagtgccaaccgtccagcatttcattacagaggatgagatcgacaccgccatgaccggcggcagcagttttgccggaggaaaaggccgtatctatgcgttcttcatggaaaaccatacggataaggaaaaagtgagattccttaaagacgagtatggcattggcggacgctctcatgccctgtccggcgcaacacacagcggcgaagatcacgatgggaaaggactgcactataaaaagcaggactgcccggatgttcacttgaactgggaaaaggtttccaagcgcattacctcacttgtccagaaaggtcgctatcttaccgaacaggaacaagcgcagtatgacaagatccaggctgaaaaggatctggcagaagaagatgccattcaagcccagcagccggagatagaggaagaaacgccaaagcctacccttcgggagcagtttgagcagtataagcctgtggtgactgccgccatatctgaggatgtggcatatcgaaatgcctgcggtcattccgaccgtgaaaatgctgtcatcgagggcaatgccgctgtgcgccgtgcggttcttggctctaaggatatggagctgatccgcctttattctgatataccggagttccgccagcgtttacaccgggaagtgatcgacgaaacctatccaaaactccatgaacttctgcgccctctttcgcaggaagatattgatactgccctttgtgcatggaacggcaatatcgagagtaaacacgctgttatccgctatatgaaagaccatgcaagagaaaaagataccgccgcatggctggctcaggaatacggcggcagtaacagcaacagcctgtttgttgtccgtgccggcagcccggaggaaacgcagctgccctggccgaaggtacagcgccggattgcccagctcattcaggaggaccggttctataccgaagaagaacagaaccgttttgacgacatcgacccaatcgccatccgggaagctctggaagaaagagggatcgtcaacggacaggtgacagacccggaaaaactggacaatgccccgtttatccaacaggtgatgtcagatgcagagcagatcgcagatgccgagacagagcagacttccgaagtttccatttccgatgaggaatatggcgcagttcgccgcccaattccgcaaagaacctcctatgacccagccgccccggtctatgccgtgggcgataccgtgtatatcgaggatgacgcctatcagatcaccgagctacgggatgacaccgtgcagcttctgcccaccggcatgatatatcccatctaccgggcagagcgcaaagaacagttcgagcagttgcttcgggcagatcgccgaaatgcttactataccgagtttcttcccattgacccggacaaggcagatcaagacttgcgggatgtattggcccatggactgatggatgaagcggataaaaagcagatttccacgctgctgcaatccggcaggagcaacagcgagatcgcctactggctgagcagagcctattccggtgagatcgagacactgaatctggagaccggcgatattgtcgattaccgtaccacggcacagggcatagaactggaagtcatggatgcagaggaaaagcgtctggctatgctgtatttccgctgggaagaggttgcgcctttgctgcgcgggatgtatgcccgtcagcaggacggttttggacaggaacagccccaactggctaccgaatccccgaccttccattccgagaccatggccgtctatccgggcgataagaacaatctgccttatgatgtggtggtggaacgactgcatatcgaggagccggagccgccagcccctgtgactgagccggagaaaacctttgaggaagtgctggacgaacacccggtttccattcaggtcaatggccagtggcagacctttcccaatgccaaagctgccgagaaagcctcctatgaggaatacaaggctaacctgcgccgcaatgcaaaaaacttccgcattaccgatgagcatttgggcgaaggcggtccgaaagccaagttccaggcaaatgtcaatgcaattcgtttgctgaaagagctggaagctgccggacagcaggcaagccccgaacagcaggaggttctttctcgatatgtgggctggggaggtctctctgatgcgtttgaaccggagaaaccggtatgggctttagagtatgcccagctaaaagaactgctgaccccggaggaatatgccgccgccagaagctctaccctcaacgcccattacaccagccctacggtcattcaggccatctatgaagcggtggaccgtatgggatttgagaccggaaatattctggagccgtctatgggtgtgggcaatttctttggtatgctgccggagaaaatgcgaaacagccgtctgtacggcgtggagctggaccctgtttccgggcgcatcgcaaagcagctctatcccaaggcggacatcacagtaggcggctttgagaccaccgataggcgtgacttctttgaccttgccatcggcaatgtacctttcggtcagtatcaggtcaacgacaaagcctacaacaagctgaatttcagtattcataactatttttttgccaaagcactggatcaggtgcgtcccggcggtgtggtagcttttgtgacctctcgatataccatggacgccaaggattccaccgtgcgccgctatcttgcccagcgtgccgagctgctgggagctatccgtctgccgaatgacgcgttcaaaaagaatgccggtgccgaggtggtatcggacatcatcttcctccaaaagcgggaccgcccgttggacatcgtgccggaatggacccagaccggacagacggaggacgggtttgccatcaaccggtattttatcgaccacccagaaatggtgctgggcagacaggagccggtaagcactgctcatggtatggactacaccgtgaaccctatcgagggactggagctttccgaccagctgcatgatgcggtgaagtatattcatggcacttatcaggaggcagagctgccggagctgggcgaaggcgaagctattgacacctccattcctgccgaccccaatgtgaagaactattcctatgccattgtagacgggcaggtgtactaccgggaaaacagccgtatggtgcgccctggcctcaacgccaccgccgaagcccgtgtaaaaggtcttgtgggactgcgtgattgtgtgcaggaactgatcgaccttcagatggatgcagcggttccggacagcaccattcgggagaagcaggcggaactgaacagcctctatgacagcttttcttccaaatacggtctcatcaatgaccgtgcaaaccgtttggcctatgcagacgattcttcctattacctgctctgtgcgctggaagtcatcgacgaggacggaaagctggaacgcaaggcagatatgttcaccaagcggaccatcaagccccatcaggcggtggctgtggtggatacggcaagtgaagcactggcggtgtccatctcggaaaaagcctgcgtggatatggactatatgagccagcttaccggaaaaacaaaagaagaactggccggagagctgcaaggcgtaatcttccgtgtaccgggacagctggagaaagacggcacaccccattatgtgactgctgatgaatacctctccggcaatgtacgccgcaaactgcgtcaggtgcaacgggccgcacagcaggacccggtttatgcagtcaatgtggaagcccttaccgccgcccagcccaaagacctggatgcgtcggagatcgaggtgcgtctaggcgctacatggatcgacaaggaatatatccagcaatttatgtatgagacttttaataccccgttttatctccagcgcagtatcggggtcaactattcgtcctttaccgctgaatggcagatcaaggggaaatcttctgtatcctacaacgatgtggcagcttataccacctatgggaccagccgcgccaacgcctacaagattctggaggattccttaaacctgcgggatgtccgtatctatgacaccatagaggacgcagacggaaaagagcgtcgcgtgctgaacgccaaggagaccaccctggctgctcaaaaacagcaggcgatccgggaagcctttagggactggatctggagagacccggagcgtcgccagactttggtgcgccagtacaacgaagaaatgaactctacccgtccccgtgaatatgatggcagccacatcacttttggagggatgaacccggccattaccctgcgggaacaccagaaaagcgccattgcccatgtgctgtatggaggaaataccctgttggcacatgaagtaggcgcaggcaaaacttttgaaatggtagctgcttcgatggaagccaaacgcctgggactgtgccagaaatctctctttgtggttccaaaccatctgaccgagcagtgggcgtcggagtttctgcgtctctatccttccgccaatatcttagtcaccaccaaaaaggactttgagacccataaccgaaaaaagttctgcgctcgtattgcgacgggtgattatgatgccattatcatgggacacagccagtttgagcgtatccccatcagccgggagcgtcaggaacggctcctctatgagcagatcgacgagatcaccgaggggattgcagaggtacaggccagcggcggcgagcgttttaccgtcaagcagctggagcgtaccagaaagtctctggaagccagactggaaaagctgcaagccgaggggcgaaaagacgatgtggtaaccttcgagcagctgggtgtggaccgtttgtttgtggacgaggcccacaactataaaaacctgtttctatacacaaaaatgcggaatgtggctggtctttccacatcggacgcgcagaaatcctccgatatgtttgccaagtgccgctatatggatgagatcaccggaaaccgtggcgtgatttttgccaccggcaccccggtcagcaactccatgaccgagctttacaccatgcagcgttaccttcagtatgaacgtctgcaagaactgaacatgacccacttcgactgctgggcttcccgatttggggagaccgtcacagcattggagctggcaccggagggaaccggctaccgggcaagaacaaggttttccaagttctttaacctgccggagctgatgaacctgttcaaagaagtggcggacatcaagactgccgaccaactgaacctgcccaccccggaggtggaataccacaacatcgtggcgcagcctaccgaacatcagcaggaaatggtcaagactctttcggaacgggcatcgctggtacacagcggaaccgttgacccgtcccaggacaatatgctcaagattacctcggatggccgtaagctgggcctggaccagagaatcgtcaaccagatgctcccggatgaacctggtacaaaggtcaatcagtgcgtggacaacatcatgcagatctggcgggacggcaaagctgacaagctgacccagctggtgttctgcgacatttctacaccgcaggcaaaagctcctgcaagcaaggcggcgaaaacgctggataatccactgcttcacgcattggaaggcgctgtgcctctgccggagcaggaaccggtctttacggtatatgacgatattcgtcagaaactcattgctcagggaatgcctgccgaccagatcgcttttatccatgaagccaacaccgaagtgcggaaaaaggagctgttctctaaagtccgtaccggtcaggtgcgtgtccttttgggcagcaccgccaagatgggcgcaggcaccaatgtgcaggaccgtctggtggcacttcatgacctggactgtccgtggagaccgggagaccttgcccagcgcaagggccgtatcgagcgccagggtaaccagaatcctcttgtccatgtgtaccgctatgtgaccgaaggaacctttgacgcatacctctggcagacggtggagaataagcaaaaattcatcagccagatcatgacttctaaatcaccagtgcgttcctgcgatgatgtggacgaaacggcgctttcctttgccgagatcaaagccctgtgcgccggagatccccgcatcaaggagcgtatggatttggatgtggaggtatcccgcctgaagctgatgaaagccgaccaccagagcaagcagtaccgtctggaggaccagctgctcaaatacttcccagaggagattgaaaagcacaagggctttatcaagggctttgaatctgacctggaggttttggcagctcacacgcacccggaggacggctttgccggtatggagattcgtggagacctgctgaccgataaggagaacgccggtgcagcccttttggatgcctgcaaggaggttaaaacctccgatccggtgcagatcggcaactaccgggggtatgccatgtccgtggaattttccgcttggaaacaggagtatacgctcctgctgaaaggacagatgacccaccgggcaacccttggtacagaccctcgcggaaatcttacccgtatcgacaatgccctcgcccagatgccccagcgtctggaggcggcaaaggcccagctggataacctctatcagcagcaggctgccgcaaaggaggaagtcggaaagccattcctttatgaagaagaactgcgaagcaaaaatgcccgtctggtggagctggatactttgctcaacatcgacggaaagggacaggcgcacgcagaggctgttgttgccaaaagcacacggacttcggtgttggacagcctgaagcgcccggtgccggcccgcagtacagacaagaaaccaaaacagcatgaggaggtgcgataacatgaataccaacaatctgaatacagccctttatgaaaagatgactgctgaacaggacaagttccgggactggctgaaaagccagcccccggaagaagtcttaaaccatgcctatgagtacaccatccgcgaggacatcgtgatggcaatggaggaactggagttgaccgacacccaggcacaggcacttttggaatctccctctccgttggcggatgtgtaccgctattttgaaaagctggagaccggccacatggatgtgatccgggacagcattgagaaccgtgctgacgatgtgtgcagagccaaagaggaactgcgaacaacaccggtctatccccattctgctgcctatgcgtccgagcatggggaaatggcacagtacaacctctcatatcaggcgaacagcgcctgcaaagaagccattgagcagaccatcagcgcccactatgcagagaatcggctggatacggaggcggcggtcaaagatgtgctggaaaagttcgggacggaacgggtacagtttattcttgccaacaccatccagcgcaagaactatgacgggcgtatctctcaggacaataaagcatgggcaaaaaacattcctacgctggaggacagcggcgcttcccgccactgtgcctatctggtggtagatcaggtcaatcccggtttgaccgacctgttcaccagacagttccgaaaagtcgctcaagaacagcagaaaagttctgtcctgcaaaagctcaaacaggagttgcccgcccataagtctgccgccccgaaaaaacgggagccggagcgataaccatggcaaagcgcaagcgggatgttccggttttgttttgggtgtccgcagaagaactggaactgatccatcaaaagatgcagcaatacgggacagagaatttgagcgcttatctgcggaaaatggcactggatggttatgtggtcaagctggaactgccagagctgaaggagttggtctccctgatgcgccgaagcagcaacaacttgaaccagctgacccgcaaagtgcatgagaccgggcgggtttataatgctgacttggaggatatatcccagcggcaggaacaactgtgggagggtgtgaaggaaatccttacccaactctccaaactttcataacagggatagatactccatttgcggagggaggaacggcgtttcttcgccgcaccttcctccgctttttctttttgtctgtatccttgtcttttgcctgtccgtaccggataatatgagtagaataagaagcgtagcaaaggagtgaaaacagatgctgacctttgaaaaggtgctggagatttttgcggattacctgaccgcagacgagaccatagaagtttatatcagccgccatggatgtgtaagagttgaatttgaccaagattttcactattgctctggcgaggtgtgccatactcccaaggaactgttcgacctcttagccgatgattaccggacttatctggagattgaactgaccaaaggaaaacgggaagtgacggaagatgatgagagagaagcggatgccctgtgcaaacggcatctggagcgttggaaggaggaacaggaatgaagattttgaaatgtctgctgatgatcgtaactgcaccggtcgttttggtgttgacgctttttgtctggctctgcacggggctgatctacatatccggtctggtgcttggtctactaagcacggtaattgctctgcttggcgtggctgtgctgattacctattccccgcagaatggtgtgattttgctggttatggcatttttgattagcccgatggggctgccgctggctgcgatctggctgctgggaaaggtgcagagtttgaaatttgcgatacaggattgggtgtatgggtaaatgatgtgaatataatttggaatgaaaaagaagcaggacaatgggagatgagacccaatgccctgcttcttggttatttggaatgaacggtagtgtatttctggtttttgcttttgggtttgtctggaaacatcatttcaagtttaccagaagataataaaggcttgaggtaatatttgctgaagtgagaacggctggaaacatcaatatatgcttgcatttcatctcgacttttagggtctgcacaaaattccaatagcaagttttgtttgctgatcacagatgtatcatgtgcggcatcatgtgctgtatcatgtgcggaagcaccgcacatgatgtagtttacatttttcaagatgactctgaaatctgtcgctgttgaggaaaattcgggcttatatgcctctgtgtatccaggcagcttttcggtttcactgacgattttgcgtaggccacttccacggcgttccatgtacttcatgcggtggaacaggtcagcaatcacagggtttcgtcgcatggaacggatactgtaaatatcgtattcctgaattgagccgccgccaaacataccgcccggagatgtgatttccacccgatcatcaaacatatcaatatggatttcgctgccaagcacaatataatcacgatggataagcgcattgacaagagcctctgtcacagctcgttcagcataatccggcttgtctacacgatactgtgcctttttgacaaaacggactttggaattattgcgaataaattcactgccgctgttcagtaaataaatcaaatttccctcgtattctttatcgtccagtgcatcatcaaagatagagcctttttccaagccattccaccgggtacagaacatacgggagttataaactgtgtgctgatcggtcatgagctttccggcattggtcaagaccccatttttgtcagccaaaccgaaggaaacataatcggatggctcaaagcggaggccggttcgttccagataggttgcctccaggagtgtgaagctgtaatcctttttcacagcttctgttgttaaggtgtcaaaggactgattggttccctttaagatcagttcatttacaatgtaatccggggcaattacgctttcatttccaacacggatatatgcttccatcactccgtctgccttgtaataatatggggtgctgcggccgggagaaacctccagagctaatagatttttaccatcttcctgtaatggttttaagataaactgaggtaatggtgtgatacgttctttgattaagcggctgatcgcttcagcatccttttgaacatcggacaagccgataggctcccggtcatcggagactccgaaaaacagagtgccgccgattccattggaaaaggcactgacactttttaaccagctttttggcttttttgtttcgagagcaactttgaaatcacattcggttgcttcagcaatgagctgttctatcatagaaatccctcctttgaggttgtagaatattcttttttattatacccagcggagaaagttattgcaacgatagaagcaaagagttcagcgaaaacaaaaatatttatgagaggaggaccttctattatggcaactacaagaatcatgccgcttcatgtcggcaaaggccgcacagagagtcgggcaatcagtgacatcatcgactatgtggccaatccaaagaaaacagataacggcaggctcattaccggctatgcgtgtgacagccggactgcggatgcggagttccttctggcaaagcggcagtacattgccgctaccggacgagtgcgtggtacagatgatgtgattgcctatcatgtgcgccagtccttccgccctggtgagattacccaggaagaagcaaaccggctgggcgtagaatttgcaaagcgttttactaaaggcaatcatgcctttgtggtctgcactcacatagacaagtcgcacattcataatcacattatctggtcatcggtcagcttagaatatgaccggaagttccgaaacttttggggcagcaccaaggcggttcgtcggctaagtgacaccatctgtattgagaatggactgtccattgtagagaatccgaaacttcacggaaagagctataacaaatggctgggcgatcaggcaaatccatctcaccgagagctgcttcgtgtggcgattgacaacgcattatcacaaagtcctgctgactttgaagaactgctgaagctgttgcgagaatatggttatgaagtctcaaagcgcggaaaatcgtatcgactgaagctctctggttgggagaaagccgcccgcatggacagtctgggcgaaggatatggattggaagatttgcgggcagttctcttagggaagaaagcacataccccgcgaaagaaaacagtcacacaggcagagccgccgaaggtcaatctgctggtggacattcaggcaaaattgcaggctggaaaaggtgctggctatgctcgatgggctaaagtttttaatctgaaacaaatggcgcagaccatgaattacctgtcagagaacaatctgctggagtatgcggttttgaaaaaaaaggctgcggctgccacggcacatcacaatgaactttcggcgcagatcaaagcggctgaaaagcgcatggcagagatcgctgttctgcgtactcacatcgtaaattatgccaagacccgtgaggtctatgtggcataccgcaaggcgggctactctaagaaattccgggaggaacatgaggaagaaattctgctccaccaggctgctaagaatgcctttgatgagatgggcgtcaagaagctgcccaaggtcaaagagctgcagacagagtacgcaaaattgctggaagaaaagaaaaagacctatgccgagtaccggcgttcccgtgaggaaatgcgggagcttttaacggcaaaggcaaatgtagatcgagtgctgaaaatggaggtagaacagaatgttgaaaaagaaaaagaccacggccagcggtaagctggtcctggtcaaaagcgttcgcagaacgcgcagccacagaatgaaattctgtgttcaaaggggcttgggggcgctgccctcaacaagcaagcggagaggaaaatcacggagggattttcttctctgcgggcctgtgtgtattaacacaggcattgcttgcctcttttctccgaaattgaaaagaaccagtgagagaatcgttaaatttcactcactggctcaattcgtttcaaattttttggacaactctgtcagttctttcaccgtttcctgggtgtgatgcagcagggtgtcacgcatttctggcggacagctggaataaagcattttcatctgattgacaccctcatcctccagagaaacatctggatttataagtgtatctaaagagatatgcaggaccttggccaatgctctcaaaatcaaataagaaggattcattttccccttttcgatattggcgatttgctttacagaaacatggctcagatcagaaagttcctgttgtgtcagttctttattctttcgggcttcccgcattttttgccccaaagcggtcaaatcatcaatcggcataatcactcacctcaagtatattctatcgtgccgatttgcacaaaggaataaccttattatgccggtcaataggcttgattatgctgattttttggcgagactgaaacgctatccttgtatcactaactgaatcaaattataatagagatgggtatttttttgaaagaaactgcccgctgtaacatttcgcggacatttgcctgttatactatctgcaaaaagcgaaggaagtgaggatatgaagcagattttaattgttgaggacgacagttttttgaataagatgttagcctataatctgaccgcagacggctacggcgtgacttctgccctaaatgcaagaaccgcagccgacgccatccgccagcgggaatttgatctggtgctgttggacattaacctgccggacgggaacggttttgagttgtgtaaactgataaagcctcagcacccggacaccattgtaattttcctgaccgccaacgatcaggagagcgaccagatacggggctatgaggtgggcgcggtggactacatcacaaagccctttgtgatcggggccttgcagcggaaaatcaaagctatgtttgctatgctggaacaccacaaaccggccaaggacatttacgacgacgggcggctgtttctggacttctcggagcagacggcttccttaaacggcaaacctctcattctatccccgatggagtacaaaatgctgaacctgttccgcaaaaatccccggcaagtgctgacccgtgggcagcttttggaaaagctgtgggatgtagacgagaagtttgtggacgaacacaccctgacaacctccatcagccggattcgcagcaagattgaatccgacggcggcgcgccctacatcaagaccgtttacggcatgggctatcaatggacgggaggcgaggcaaaatgaagtttcaaaacctctcggtaaagcggctgtttggtcgggtggcaatggggcttgccctctccatgtccgggattaccatagccctgttttttgtgatgaaacagacggcggtgctgctgacgggcggggcgctgctgctgtgcgctcttgtggggatttttgtactgacgcaggcgtttggaaagcggctgtcgcagtttactgctgacttgtgccagactttagaccacatgatcgccgggaatgaagcgccccagcggccagaggacagcgaaacccagcttgccagaatcggacaccggctggcaaggctttaccagatcatgcaggagaacagacgccgggtggacgaggaacggcaggagttgcagacccttgtatcggatatttcccatcaggtgaaaacgccggtaagcaatctgaaaatggcgacggacaccctgctggaaaagcctatgaccgaggcagaacgcaccgactttatccgtggaatccgcagccagacggataagctggactttctctttcaggcccttgtgaaaacctcccgtctggaaacaggcgtgatccagttggataagaaaccgggccgcctctttgataccgtggcgcaggccatgagtgggatcgtgtatgcagcggagaaaaagaaaatcgccgtgtccgtggactgcccggaggatttaacggtttctcatgacagcaagtggatatccgaagccctctttaacctgctggacaatgcggtgaagtacaccccggcaggcgggaaaatcgctgtgtcggtggtgctgtgggaaatgtatgtggagatcaaagtgaccgacaccggcaagggcatttccgaaagcaatcaggccgctatcttccgacgcttctatcgtgaggaagaagtacacgaacagcagggcgtgggcattggcctgtatctgacccgcgagatcgtaacgcggcagggcggctatatcaaagtagtttcagagccgggacaaggttctgctttttccatcatgctccctgtgaagtaaaggacagcgggcggcctttttctggctgtccgctgaatttttttgaaatattcgagcactgtaacatttcaccccgattttcattaaaaattttgggccgctgtaacatttcgcggacatttgggttttacaatacccttatcagcaggcaggaagccttgaaaggagttttgaatatgagcattttacagaccatcaacctaaaaaagtattacggcacagagccgaacatcactcgcgcccttgacggcgtgaacttctccgtaaaggacggcgaatttgtggccgttgtgggaacctccggcagcggcaagtctaccctgcttcacatgatgggcgggctggacacccctaccagcggaaccgtgattgtccggggtgaagaactggcaaaaaagaacgatgaacagcttacgattttccgccgccgcaacatcggttttatcttccagaactataaccttgttcccatcctaaatgtgtatgagaacatcgtcctgccggtggagctggacggggacacggtggatcagaagtttttggacgagatcgttcacctgctggggctggaagataaactgaaaaatatgccgaataatctttccggtggacagcagcagcgtgtggcgattgcccgcgccctgattaccaaaccggctatcgtgctggccgacgagccgaccggcaaccttgacagcaagacaagcgccgaggtgctggggcttatcaagcgtaccagtgcggagttccggcaaaccgttgtaatgattacccacaacaacgacattgcccgccttgcagatcggattatccgcattgaggacggcaagattgtggaataaggaggtggcagactatgacatggccttttgagaatgatacaagtgccattgtaaaaaaattggcaggtaggagtatgcaagcagataagagaaacaaggcatttctgcttttgacaatcgccatctctgtctgtatggttttttcgattctcctaatatcaacaggcacacaagagaaattcaagaacacacagagaaataaagcgcagattggcattttgggagttacggacgaacaaacggctcaactgcgtcaaaacgaaaatattatgtgggttggcgaatattccgctctaggtttattttatgttgaaaataaaacaatcactgttgcttatggaaatgaagattattttttacatcaggaagaaaaaacttttcagggaagtgtgccgcagaaagcggatgagattatgctcccccagaactaccttgattttttaggaaaatcctatcaggctggcgattcaatttctattgacctgactggaacaggacaggaagcagaatatacactttcaggtgttttgaataatacgaaagaaagcaacggatattttatttatgttagtaaagagcttgcccgagatttggcaaaagattcttttcaggttacagcatatacgcggttgaatacagacgctataagctccacggctattcttgattttgccggtaaagcaatacaaaatacaagcattgtcgaggaacaggtaatgcttacagattattctgctgttatgtcgggtgtgataacatcaggtattccgattccagtaccactactggcggcgttgacggctattttggcggcaacgattgtctatggtgttttttacacaaagattgtaaaaaatgttcagatgtttgggcaactgcggacagttggcatgacaaaaagacagattaaacggatggcaagtaaagagggacgtttatatgccttagctggcattcctttggggcttgtcattggtgtactgattggatttattggctgtcctgatggattccggctaaaaacaacagttatttatgctgtattgattgccgcagtagcctttgtaatagtgaatattgccatttttaagcctgtccgagtagcaatgaatacttccccggtagagggtgctaaataccttgcgtatgctggaaaggcaaaaagcagctcaaaactgcatcggaaacttacgccgtttaatctggcgaaaataaatatacaaagaaacaaacaaaaggcagtcctaacgcttttaatgcttggagtaagcggggctcttttattggttacttctacggttgctggttctattgatccggcaaaacaggcaagtttcaaatattatcctgccggtaacattcttatacaaataagaaatacagtgggtagctctttcgataacgaagcggagccatacggaagcgcaaaattgcaactggaagaaaatccacttgaagatcaggcattgatgcgggaattagaaaaggtagatgggatagaaaaaattaccgcatttgacagcgtttatatgacagctactttttcgggcggaagtggttctatcacgagcatttcaagtttctttccaaccttaaatcgggaacagacagaagaaaagcaggcggtgttatcctccggaacagcagattacgacgatatggttgagaaaaatggaatattggttgcagaagatatagcacaagttggcgatactttgaagattgagggcagagcttttgatggtagaacctttgatgtggaagccgttgttgtaggcacatacaataggtctgatttaatggaggatagcccggttgttcccggaagtccctacttcattatggcttatgacacagcaaagaaactgacagggataacggaacagacggggattctggcagttaaaaattcagatggacgttttgatgaagttttggccgcagttcagaagattgcggataaaaatggaaaaatagaagtaaatacgattgaacaaacgattaaaaatattcagtatcgatacagtgcatctatacatgctctgtatatgacttctgctattctgttcgtctttggaagtatcagccttatgaatatgcttatggttgattttcagaatagaaagcgtgaatttggtttgcttgaagctgttggaacaacacggcagcagttgaaagcaatgctagatagggagatgggaatttacctcggaggttcattggtaatagctcttgtatttggaagcattttaagtgtaattgtttgtagacgattggatgcggtgaaccactgcattacattggtattgccgtggctgtttctattggcgttagtcgttgttttagcagttatatatttgatattcactgcatacgcaaaatccgagttgaagaaaacaagcatcttgtctgccataagggaggaatgatctaatgaagcgaccgggatagattgcacaggtactatttccataattactgacacagaaaaattcgatacggttgaagccgcattaaatcagctaatagacggaaacagcaatttggtttattgataccatagaagaaagcataacttattatagtagaaatcaacaactatctttcgggatgttgttgatcgtggctgttattgttgtgtgcttttctctcatcaaccttgtcaatacgacaattacgaactttctgtcccggaggcaggaaattggaatgttacagtcgattggtttgagtaaaaaacagcttatcaaaatgctgtactatgaggggttgatgtattcagcttttgctacgcttgtaacattggttttgggaactggactgggcttcttatccgtacagatagttgtgaaaacaataaatccatacttttactattcatttccgtggctgatcgtattgatatatttagcaatcctgctgattgtgcaatttaccttgatttcttacacaactggaaatctgaaaaagcaatctcttgttgagcaaatcaggacgatggaataaccgtatgggatcggcggggcggcggtatgctgccccgctttttctcggcttctcgaaaaaattttgaaatgtccgagctttgtaacaattcagccggtttttctgtcgaagtcaaaggaacctcggacatttgtgtaacatttgtgttttacacttgcattaaataaatatttcactcccaaccacatctgcccagcggcagaaaagaaaaaagccgctgctgggcagacgattttccgcgccctaatgaacttgtctgtggcggctttgattttcagagccgccgtttctttttgtttcgacgacccctacaccgtgttctggcatggcggctttaggaggaagccaccatgtcaattttcgtcattcacaatagccacgagttacaccagttaaaaaaagccttgctcctccgtcgggaaagtatgattaccaatcagcattatcattccatctaaatcagcagaataataggtgtttttgtcgcgccggtttcctattacagggaactggcgcttttttctgtcgatttttcgggaaagctcccgaagtatgtcgctgccgttccccacctcctttcgattcacttgtcaatcacccgtgaatcgaaatggaggtacataatggagaaagtcaatcttagggacttatatcccgatgtttataaaacagatcacttcgtagaagtagcagaagatgtgctggagacaatccgtgctgctgagcgtgcagaagccgcctatgaacggaggatgtatcgctataaggcgcactactccctggactgcgacaacggcattgaaaatgcgatcctgctgaagccacagacgccggaaacgcttctggaggaaaagcagctgcgggagcagctctacgccggagtgatggcgctgccggagaaacaggccaagcggatctatgcccggtattatctgggtatgcgtgtgagcgagatcgccgcagcggagggtgtagacccaagccgtatccgtgacagtatccggcgcggtctgaagcagctggcaaagtatttttaggatagaataagcaaagggcgcaaggtatcaaagtgcttctggcacaggaccttgcgccccatctattgcagtagctttagaggagtatttcgcagagttgtctttggatgcaaaagaagcaggagaccttttcagatttccggcttcttttgtgctagtgataaatatccaaaatgcttttgacttaactcaaatgggcttttgggattgtatctgtagagtcaaaagtcaagatgattttacatccacagttaatcttactgtcaatggtcatagtcccttcatgtgccgctacaatttgtcgaaccaaaacaagccccagcccatgtcgaagatctaagcgctcatctgtgctttctaaataatgaggtttttcttttagttcttgtagtttttcttcggagagtcctataccatcgtcttgcacaataagctgaatggtattttccatccgtcttaaagataacagaatcctacatcccagcgggttgtgctttatactattttgaacaagattattcacggctcgtgaaatcaatctggcatcacattctaacatagcgttttcagcgtcagtagcaatttcaattccgatattatagctatcggaaattcccatgttcaataggtctgctacataggatcgcagcaatttggataagcgaaccatctctttgtgaagcggctgcatttcatattccaactgtgagactaaattcaaatcctgcaccagttctttgattcttacgctttgcttccgtactatttcagcctgttcttggatggtcttgctggcagattcattttccgcaatgcggcccgcataccccataatcatggagagcggtgtgcggatgtcatgggaaacgccgctgatccagttcgcccgtgcttcattttgccgattcaaaatggaagaagctttgtttacgctgcttgcaatatccgacagttctccgctgatatgaagtgagactggctttccatctgccagagtttccacggcagatacgatcggttcggtattacggatgattttgcgtttggagaaataataggcacaaaagaggcacagtacatccaatcccaacattccaagcacaaagacggggagccgtcgaagtgctgaaatggaatagtaattgctggtgagttttgtatagctgtcttttggataacccaatatcaacagtccatcatcggtgttccagacaaaaaccggataatcttcaatatatccttttgaaaacaatgcgacatcttgaatagtgtaactttttggcacttcatcgggcaaatcaaccgaccaataacactgcccatcagcgtttaagtagattgcccaaatatgattctgccggagcttttgcgctgcgtcatctgataatcgttctggtgtggcggcagcagcggtcatttccaacatggggtgcggggatgaagttccataatcctcggtcacaaccttttgaaatgtcaggccgaataccactgcgttaagaaacagtagtatcagaataaaagtagcgaaagatataagatgttttgatatataatgtgcaaatgatctcatggcattacttccttgctatcagcttatagcccaaacctttaatagttatcagggatacaggttttgatggatcggtttcaatcttttcccggacacgccgcacatgagcattgaggctgttttcgtagccgaatgggttatccccccacaaggcttcgcaaagcgcatctacggtaacgatctttccggcattgcgggcaagcgtttcaagtaaagtatgttctttggctgtcagggagataatctcgctgcccttatggacttcggcccggctgaaatcaatcgtacatccatctaaaacaagcagcggcgaatcctctttgtaggttcgccgcagcaccgcatagatacgcagtaacaattcctgcggcataaaaggcttagaaatgtagtcgtctgcaccaagtcccaatcccgataatttgtctgctgtctcgtcctttgctgttaagaaaatgatcggcacattagtaaaggtgcggagctgctgcatcaaagaaaagccgtccccatctggcagcatgacatccaaaacaattaaatcaggagtttcctcttttgcggtcaaaatagcttttttgaccgacatagcagtaaggacagtttcaaatcctgcatctttcaatatatctgataccatcttcaatagttcctgttcgtcatctaccaacaggagccttttactatgtaaaaaagaattatccatagcatcctctccaatctgattttctttgtttctattatatcataggctgtccattctgcgatcttgtcccttaaaaagtaaggtaaaagtaaggacgggagaatgtagatgtcaggttgaagctgtaccataaaagcatcgaaaggagatgtttctatggactatatcatcacaacggaacagttgacaaagaagtacaaaaatttcatctcggtcaacaatgtttcgcttcatattcgcaagggcagcatttatggttttctcggccccaacggtgcggggaaatctacgaccatgaaaatgctgctgggcctgaccgcgccgacaaagggcagctttactattgatgggaagcagttcccgaatgatcggattgccattctcaaagagatcggctctttcatcgaagcgccgtctttctacgcaaacctgaccgggcgggaaaatcttgatattatccgccgcattttgggactgccgaaagccgatgtggaagatgctctggaactggtagggctgactgagtttggcgaccggctggcaaaaaagtattcgctgggaatgaagcaacgcttgggccttgccggggcgctgctggggcgtccgccgatcctgattctggacgaacccaccaacggccttgacccgtccggtatccacgaaatccgcaatctggtaaaatccttgcccagcctttacgactgcacggtgctgatctcgtcccatatgctgtctgaaatcgaattgattgcagatgacattgggattctcaaccacgggcggatgctatttgagggaagtatgaatgatctgcgtcagtacgctctgcaatccggttttgctgcggacaatctggaagatgtgttcctttctatggttgagaaagataacatggacagaaagcagagggcaaaattatgaaaacgctggcaatcgaacttcggaaagaaaagcgaaccggcgtgattcctgtgctgctggccgttggtgtcttgggagccgcctacgcatttgtcaatttcattgtgcggaaagacacacttctgaatctgccgttggctccgatggatgtcttgctgacccagctctacggtatgattatggtgctgaacctgttcggcatcgtggttgctacctgcatgatctataacatggagttcaagggaagcgctgtaaagaagatgtatatgcttcccgtcagcgttccagccatgtatctgtgcaaattcctaattctgacggtcatgtttttggttgcaatcgtactgcaaaacttgacacttgcacaaattggtatgacggacttgccggacggggcgtttgagatgggtacgctggtacgctttgccggatactcttttctcacatccatgccggtactgtcgtttatgctgctgatttcctcgcgctttgaaaatatgtgggtgccgcttggaattggtgttgccggttttctaagtggtatggcccttgcaaattcggggctgacgcttttgctggtgcatccttttgtgattattctgaaacctgcggtagccatgagcgcccagcctgatccgacggttgctcttgtcgctttggcggaaacactgttgttccttggtgttggcttgtggctggcgaagtacagacgctacgagtaaggagggataataagaaatgagctttttggatttgctcaaaatcgagtttatgaaagtaaaacgctccaaaatcgtacccctgattttcattgcacctctattggtggtggtttctggggttgcgagtttgagcaactactttacgccggaatacaccaatgcgtggcctgctatgtttattcaaagtgcgcttgtttacgcctactatctgcttccattcagcatgatcgtggtttgcgtgatgatcgcaggacgagaaacaggaaataatgggattctgaaaatgctggcgctgccggtcagccgctgcgcattatccattgccaaattctgtgtgcttaccttttatctgtttatggagatggtggtgtttcttgtcgtatttgtaatcgctgggttgattgcaacacagacaatggtggtcacagagaccctgccaatcctgtatcttctgaaatggtgcttggggctgtttctgactatgctgccgtgcattgcggctatgtgggccatcaccgtactgtttgaaaagccgcttctctctgtgggattgaatttgctgcttgtgattcctggtgtattggttgcaaatacgccgctgtggatcgcctacccgtattgttacagcggttatctcgtttcctgctctctccatgactttacagcagaaacttccgacgccgctttttcgatgtttccgttcctgccgtgcgcgatagtcgtgtttggtctgtttttcgcgctggctgtcacccaatttgggaaaaaagaaatgaggtaaaactatggaaaggaaaaaacttcaatcagttagtatcgctgcgctcattgtgagcatcctgccgctggcggctcttgccccgtcgttcctgcacctttcgctgtcggacagagtccgaaccgcttgggccggagccaatatcgtttttgtcctgctgggcctgattctttcggtggtatgtgtgcggagcaaggaaagccgcagcgttatcaatatcgcatccacggcaatcagcgcgttttgggcgttactgatggtgggaattgttgcgcttgccgtgttccttactttcgttcagtgaggaaattgctatgcggaaaattattggatgttgcctgattgctgtttctttactggcctgtactgcctgctccggcctcgacaggttaagtgaaaatctcagggaaggagcagagcaattaggtgatgatgtagtgattgggaaaagcaacgctcttataaccccttatcagtcttttgagggcagccggacttcggacaacgatgcttttctggccacctatgacgcttctgtaactggatttaacggacaggatattttggttgctgacaccgacctcaaggaaaatgagtgccgtgaaattgtaatccggtaccagtttgattctcttgatggggactgtcaactcatttacatctccccggacttggaggagcaagtgctttctgaatctgccagcggaagcgttgccgttcagcttcaagctggagcgaactacatcggaatcaccggcacagactattcgggcgcgatccagattactgtgggataaacgatagaatgatatgaaacgaatattggtagtggatgataacacggaatatctgcaagtcctgtcatctgtgttatcgggcgattttgatacgattaaggccacgggcgtcaaggaagcattggacatacttcaagcagtcacagttgatgcaatctgttccgatttcaacatgaaagatggcacggggttggatttgcttgaaaaaatccgtcataaaggtttgagaacgccttttctgctaatgtctggcgatgacagcagagcattagagaaaaaagccaaactgtactatggtggtttttgctgcaaaacggattttgatttaatccgtaaaattaaagccttagtcagcaactaaataaagataccatctgccggacgacggcaaaagaaaaaaagccgtcgtacagcagacaatttgacacgcccatttgaaacgacggctttgattttcagagccgccgtttctttgcatttacacaaacctatgacgacttgcagggacacggtagccgattggaggttaatttaccgtgtcccgtttgctttttcaaagctcacatgatctacatcagttaaaaaaagcattgctcctcctccgggcaagtataatattgtatcggcattatcgttctatgtaattcggcataatagtggttgtttttggcgcgccagttttccatcgcggaaatctggcgttttttgttgccattttttcagagatgatccggttgtttgccgatgccgttccccacctcctttcgattcacttgtcaatcacccgtgaatcgaaatggaggtacagaatgaagaaaattaaccttcgagaactttatcctgatgtttatacaacagactttttggtagatgtgacagaggaagtaatggaggctattcgagctgctgagcgtgcagaagctgcctatgaccggaggatgtatcgctataaggcgcattactccctggactgtgacaacggcattgaaaatgcggtgctgttgaagccgcaaacaccggagatggttttggaggaaaaacagtttcaggagcaggtctatgctgctgtgatgaagctgccggagaaacaggcaaaaaggatttatgccagatactacctgggaatgacggtaaatgaaattgctgaagtagaaggtgtagacccaagccgtgtccgggacagcatccggcgtggtttaaagcagctcggaaaatatttttgataaagtttcatttgatgcgcctgttttttgccttttttgtcagtgttaataagaaggacaagttttcctccttcatcagtacattgacaatcgaatagacagcacaacaggtacataacccatgtatgagcgaatatgaaacgccgcgaagatggagcagtcagggaggtgatgaaagaactgcttcggagcgatctacgatttcataaaacggattgtggcagattcggcgcgatgactgcatgggggcttaaagatacttcctcacggcccgccaaagacttggggggaaccctgcggcacacgatacgaacgatgctgcggagttatgacagccgcgccagcggagacctgttgtgttcccatcgtcagggggcgtggcaaatgtgatgaaagctgagttatataaataggaagcgtttgcagcttcctgttcaaaatcagataccatgcgctggcagtttcggctgccagcgtattcatgtggctttgaacaaacacgatgacaaacttgacagattggaggaaatatgctttatggaaaaacttattacacgaaaagaagcagcagaaattttaggtatcagcattgcaacgctggacgcggcccgtaacaatggtcttatttcttatgtgcaatatgtgcagaatggctgtgtgtactttacttcagcgggccttcaggagtatatcgcaaaatgcacccacagagcaaagccaacagaaaagaacgcaacttatcgtaaacctcgcagagctggagtgtgagccggtccgtatccttgtcgaaatcataatggtctgataaaacatagatacagcgctggagtctattcttaggaggtgacggaattggccaaacggcaaacaataattcctcaatatggcacagttatgaaaaggggtgtcctatattataggaccagaatcaaagacgcgaatggtaagctcgtagctatctacgcaaaaacacctgaagaactatacaacaaagaaacgcttgcgttggaacagattgagaatgccacttttcatcggaaaacgcccacagttgcagagtattgtgaaaagtggctgctgatgcagtcggttcatgtacgagctactactttgacggattacacctcaaaggttaggcggcatattatagcggaattgggagataaacggatgggtgaggttagcctggatgatattcagcttgcccttgttccggtttccaaaaaatctgcatcggtttataaatctgtggtaatcctttacaaatctatctttcgcgcagcgatggaaagcaggattattgaccacaacccaacgatttatctgacaacaaaaggtggcggtgttccacaagaggagcgtcaggctttgacagatgaacaggtggagtgccttttggatgctatccgagatttaccgccttatgtctttgtcatgattggtttatatgcagggctacgccgggaagaaattcttgttctgcaatgggattcagtatatctggatacagatactccatatctgacggtaagacgggcatggcataccgaacataacagaccggtgatttcggatgaattgaaaaccaaggctgcggagagaaatatcccccttcctgtttgcttggctgagtgtttgaaagcagcaaaggaaacttcgacttcggagtatgtggtttcaaaccgggatggcgaaccgctgtcctacacgcagtttaagcgactttggcagtatattgttacgaggacggtcaaggagcggagctattatcggtatgaagatggaaaaagagtaaagcatactgtcacacctgtcttgggagaaaaggctgctcataacggaaaagtggtttacagtctggactttgaagtaacaccccatcagctgcggcatacttacattaccaatctcattcatgcatcggtagatcccaaaacggttcaatacctggcagaccatgaaagcagcaagattaccatggacatttatgcaaaggttaagtacaacagaccagatgagctggtcagatcaatgaactgtgcgtttgcaagctgggatgcagcacagtaataacaaataggaaatgaagcaggagcgaggcaaggatgcctcgctctttgttttacctcagccgtatctttgattaaatcgaggctttctgataaaaagagagtgtagatacggagactacacattatcaagagaggacgatcaaagatggcaaaaaagaaaacacagatcccgaagtacgggaccattacattgaaaggaatccagtattacagaaccaggattacggatgcagatggcaaagagttgagtttgtatgccgcaacttgtgaagaattgtatgagaagcagttagagacccggaagcaggtggaagaaattatctttcaccggcagcacccaacagtagccgagtatggagagaagtggctgctgatgcagtcggcaaaggtgtctgcgtctacactcagaggttatacgagggatatgacaaactatatcataaaacctctgggagagatatatatggaagaagtgaccgctgacgatattcggctggcgcttgttccattgtcaaagaaatcggaaggcttatacaataaggtcaatatgctactcaagtgcattttttatgcggcagagagaaaccaaattcttgaacacaatccctgtgcgggaatatccggtaaaggcggaaaaccgacaaaaaagaaggaggcattgacagatcagcaggtagccgtgcttctggatacagtcaagggacttcctccatatttgtttgttatgctcggtttgtattccggtctgcgtcgggaagaaattcttgcactgcaatgggattgtgtatttctggacgaggatacaccttatctatcggtgaggcgggcatggagtacagagcataacagacccgtgatttctacggtgctaaagactccggcggcaaaaagggatattccgataccgaagtgtttggtggattgtctgagagaaacgaaagaaaattccatatcaaattatgtgattgctgacagcaaaggggagccgctggctgcttcgcagtttcaaagagtgtggcagtatgtcgttgcccgctccactaagccccggaactattataagtatgtgaatgggcagagcatcaaatacacggttaccccaacgctgggcatgacccagaaaaatcaacccaaaatcagatatacgctggactttgatgtaaccccgcatcagctgcggcacacttacattaccaatcttctctatgctggtgttgatccaaagaccgtccaataccttgccggacacgaaaacagcaaaacaactatggacatctatgcaaaagtgaagtacaataaaccagaggaattgtttggggtagtaaatggtgcgtttcatcaggctattgctgaatgaaaaaaggccgttttttatggtccgcacaccggataactgagaggcagaaagccggaaaagcccggagtatcaagggaaaacagctcaaaaactcgcgcagtacggtctcaaagcagctcgtcgcgctccgcagttctcaaagagataagcaaatcgaatattacaaagaacaattttccccgaaaacatcaagttttcggggatttttatatacttcaataattctgtcaagacaccacaaaggtgcacaagattttcgcgggaactaataggtgaaggtaaatattgcaaatttttttggaagaaatgatataaaaaatgtcttttattgtcgtttgtagtgaggtataatgataaaaaatacagatgtggtggaattttatgaagatattaaaaacaagtgatgagttgataactcatatgaaaataaaaggaataaaatttgagatagtaaaggaagaagacgcaaaaatatttcttcaaaataataattactacatgaaattggcatcgtacagagccaattatgataagcgaaaaagtaatagtaagtacataaaccttgactttgcttatttacaggaattgtcaacaatagatatgcatttacgatatttaatattacaaatgtgcctggatattgaacatgctgtaaaaacaagattgctaaaagatatagaggataattctgaagaagatgggtatgatattatcagaagatttgttacaaagtatgaaagaagttgccgaaacatacagaaacacaaatccagtgagtattgcagagaattgatagagaaatactatccatattttccggcatgggtatttgtagaattaatatcttttggagatctggttaagctgtacgaatattatatagagaggtatccgggacgtttaaaggatagcgagttgttgtactcaattagggatttaagaaatgcaactgcgcatagtaattgtctgataaataaattgcaaaaaggaacaaacaagccgtctgtaaaaattataaaatttgtctcaaatatagatggaataggagagatcatgagaacgagcaaattgagcaataagtttttgtgtgattttgtttcattgatttatgtttacaatgaatttatctgcgtagatgtcgtaaaagagaaaagatttaagcaattacaagagtttatagatggacgtgcagtaaaaaataaagagtattttgaaaagaatgaatgcataaaaacagcatacttctttgtaaaaaaagttgttgactatataaatgaagcgtgttaagatgaatctacgattaaaaaattaaatttttgtagggaatgggtatttactcgttcccgatttttttagagtttggctacagtatctcccccgaaaacatcaagttttcggggatttttattttcgcgatcagctttaatatgccgcgcatcagtgcgcttgcagcaaccgccagggaaactcattcggtaaaatggagagcaaagatcggcgtattttatacggcagcagcattgctggtttcctgcattgtgtaccatataggtctgcttgttttttttaagaaaaataatgcttgacatcctaaaatagattgtgtacaatctaaacataaaaagattgcgcacgattaaaaatgaaacaatttaaaaagattcatttttaatgacaaggagaaaggagggtaagagatgggcatttatgagtattctgtggagcgaccggacggaacaatgcagccgttgcccgcttatgagggaaaggtacttctgatcgtgaatacggcgaccggatgcggattcaccccgcagtaccgggaactggaggagttttaccggaagtaccatggcaagggacttgagattttagatattccgtgcaaccagttcgcgggacagacgccggggacggatgaagagatccacgagttctgcacgctgaagtatcacaccgagttccctcagatgaagaaatccgacgtcaacggcgaacatcagcttccactgtatgcgtacttaaaatccaagaagggatttgccggattcggaaaagtggcgaaagcggcggcgatgggaataatgctccgcaaaatagataagaattataaggagaaccccgacatcaaatggaattttacgaagttccttgtggacaggcagggcacggtagtggtaagatttgaaccaacaggagatatgaacgaactggaacgacagattcttgcattattatagatgcagagcgatatggggaatggagaacggtatggaacgagtagatattgccattattggaacgggaccggcaggtgtgtcggcagcgattaccgcgaaagtgagaaataaaagtgtactgttaatcggcagcagagaactcagcgagaagatgagcaaggcgcatcagattttaaactatccagggctgccggaagtttcaggagcagatctggttgccgggtacaagaagcagttagcaggtcttggcatcgaggtgacggagaagcgcgtgaacgcggtctatgcgatgggagattattttgggatccaggcgtccggcgagattcttgaggcgtccaccgtcattctggcggcaggaatcgtcatgggaaaaccgttcccgggagaaaacaagctgcttggaagcggcgtcagctactgcgcgacctgtgatgcgcagttcttccgtgggaaggaagttgcggtgatcggatacggcagggaggcggagcaggaagcagactatctggcggagattgtcggaaaggtgcattatttcccgatgggaaaagaggagccgcagctgtcggatgccatagaggttgtgcatgagcggccgaaagcgatcacaggcacgcagacggtaagtgcgcttgagacggacgcgggttcccatccggtggacggcgtatttatcttaagagacgcgatcgcaccgttacagctcgtgccgggacttgcgacggaggagaatcacgtaaaggttaatctccagatggagacaaaccttccgggactctttgcatgcggagacattaccggaaagccgtatcagtatatcaaggcggcaggacagggaaatgtggcggcgctgtccgcggcagagtacctggataagaaaaaaagagagatctaaggaggattatcatggttaagaagattcagaacaataatatggatgaagcgttacaggcaaaggcagcagtggtggacttttcggcagtatggtgcggaccgtgccagatgcttgcaccggtactcgaggaactggcggatgatctggacggtaaggtagcattttacaatgcggataccgatgagaatacacagcttgcgattgcaaacggcatcacaaacattccggcgcttttattcttaaaggacggcaaggtggcaggcaagaatgtcggattcatgccgaagcctgaactggaagcatgggtaaaaggatgtatggagcagtaacagcacacagaagatacggagtgaacacatatgggatttgacgaggaacatccgttagcgacgatcgtggaaagcatgttagagcgcacgcatccggattataaggagacaccggacatcaaatggaactttaccaagtttttgattgacagagacggaaacgtggtggagcgttttgagccgacggcggatatggatgttgtccgcgaaaagattgaaaactatttataagcgacaggtgccggaatgaaagataagtatgatgctttaaaattagaaaatcaactctgttttccgctttacgcatgctccaaggagatcgtgcggcgctacaagccatatctggatgagattgatctgacctacacgcagtatattgcgatgatggtgctgtgggagcatggcaggatcaatgtgaaggatatgggggcgcttttgtacctggattcggggacgctgacaccggtgttaaagaagctggagcagaagggctacctcaccagagagcgtgatcacgcagatgagcgtgtgttaaatgtgacgatcacggaggcgggagagcagctaaaggagcaggcggtcgacattccgcggaagatgggcggctgtatcggactgtccggggaggatgcgagggagctgtaccgcatcctgcacaaggtgcttgcgttgatggagcaggaatgaaatggccacggtatgaaaacagtagacaatatacaaaaaactgatataatgaattcatacttatttaaaggagagtttgttatgattgagagaagaaatattgcggtgtgtattgtactgacacttgtaacctgcggaatttatggcatctactggatcgtgtgtctgaccaatgacgtaaatacggtttctggtgatgtgaatggaacatccggcggtatggtggtgctgctgacgattgtgacctgtggaatttacggcatttactgggcatataagcagggagagaagcttgactttacaaagaataaccgtggaatcccgtcaagcaacagcggtgttttgtatctgattctccagatttttggatttggaattattgcatatgcattgatgcagaacgagctgaataagctggcataacagatcggaaatgtaggatgacgaaaaaagcacgtttgaaaaaattgctgatgaatatatttttactgggaatggcgggactgttgtacggaatattcgtgtcgtacacagggctcgccattccctgtctgttccggaaagtgacgggactgttgtgtccgggctgcggtgtgacgggaatgtgtgtggctctcctgcatcttaactggaagggggcttttttctgtcatccggtgctgtttgtgttgctgcttccacttacggcagtatttatctgcagtgcggcggggtatgtgcagaatggcagattccggttcgcccgctggcagaatctcattctttacgtcagcgtcgccgcgcttgtaatcttcggtgtggcgcgcaatctggtgcgttttttgtgaaaaacaggaaaaaaatagattcagaataatttaacgtggtcaacacatgatcttcacattggctttctatactaaccctatcaaaagaaaacagacattgacagagtcagagaggaatgaagatcatgaaatggaaaaaattagtaacattgggctgcgtcgtagttatgacggtatcatccgtaacagcatgcggcagtaatacaacagagaaccagacggtagaagcaacagagcagagtgaggagaaccagagcgattctgtgatcgtgcaggttacagcagttgaaggcgatcagattacagcggatgtaggaacacttacaaccgcaagcgcagatgcatccggaaatggagcaccgggcggagacaacagtggaaacggagcaccgggtgatgcaccaagcggagacgcaccgggcggagacaacagcggaaatggagcgccgggagaagcgacaagtggagacgcaccgggcggagaagcaccgagcggagacaacagcggaaacggagcgccgggagaagcgccaagtggagaagcatcgggcggagacgcaccgagcggagaagcaccgggcggagacgacagtggaaacggagcgccgggggatgcaccaagcggagacaacagcggaaacggagcaccgggagaagcgccgggcggcagcagttttgaggcttccggtgagagcattacctttaccttgacggatgatacggcgatcacgttagagtacctgcagggaagcggcgagggaaccgcagatgacattgcagtcggcagcgtattggaggtagttctggacgaagacaaccaggcagtgtctgtcactgtgcgcaacttaaatgcaggcggcggatttggcggaagcggtgaggtgacaaacggaacttctgcaaatacgattaccgaggataccgaggtggatagtgagacttacacatccaccggtgatgatgagaacgcacttcgtgtcgacggagcgactgttaccttaaaagatatcacgatcgagaagacagccggctcctcatcgaacacagaggatggagatttttacggactgaatgccggacttctggtgctaaacggcgcaacggcaacgattacgggagcgacggtcaataccagcgtgacaaacggtaacggtgtgttcagctatggcgagggcacggttgtaaatatttcggattccacgatccgcacgacagaaaataattccggcggtatccagacgaccggcggcggcaccatgaacgctgcaaatctggatgtcgagacacaggaaaattccgcagccgcaatccgaagcgaccggggcggcggtacggtcaatgtggacggcggttcctatgtgacaaacggaacaggaagcccggcaatctactgtacagcagatatcagcgtgtcagacgcgactctgacagcgaatgccagcgagggcgttgtggtagagggcaagaattccgttgcactgacagactgtgatgtgacaggaaatatgagcaacacctataatggagactcggacgaaaacattcactgcattatgatttatcagagcatgtccggtgatgcagatgtcggagaggcgaccttctctgcagagggcggcagcattacggcgaagacgggagatatgttctatattaccaatacggattgtgagattacactcaaggacgtcgcatttacacttgccaatgatgtattccttcgcgtggagggcaactcttcctcccgcggatggggcacagagggcgcaaacggcggagatgtgacactgacggcggattcacaggagtttacgggcaatattctcgtggatgagatctcaagcctggtgcttaccatgaaaaacggcaccagctacgagggcgccatcaatccggacggagacggcggtacggtcgacgtgaccctggatgacaactccacctggacactgaccggtgacagctatatcacaagctttgacggtgataccgccaatatcacggcaaacggatatcatctgtacgtgaacggagagcaggtactgtaacagattggagaggtagttgaaaaagaggctgccacatatcacaggtgcagttgatgataagtaatattacaggaagcacatgatgcagattccgggtggaactgcataggaaacattcgttggagaaaaatgtgtgtatttcttccagccggatgactgcatctgattccgtgtctcttccacgtttggacactgacgggtgcatgtccgacacaccggagacaatgggcggactttctggtgtccctaatggcacctcttcacagacaatataaaaccgcgcgaaccgaactcgccggcatttgctattgaaaatagggcagatgccgactcagacagcggcttcgcgcggttatgttttgttcagaggtgccataagggacacacacaaaagtcctacaaattgtcttccggagtgcggacatgccccgtcggagtgctccaaacttggaaagacacggatcatcgcagatgcagccaccggctggttagaaatgccgcattttttgaacagaatgttccctaggcattccacccgaaatcgtaacggtatgcttctcataatattacttatctcgtcaaacaggacgatctgctgaatgcggcagctttttttcaagagagagattatgtattttagtggaattatatcagacgcttcggaagaatttcggatatgtggaaaaaggcagcgaaagtgtgctatagtgaatgaaaagaatacaatcatactggaggggagcagagatggaactgctggatattgtggacgaaaagggaaatccgacaggagagacagtgccgcgggaggtggcacaccgtgagggaatccggcaccgtacggcgcacgtgtggatttttcgcagacgcggcggcgtagtgcagatccttttgcagaaacggagcgacaataaagattcagatccgggctgttatgacatttcaagtgccggtcatattcctgcagggagtgattatattccttccgcggtgcgggagttgaaggaagaactgggtgtggacatgaacggcgatgaactgatttattgtggacaacgcctgttccggtttgaaagggaattccacggcagcatgttttgcgacaaccaggtcagcaacgtgtatgcactctggcttgaccgcgaggaggaagcttttgtactgcaggaggaagaagtgtctgaggtccggtggatggacttcgcggattgcgtatctgctgtccgggagaaccgaatttcccactgcatttacatggaagaactggaacttctgaaaaatgcactgcatctgcattgattcgaggggaggcagggaaaacggctcagtatttccagcggagatccagccggtagtgtccgtccttcaccgtgatcggcagatagtcagagtatgtctcctgtgcctccttggagtaatagcggatggtgactgcggttgcccagggggtgtcgtgatatacggtagttccctccagcaacgaaagatcccccacgtttttgcggaaatacaccagatcatcatgaaaatattcttctgtgtcttccgcggttacagggatatctctgccgttataagaaagcgcggcgagggagccataatcctcctgctgtaaaagcgcgcagacctgtgcggcaaaatcatcggtatcctcccggcagacatatttgccggttgaaaatgggagaatgtgccgtctggccggaatgtacttcaggcgttttggatcggaacttttatagaaaatggtgccaagtacagacgagccgtctgcaccggcgcgtgccacgcggtttccggtgaaaaatgcctgaccgagtgaaagatctgcagtatagcgcgttccatcaacctcatattgcacggttaccaggtaatcggaaaaacgtctgatgataccggaatcgtaggcaccgatactctggtcatattcggtctgctccacatgaaggacttcgtaatcatccggcgtgagccggccggtataggcgatacttaaaaagatggtctgaaaaagagtaaaaacgagcccgagtacaaccagccacagggcgagatagagaataccgccatatctggattcgttgatgaaacgcccgagacgggtcgcacaaaaatgcgaaaaatgggggcggaaccagcggttgtgattgcccgggctgtctgaaaatgtcgacttcatagaaattctcctgaatataatgagctataaacgggtttgtgaaagctgtatcaatagcagtatagcataaaaaggcgggattttctattatttgacaggcgggaagtgctgtattaagataagggacagatttctggcagaaggagaagacagttggagcagataaagtattatatggcacccatggaaggcgttaccggatatgtctaccggaatgcatacgcaaaatattacggtggaatcgaacgctattttacgccgtttgtggcgaataaaaagcttggacaccgggagaaaaatgacgtctgcccggaacacaatgcgggaatggcggtcgttccgcagatacttacgaaccgcgcagaagattttctggcgatcgcagagattctgcgggagtatgggtacgatacggtcaacctgaacctcggctgcccgtcgggcacagtggcggcaagaggacgcggcgccggatttcttgcgatgccggacgagctggatcattttctggaagagatttttgaaaaatgtccgctccggatctccatcaagacacggatcggaaaagagaacccagaggaatgggagcgtctgcttgccatatatgagaaatatccgctggaagaactgatcgtacacccgagggtgcagaccgatttttataagaaccgggtcaatctggaggcatttgcactggcagagaaaaacagcagacattcgctctgctataatggtgacattgtggacgcagcgtccgcggcgcacatccgggagggctttccgtcggtggataagttcatgatcggccggggactgataaagcacccctggcttctggaggaactttccggcggcagacaggaaaagcaggagcgaaaagagcgttttctccagtttcacaatgcgatcctggagggataccggcagcagatgtccggggacaaaaataccttatttaagatgaaggaactgtgggcgtactggggagaaaactttacggatgcggaccggcatctaaaaaaaatccgaaaatgtgagcgggctgctgagtatgaatgtctggtggacgcgctgtttcgtgaaaaagagctgtgcgtgtaggaaaagagtggggtatgcggcaatagatttgtgtgatataacaaaaaagaagctttccaatctgtaacatttatataaaaagacgaaagggactttttatttgctgtaaaaagtattatactgtactccgtagtatgcttcatgagaacgataggggaattggggaagaggttttaaagagggtatatggaaagctatacgttagaggagaaagtgcttcgcaaggtcatgcggaatattccgatgggactgattgtgagcaaagagggatttcggcgcaagatttactatgtcaacgacacggcgtgtgagattatgggatacacgcgggaagagtatatcagaaagatgcaggacggatggacggatctgatggatgtcgatctgcgggaggtcatccgcgagcacaatgaacagattcgttccgggacgccgtttgaggtgctctcaagaccgcagacgaagaacggcggttacaagtggatattaagcagggtgaatgtgcagatgcaggagggaccgctctgctatgtcagctttatggatgttaccgaccggatggagcgggaggaactgtgccggcaggagaacgaggtgctcagggagcaggcgatgcaggactcctttacgaagcttctaaaccgcggcgcgctggagaagcatgtctgcgaggcgcttcaggagagaggcggcgatgaggaggatgcattcattcttctggatgtcgataattttaagcagatcaatgacatttacggtcacggagtcggggatatgattctgatgcggatggcgggaatcttaaacgaagtgtttggagaccattcctgtatcggcaggatgggcggcgatgaatttgctgttttcctcagagacatcggcgaccggagagagattgaagagaagattcaaaagcttcttacggaggtacgcgccgaaaaagaacggatgcacctgagcaaggaaccgacagccagtgtcggcgttgcatttgtgccggaatcgggaagcacgttcgtggatgtgtaccgggcggcggatcaggcgctgtatcacgtgaagaactcgacgaagaatggaatggcgttctatgattttgtataatttttcctattgaaaaaaatcatcatatactgtaagattaagatgttatatgactgacggaacaagtggaagaaccacatggagtataacgtatctaatgccgaccgtctgggcgaatgtacccgggcagccggcttgttttgaatcaggggctttttatcggaaaagtacccgggattcccatctctaagacaaaagatgctttggttcaaaaagcataaaatacccactgagagtaagacaagacaaacatgcctgacaacaaaacttgatattgacagggaaaatcgtgctgtgctatagtcataaaggttagctacaactaactaatatcatgttttgacaatgctgtctgcgggcagggaacataattacattacaaagtaagcaggaggaagaatcatgcagaatgaatggagaggctttcagcggggaagctgggaggaagagatcaatgtcagagattttatccagaaaaactatacgccttacgacggggacgacagctttctggaaggaccgacgcaggatacgacagatttatggaacgaagtgttagaactgtcgaagcaggagcgtgaggcaggcggtgtcctcgatatggataccaagattatctccacgatcacatcccacggaccgggctatctggacaagagcaaggagaagattgtcggctttcagacagataagccgttcaagcgttccctgcagccgtacggcggaatccgcatggcagtgaaagcctgcgaggataacggctaccatgtagatccggaagtggtggaatattttaccacgcacagaaagacacacaacgccggtgtatttgatgcttacacaccggagatgcgcgcatgccgttcggcacacatcatcacgggacttccggatgcatatggccgcggacgtattatcggcgattacagaagaccggcactctacggtgtggatcgcctgatcgaggacaaggaagaacagctcgcaacgacccgcacgatcatgtactcggatgtcatccgtgagcgtgaggagctttccgagcagatccgcgcactcaagatgctgaaagagcttgcaaagatttacggctgtgacatttccaagccggcgaacaacgtgctggaagcgacgcaggcggtatatttttcctaccttgcagcagtcaaggagcagaacggtgcggcaatgagccttggacgtacctccacattcctcgacatctatgcggagcgcgatctcaaggaaggaacgttcacagagaaggagatccaggagatcatcgaccagtttgtcatgaagctgcgctgcgtgaagtttgcacgtacgccggagtacaactccatctttgccggagatccgacatgggtgacggagtcgatcggcggaatcggtgtggacggcagacacatggtgacgaagatgtcctaccgctacttaaatacactcaacaacatcggagcagcgccggagccgaacatgaccgtgctctggtcggtacagcttccggagaactttaagcgtttctgcgcacagacatctatcaagcactctgcgatccagtatgagaatgacgacatcatgcgcgtggtacacggggatgactacggaattgcatgctgtgtatcctccatgcgcatcggcaaggagatgcagttcttcggcgcccgcgccaaccttgcaaagtgccttctgtacgcgatcaacggcggtgtagatgagatcagcggcaagcaggtcggaccgaagtaccgcccgatcatttccgagtacctggattacgacgaggtgtgggataagtataaggatatgatgaagtggctggcaggtgtttatgtcaatgccttaaacatcattcattatatgcatgacaaatactgctacgagaagctggagatggcgcttcatgacaagaaggtgcgccgctggttcgcgaccggaatcgctggtttttccgttgtggcggattccctgtctgccatcaagtacgcaaaggtaaagccgatccgcgatgagaacggaatcactgtagacttcgaggtggagggtgacttcccgaaatacggaaatgatgacgaccgcgtcgacgacattgcaaaggaagtgcttcacacattcatcggctatgtcaagggcaaccacacctaccgcggcggaatcccgacgacatcgatcctcacgatcacatccaacgtatcctacggcaagaacacaggtgcgacaccggatggcagaaagaagggtgttgcctttgcaccgggcgcaaacccgatgcacggacgcgacacgaacggtgcggtagcatctctcgcgtcggtagcgaaaatgccgtttatggattcccaggatggtatctccaacacgtttaccatcgtgccggatgcactcggcaaggatgagacgggcgaggagcagaaccttgtggcgctgctggatgcttacgtcgagaagggcggacatcacttgaacgtcaacgtattgaaccgcgagacgcttttggatgcacagaaacacccggagcagtatccgcagctcacaatccgtgtttccggatatgcggtaaactttatcaagctgaccaaagagcagcaggacgaagtcattgcaagaaccttccacgagcgcatgtagttcatgtggaagtgatacagacaggataaatcgcgcgaaccggaaccggtgccctgctgcttttgcggcagggacaccgggatacgccggctcgcgcgattgtattatgattatcagatggatgggattaaaaaggaggactttatgggaaaaattcattcgattgaaagctttggaactgtggatggaccgggagtccgctttgtggtgttctttgagggatgtcccatgcgctgcctgtactgccataatcccgacacctggcatctggaggatgggcaggagatgagcgcggaagagattctgtcacgcatggagcgcaaccggtcgttttaccggaccggcggaatcactgcgaccggcggagagccgatgctccagattgattttttgacggaactgtttgccggggcaaaggaacgtggaattcatacctgtctggacacctcgggcattatgtttccggggtgcggcggcacatcagaggaggagcgggaacgcttaaagaaggtggaacggctgctttctgtgacggatcttgtgatgcttgacatcaaacacatggatgcggaggagcacaggaagctgaccggacaggacaatgagaagatacttgcgtttgcaaggtatctggatgaaaaacagataccggtctggatccggcatgtggtcgttccggggattacatttcagagggaagaactggaggctctgggccggtttcttgcaacactttcaaatgtggaaaagctggaggtacttccgtatcactccatgggaaaagtgaaatatgacaatctcggcattgattatgcattaaaagatacgccacagctcaccaaggcggaggcgaaaagtgcggagagcatcattctggaggcaatgcgtcaggcgaggaatgtctgactgccggaacggatcgtgcagggaatgatagagaaagtgcatgaagtaaacgatgccgcgtccaatatggcagctatcacggaagaacagtctgcatctgcggaggagatagaggcaacggcggtcagcattcagaaactggcggagattgtctctgagaacagtgcagatgtgcagaaagactcgaaggagatggaaaacacggccgagacgctgaaggaacatatttccaggtttacgatttagaacttgcagaagaggtactttcgtattatagtgtagatagagactcagattaagaaaggagcatgcattatgaagatcaagaacatcacggatatcgacggattttttaaggtaatagactcctgtcagggaaaagtggaactcattaccggtgagggggacagactgaacctcaagtcaaagctttgccagtatgtgtcacttaccagtattttaaagacggatgtggagattccggagcttgagcttgtcgcttacgagccggaagatacagagaaaattattaagttcctgatgaagggctgagaaaaagaaccgtcaacacaggttggcggttcttttttggtttgcgcgccatgggcgcgctctaacgggtgaaagtcccgaacacgcctaggcaacgaggaagtgtatagccgaacagcaagggtgtctatcgtgaggtggaatctgaaggaagctgtaa

SEQ ID NO: 9 - DNA, 237739 bp, Roseburia hominis
aagatgagatatccctcacataagtgagtaagatcccttgaagactacaaggtagatagggcagaggtggaagcacggtaacgtgtggagctgactgttactaatcgatcgagggcttgaccaaatataacgaataatgtttgcaggtttgatggatgatttctgtgtgaagttttgaaggtacaatttttatggcccaatggctcagttggttagagcgccgccctgtcacggcggaggtcgcgggttcgagtcccgcttgggtcgtttttatatgggatcttagctcagctgggagagcatctgccttacaagcagagggtcataggttcgagccctataggtcccatttcttattatatatgccgatgtggctcaattggcagagcagctgatttgtaatcagcaggttatcggttcgagtccgatcatcggcttttcacataatttcatattgtgtgtaaatgggcagattcccgagtggccaaaggggacagactgtaaatctgctgcaaattgcttcggtggttcgaatccacctctgcccattcttttgataacaagtattatcagaagtaacttcatagcgcgggatggagcagtctggaagctcgtcgggctcataacccgaaggtcataggttcaaatcctattcccgcaactcaatgcgaaagcatttgtgcccagttagctcagttggtagagcagaggactgaaaatcctcgtgtctctggttcgattccggaactgggcattgtgttttgtttaaaaataatatgggatactagctcagttggtagagcacctgacttttaatcaggttgtcgggggttcgaatcccccgtgtctcattaggaaatgaagagcggaaagccggtaaattcaaggcttcccgctctttttatgccattttcccagtagggaaaagtaagcaaaagttgatgatttttaatgtccgcaacgcgtccgcaaaaaaatacggcagggtgcggaagggtttctatttcacactcacagcgggggaagtgttgctcggcgcaattgctgtggccggtatgtttttcccggcacagcttgtggcggtatttcagaatgatccagaggtcgtggcgatcggcgggattgcgcgccgtgtccagcttgtggcgctgttctttcagccgatgacggtctgtgcgaacatgatgttttagagcatctggaaaaacggcagggcgacgttgcttgccatgttgcagaatcttatgtattatagtgaaaaaaggttgacagtcccggcataaagctgtatcatacttaagtggattcgcactgcaacgcgttgcagtgcgaaaatataagaagataccatatgcagcagtgcgtatgacagaaaggatcaatagatatggaaatggagatggaatttttgcggaagctgccgacaccgcaggagttgaaggagcagcatccggtcagtgcacagattgtagctaccaagacgaagagggatgacgagatcaggaatatttttgaaggaaaatcggacaagctgattcttgtgattggtccatgctcagcagataatgaggatgctgtgatcgactatatttcaagactccgcacggtgcaggagaaggtggcggataagatttttatgattccgcgcatttataccaacaagccgcgcacgaccggaatcggttacaagggcatgctgcatcagccggatccggagcgggaatcagatatgctaaaagggatcattgcgattcgtcacatgcatatgcgggcggtggaagagaccggctttacctgtgcggacgagatgctctacccggagaatcaccgctatctttcggatctgctgtcgtatgtggcgattggagcacgctcggtagagaaccagcagcacagactgacggcaagcggcgtgggaattccggcaggaatgaagaatccgaccggcggagatatttccgttatgatgaactcgatcattgcggcacagcacggacatacgtttttataccgtggctgggaggtcaagacgaccggcaatccgtatgcacatgccattttgcgcggatatgtggacaagtttggcagaaatattccgaattatcattatgaggatctgcagaatctgctggagcattatgaagaggcgaaggaagccggacacgagctggcacatccggcggtcatcatagacacgaaccactccaattccagcaagcagtttatggagcagatccgcatcagcaaggatgtcctgcacagctgtaaggtgtcaggagagataagaaagctggtgaagggactgatgatcgagagttatatagaagacggagcacagaaggtcggtgacggctgttacggaaagtcgatcacggatccgtgcctgggctgggagaagaccgagaagctgatctacgaattggcggaactgtggtaaaggagagagaatgtaccggatattgatcgtggaggacgatgagatcattgcgcgaagcttaaaaaagcatctggaaagctgggattatgatgtggtctgcgtggaggatttttccgatattatgaaggagttcgcgggggcggcgccccagctggtgctgatggacatcaagcttcccttttacaacgggtaccactggtgcagcaggatcagggagatgtcgaaggttccggtaatcttcgtgtcgtcggcgtcggataatatgaatatcgtcatggcggtcaatatgggcggcgatgatttcattgccaagccgttcgatctggatgtgctgaccgcgaagattcaggcgcttctgcgccgcacctatgattttgccgggcagaatacggtgctggagcatagaggcgcactcttaaatctgggcgatgcgacactcacctgcggggagacgcgggtggacttaacgaaaaacgaacttaagatactgcaggtgctgatggagaacaaggagaagatcgtgtcccgcgatacgttgatgacgaagctgtgggaaagcgacagctttgtggatgagaacaccctttccgtcaacgtgggaagactgcggaaaaagctggatgcagcaggacttccggattttattttgacgaagaaaggaatcgggtaccatatcgggtaggggattttgatgaagcagaaaataggaagatcctacataaaatgccgtctgaaatggattgccgcagtgactggctgcgggatcgtgatgacggcagtcttatttttaaatgaagtgcctgccggggagattgcctacggcatgctgttgtgtctgggaattctgctgcttgcagtgacgatggataggataagttacggcagacggcacagggaactgctggcattgcggcagtcaataacggtatcgctggagaatcttccggaacccggcgaaatcctggaggaggattatcaacggctgcttgggcttttggcggaggagaaaatgcgtatctggaatacggcagtcagcgaaaagcgcgatctgatggaatactataccatgtgggtgcaccagatcaagacgccgattgcggcgctaaagcttttaatcgaggaggaagcggatattcccggtgcagaggagcctttgggagcggacagggaaaggctgcagcggcagagggagaagcgcaaggatgaagaactacagcagctgtttgcgattgagcagtatgtgaacatggcgctttcgtatatgcgtctcggatcggagaccacggactttgtgctgcggcagacagatctcgacgaagtgatccggatggcggtgcgccgctatgcgagacatttcatcagcaagaagatcgtactgcactacgaggagacgggggcacgggtgctcaccgatgaaaaatggctcggctttgtcatcgaacagctgttgtcgaatgcgctcaagtacacgcatgaggggagcattacgattgggatggaggagggacgccttaccattaccgatacggggatcggaatacgcgcggaggatctgccgagagtctgcgaaaaaggctataccggatataacggtcatgccaaccagaaatcgaccggaatcgggctgtatctttgcagcacaattttaaaaaagctggggcacagctttacgatcacatcgcaggaaggaacgggaacccgggtgatgatcggcttcccggaagagtcatagaagaatcttacaaaaacgtaagaaacagcagagaaatgtaatccaaagaaatggcttgcatttctctgttttgttatactgggtacagtcaaggaaaggagagagacacatggctattctggaagttcataatttgaaaaaaatatatacaacaaggtttgggggaaatcaggtgcaggcgcttgcagatctgaatttttccgtggaaaaaggggagtatgtcgcaattatgggagagtccggttcaggaaagacgacactgcttaatattctggcggcgttagacaaaccgaccgcgggggaagtgctgttgaataataagaacattgtgacactcggcgagagggagatttccaaattcagaagggagaacctgggctttgtttttcaagattttaatttgctggatcatttttcattaaaagataacattcttctgccacttgtcctggcagatgcaccggtgcaggagatggaggagcggctttggccgattgccgaaaagcttgggatcgatgtgctgcttgagaaatatccttatgaggtttccggcggacagaagcagagggcggcggttgcccgcgcactgatcacccgtccgcagctgattctggcagatgaaccgacgggggcgctggattccagggcgaccgacggactgttgaagctgtttggcacgatcaacggggaaggacagacgattcttatggtgacacattccacgaaagcggcgagccatgccaaccggattctttttatcaaggacggcgaagtatttcatcagctgtaccgcgggaatatgacgaatgaggagctgtatgtgcggatttcggatacgctgacggttcttaccaccggcaaagagggaggctatcatgcgtaagttatatgtcaaactggcagcagtcaatatccgcaataacagacagctttacctgccgtaccttctggcgggggtgttctcggcagcgatgttctatctggtaatgtccattcaggataacccggggctggagcagatgagaggcggcgcctatgtggcggtaacgctgctgctcggagtgatcattgtcggactgttcgcggcgattttcctgttttataccaacagcttcatcatgaagcggcgcaagcgggaattgagcgtatacaatatacttgggatggagaagaaacatatcgccagggtgctttttctggaaatgctgtttacggcggcggttacgatcggcggaggcctgttgttcggcattgcattcggcaagctgatgacgatgcttttgtaccgcatgacaggattcaaccagagcgttccgtttaccatttcgctgacgggatgccgccacacgctggtgcttttcggctgtatatacgcggtcacgcttttctataattttatgcagataaagctttccaacccgatggaactgctgcacagcgccaatgcgggagagcgggagccgaagacgaaagtgctgctggcggtgatcggggcggcggcactcggcggcggctattatctggcgcttacggtggcggacgcagtctctgccattaccatgttttttgtggcggtgctgcttgtgattctgggaacgtattgtctgtttaccgcgggcagtattgcggtactgaaactgcttcggaaaaataaaaactattattacaaatcaagacattttacgacggtttccggtatgatctaccgaatgaaacagaatgcggtggggcttgccaatatctgtattttatcgacgatggttctggtgacggtttccaccaccctgtgtatgtatctgggagtggaagatgccctaaagcggcgttttgcacatgaggtgtcagtggtgtcctactataatgcaatgccggaatatccggaggaggtggatgcactggcggaagcatccttaaaggattccggacgggtgctgacggggcacagcgccatgttgaacatgtctctgaccgcggtgcgcacggacgatggattttccgtgaccggcatcggagcaggcacagattacagcatcaacgatgtggtgctgctcacgattctgcccaaatccgactgggagaattataccggtgaaacggtcggggaacttgaaagaggggagattgcactggcgtcatcctcttcctatgaaaaagggacgctggcgctcgacaatgagatatatcaggtaaaacagatctgcgcatatccggaagcggagcgcgattatctggatgacatggcagacgacagtgtatttatgattgtgccggatagggagacactgggacagatttttacggagttgaaacagaactgggacgaggagcgtgtaagcctgcagatcaaatacaatatggcgtttgacatagacggaacagcagaagaaaaagtggcagcggaaaatgcgcttcactcggtgatctcgtcatacaatgacgggcatccgtcggatgatacaaaggactcttattccagaacgtatgtcgagtgccgggcacagaaccgggatgaatactacagcttaaacggcggtctgctttttatcggtctgtttctgggtgcgatgttcctcatggtgacggtgctgatcattttttacaagcagatctcggaaggctatgaggacaaggaacggtatgccatcatggagaaggtcggcatgagcaatgccgaggtaaagcggagtatccgcacacagatcctcacggtatttttcctgccgatcggggcagcagtgcttcatgttgtcatggcgttcccgatgatcaaatggattctggcggcgttcagtctcaacaataccgcgctgtttgccttatgcgttgcggctacggcagtggtgttcctgctgatttatctgctggtgtttgcactgacttcccgcagctattataagattgtggggaaccaggtatagggaaaatggttctcaccataaaatccaaaaactcttccagtgtcattttagggttctgcagccagcgaatgacactggcgagaagaccggacaggtaaaaatcggcaagaagcgccatctcgtaatcgtcatgcccctccgagggaacaaaataacggtttaagaggggccataccacttctttcaggcgggtcgcaaaatgcgggtcgccatgatcgcttaagagtacagcagcataggtttcatatgtctgcatcagatctaaaagaattcccatctgaccggaaaggtcaaaggtatcatttttttccagagaatcattcagaacatctgtaattttcccgaggatttcttcctcaatctgatcaagaagatcatatacatcattatagtagagataaaaggtgccgcggttgtaaccggcaagctcggtgatctccttgatggagattttttctatcggtttttgcgcgtagagagaccagaaagcgattcgcagattatttttggtctgttctgtgatatggggctgctttttcatgaaaacctcccggtataagatttgcgttcattttgtcttcgcgtaaattatagcacgacaacgtgttgtcttcaattttttaacacgtgtggagaatctgttgattgatgaaaggcagcgcgggtagtacattaggcatagaaaatggaatctgcatagagataaaaaacagagtctgggaagaaaggcggccttttatggcatatatcgaatttaataatgtaacgaaggaatataagacaggtgagacttcgatcaaagcgctggatggagcctcattttctgtggagaagggcgaactggcagtgattctcggttcctccggtgcagggaagacgacggcgctcaatattttaggcggaatggatgtgccgactgcgggcgggatcaaggtggatggcagagatattgcaaagtataacaaaaagcagctcgtcggataccggcgtaccgatattgggtttgtattccagttctacaatctggtgccgaatctcacggcgatagagaatgtggaacttgcggcgcaggtgtgcagaaattctctggatgccggggagatgcttacaaaagtgggactggcagaccgcaaaaataactttccggcgcagctctccggaggggaacagcagcgggtatctatcgcgcgtgcgatcgccaagaatccgaaactcctgctctgcgatgagccgacgggagcgcttgattataataccggaaaacagattctgcagctgctgcaggatacctgccggaaggatgggattacggtacttctgattacgcacaactctgcgctggcaccgatggctgaccgcctgatccgatttaagagcggaaaggtgacagagattacctgcaatgcgcaccctacgccgatcgcggagatcgaatggtagcggggcagaagagaaaggcagggataccgatgatgagtgcatataataaggagatatggagggcaatccgcaaggagaaaaaacggtttttctccatcatgctgatcacgattctgggtgtcggaatgcttaccggattgcgggctgcctgcatggatctgcgctattcggcagatcagttttttgacagacagggactgtacgatatcagtgtcgtctcgacgctcggacttacggagaaggatgtggatgccctaaaggcactggacggtgtcatggatgcagtcggcgtctacagtgagacggtacatgcgaaagtaaatgatcatgaggtcagcattgcggtctgcacgttaaatgacaggggaatcaatcagccgtatgtgttgtccggcaggctgccggaggcggcggatgagaccgccgttacaaccgcgtttgcggatgagacgggatgcgggattggtgatgtcattgcggtggatacagcagatgatgagtcttcgctgcgctacagccgttttaccgtaacgggaattgtgctggatgtgcaggatgtcaacaatgcaaagggagcgacggcgttccgttccgggcaggcggaggaggacactgtgttcatcttgccggaggcggcagacagtgatatttacacacaggtctgccttaccgtcgatggcgcggcagaactgttctgttattcagatgtctatgaggaaaaggtcgcgcaggtgacggatgcgattgaaacgcagattaaggaaaatcgggagcaggcacggtatgcggaagtcacggatgaggcgaaagaaaagcttgcggatgtgaaagcggaggcggaagagtcctttgcggaggcggagcagaagctttcggatgcgagagcggaactggataatggctggcaggaactttccgatggccaggaggaacttgatgcggcaaaacagcaggcggaggatggttttgcggaagcgagagatgaaattgccgcgggaaagcagcagattgccgatggcagcgcgcagctggatgcagcagaacagcagctttctgaaggcgaggcgcaggtggcgtccggtaagcagacgctttcggcaaaggaagaggaaacctatgcacagttagacgcggcacgcgcacagcttgcagagagcagtaaacaggcagcggagacggaggcggcattggaagcgcaggcgcaggcagtcatccagacgtatggggaaatgtggcccgcggaggcatgggatgcctatgtgcaggcggcagtggaggcgtatttacccgtagcaagagcggtggtcgcagagcaggatgcctcgcaggcacaggcggcggtaccggtactggtggaggacagccagagtgcgtttttggaggcgttgcagcagcccacagccgatcagctggtacagcttgcaatgggaatgggaaatgtgcgggcgacaatccaggcgctcggcgaggcacaggcgcagctcgatgcggcagaacagacggcacggcagcagtttgatgcggcatggaacgaactgaacgaaggggaagcacaggtcatcttcggaaaatcgcagattgccgataagagagcagagctggagaacggaagtatggcgctttccgaaagtgaggcgcagcttgtgaaaaaggaacaggagactgcggcgcagataaaggacggtgaggcaaatctcgccgaaggacgggaaaaactgctcaaaggcgaaacggaatacgcggacggcaaggcagaatatgaaaaaaatcttgcggacttcaatgagacgattgcggaggaagagcaaaagatagcggacattgatatgacacagtggtatgtacaggatcgcacgtctctgagcggctatgccaacgtgaagagcgatgcggcgtcgattgaggcgatcggtacggtcttcccgatcgtatttttcgttgttgctattctgatcagcctgacgacgataacccgtatggtggaggaagaccgcggtctgattggaacctacaaggcactcggctttacggatcgtgagattcgcagaaagtatctggtgtatgcatgtgcggcgagtgtatccggcggaattctgggaaatatgtgcggatttgttctgctgccggagattattttccggatttttgacacgatgtatctgttcccggattatttgctgcgctttgcgccgctgctcggatgtggcggagctgcgctttttgtggctggaattgtcatcgctaccgcctgtgcatgtaaagcggaacttgtacatatgccggcagttctgatgcggccgaaagcgccgcgcgcaggctcccgcgtactgctcgagtgcatcacaccggtatggaagcgcctgtcatttctcaataaagtgaccgcccgcaacctgttccgctataaaaagcgtcttttcatgaccgtagcgggaattatgggatgcatggcgctcttactatttggatttgcggtgagggattcggtaacagacctgctgccgcgccagtatgagaacgtgtaccggtatgatgtcatggcagcgggggcagcatccgataatgacaagattctttcctatgtaaatggggatccgaatgtgcaaagtgcgctgaatgtgcagatttccacggtaaagctgaagaatgctgccggaaaggaagaaaaggcacagatgattgtcgtgccgggggatgagcctcttgcagagtacattggtctgtacaatcttacggatgaggagatcggtcttctggacggtgagattctggtgacgcagaatgcagcaaatgtgcttggatttgcggccggggatcaggtggagattcaggatctggatctgaatcagcaggaagtgacggtaagcggtctcgtccgcaattacctcggcaataatgtctatatgacagagaaaacctatgaatcgctgtttggcgattatgaaccgaacggggtatttttaaagctgtctgaaacatgttcagatgaaattacctatgcagatgaccttggcggaaaagagggggtcgtgtcctacagcagcaagcaggagctttcggatgagttctcggatgcgttcaccctgatcaatatggtggtttacattgtgattatcatggcggcggcactcgcgttcgtggttttatttacgctgtctacaacgaatatttccgagcggagcagagaactggcgacgattaaggtgctgggtttttttgaccgtgaggtgcatctgtatgtcaacaaagaaaccatgatactcacggcgatcggcattgtctgcggaaccccgctgggatatgcgtttgcgcagaccttaacgtatgttttgaacatgccgtcgatttatctggcggtgtcccttcacgggaaaagctatgccatggcggctggcctctcatttttgtttgcgatcctggtggatctgctgacgaaccgctccctggatgaaattgatccggtggaagctttaaagagtgtagaatagaaaaagcgccggcaccgatgggtgaagttcatcggtgccggcgctttctttttgtaagatttagatttgttaaggtttgatttagaaattgataagaaataaagataataatgtgatacgtagctgattgctacataaaactttattaggggagcgatatttgtgaaaaacatactggactatttggaaagaacaacagtatgcaatgcttggaaaacagcggttgatgacgggaatatttgtatgacgtggctggaattgcaggaaatgtcaaaaagcatcgggacggcattgtgcaaaagaacaggcagacaaaaaccggttgtgatattggcggaaaaaagcgcagtcacgttggctgcaatgtttggagtagtgtatgcaggatgtttttatgtaatggtggatcccaaacagccgatcgaaagattatgcgaaatatttcatacattgctacctgaaattatcatcataccggcagaaaatgaagcgcttctggaacaaacgggttatggagaatgtaaatgtctgttgaaagacattatgaaagagcagattgatgaaagaaaacttcttgcagtacgtaaagcatgcacagcggatgaccgtttatacggaatctttacttcaggctctaccggagtgccaaaggggattgtggtaagccataaatcagtaataaattttattacacattttattcatacattccggttcacagagacggatgtcattggaaaccaggctccgtttgattttgatgtatcagtgaaagatatttatacgtgtctgatgacgggagcggcacttgttataattccgacaaaactattttctgtaccacctgtgctgctggattatttgtgcaacaagcatgtaaataccctgatctgggcggtatcggcgcttacgctcatttcagcgttgcacggattgaaatatagaataccgatagaagtaaagcgggtaatgttcagcggagaagtaatgccggtaaaacagctgaggcagtggcagcttgcactgccggaggcggagtttgtgaatctgtatggaccatcggagattacctgcaactgcacttattacagggtaaaaagaatatttgaagatgatgagattctgccgcttgggaaagcctttgacggaagaaaagtatttcttatggatgatgaaggaaaagagatttcaacggcagaaaaaaacggtgaaatctgtgtgtcaggtgagtcgctcgcagaagaatattatcataatccggaggaaacaagaaaaaaattccggtggatggaaactgcagacggcatggtgcggtactattgtacaggagatctgggatattacagtgcggcaggtgagttgtatttttccgggagaaaagatttccaaataaagcatatgggacatcggattgaactggaggaaattgagcatgcgttgaatcagttggacggagtagaaaatagttgctgcgttatgaatactaagaaaaacagactggtaggtttttattttggaacagcagagtcaaaagaaataaaaaatggtctgaagaaaaaacttcctcagtatatgattccacatactattgtccgggttgcgcatatgccattaaataaaaatgggaaaatagatcggaattactttggaaaacgacaggaagtggtgacgtaatggatttggaaaagtttgaacatgcaattacaaaatacggaaccccgttatatgtatttgacatagatgaagtaaaaagaaagacagattattttagggacaggtttagggaaagcgcaggactgtgttttgcaatcaaagcaaatccttttctgacatgtacaatgtcgaaagtcacagacagaattgaagtatgttctatgggtgaatttgagatttgcagagaattgcagatagaagcggagaaattgctgatatccggagttctaaagaaaaaggaagatattactgagatattgaacatatacggggggagatgccgctatacggtagaatccgttgaacagctttacagctacataaactggagcagtacacacggtgagaaaatcaacgtatatctgagactgacaagcggaaatcagtttggtatggatgaggaggcgattgagaaaataattgcttcaagggatcagtttccaatgattaaagtttgcgggatacattttttctcaggaacacagaaaaaaacagcagaaaaattcagcaaagaaattgcgtatctggataaattttgctggaagatagaacaaaagtatggatttacaatgagtgaattagaatacggtcccggaatagcagtgccttattttaaagatcaggaagatactttagaagcggatataaaagtaattaagacagcaatatctggaatgaaatggaaaggaaaggtaatgctggaaatgggacgtgcgtttgttgcatcatgtggatattatcttacctgtgttcacgagtgtaagaaaaataatgacaggaattattgtattgtggacggaggaatgcatcagattcagtatgatgggcaaattcggggaatgtaccagccgaagtgcagaatgtatccagacggaagagaaggaaaaaaagaaaaatggaccatctgtggggcactttgtacagcgaatgatgttctggttcgggatattgagctgacagctcccggggagggaagcgttattatttttgaaaatgcaggagcctacgcgatgacagagggaatgtcattgttcctgagccatgaattgcctgcggtagtgttttacagtgaaaaggaaggctttaaattggcacgaaataagcaggaaacttacaaatggaatatggaggatcacaaataatggaaaagttgatgaatattttaatggaaatagacagtagtattgcatgggataaggaagaaaaattgatcgatgacaggattatggattcttttatggtaatatccctgatctctgaattggaagaccagttccagattgagatagatgcgtcagaaattattcctgaaaatcttaattcagtcaatgccatgtggagaatgataacaaaattacaggagagttgatatggcataccatacagggatatatttgcttctgtttttgccggctgtccttctgctctaccagttgacgccgaaaaaaagcagatggattacgctgctggcagccggctacctttttttctggatatgtagtggaaaactggtgctttatctgttaggaacaacgttattcacgcattacattgcagtatggatttcatggataaaaacaaaatgtaatgatgaaacagcaggaatgcagagaaccgaggcaggcactataaaaaaagcttataaaaagaaagaaaaagcgatattagtatttggaatatgcgttcttctgggaatactggcatatttaaaatattataacttttttatccaaaatgtgaatgtgcttctggcacaaggaggaagcagtctggctttgggtacaaagcagatgctcattccggttggcatatcattttatacgctgcaggcaattggatatatggcagatgtatattgggaaaaggtggaggtgttcaggcatcctggaaagatcgctctttttctgggcttttttccacaaattatggaaggtccgatcagttcgtatgcgcagacagcagatacgttatttgagggaaatcccctgacgatggaaaatctggcgcagggaagtgtaagaattttctggggacttttcaaaaagctgctgatagcagaccgcctgtatcttcttgtggatgtaatctttaataattatcagtatcattacggagaaatgattgttatcgtggcaatcgcttacaccacccagctatacatggaattttccggctgcatggatatcattatcggcagtgggaaaatgtttggcgtcacgcttccggaaaatttcagacaaccgtttttttcaaaaagcgcggcggaattctggagaagatggcatattacgcttggtgtctggtttaaaacgtatgtgttttatccggtatctgtgtctggcattgtaaaaaagtggaataaatttggaaagaagcattgtggaaaatatttaacaaagctgggcatatcggcgctgtgtctattcccggtctggatatgcaatggtttatggcatggggcaagatggagttacattttttatggaatgtactattttgtaatactgcttgctgaagtggcagtagaaccattgagagataacatattggaaatatgtcatctggataagaatgccctgccgtatcgaatattacagactcttaaaacgtggcttattatttttacaggggaacttttcttcagggcaaacggacttcaggcaggaatgagcatgtttttcagcatttttaagggaaataatattcagagttttgagaatattgtagcacggcaggaggaaataagaggaattttaatgtcggtcggacttgaccggctggattattttgtggttattgccggttgtattgttgttgcagttgtcggaattataaaagagaaaaagctgctgggagaggaaggaatccagaaattgtggcttccggtcaggtggacgctttattacgccttgatttttgcggtattgattctgggcgcatatggaatgggctatcagcaggtggatatgatttatgcaggattttaaatatttcaaaaaaattatttcaaagaatatactttttatgatgatactggtgctgcttctggtgggtgtatcggaaagaatagtgaatttaatggttgcgaatgacagctatgtactggatcgaaataaaagcattttccggatattaagggagccagaaaacagcgtggatatcattgtattaggggacagtctgggtatgacgtccatttccccgatggcgtggtggggcgattacggaatgacagggtatgtgtgtggacagaccggtcagagaatgcaggaagcttttcatatgctgcaggcagcatatgaaacccagagccccaagcttgttattctggagacgaatatggtgttccggtgcaaaaatttgtcatcagaagtaaaagattgcctgggtgagattggctatcgctatattccaatatttcaaggacatgatatttggaaatccatgttatccgaaaaacaatatcctgctgagaattataagggatttgcatttcgctgcgagactgttccatacgaacagggggaatatatgcagaaaaatgaccagaaagaagaaatttcaaaaattgtcagtttctatctggaaaaaataagaaaactgtgtgaaaaaaatggaacgaaactgttgctggtaagcactccgtctccaataaactgtaattatgcgaggcataacagtatagaggcatacgcaagggaaaaggggctggattttctggatttaaacttgaagacggaagaaatagggattaactggaagacagacagtcttgacaacggagatcatctaaattactcgggagcagataaggttacacgataccttggcaattatctgacccaaaattatactttcccagatcacagaggcgaaaaaacataccgcacatgggataaggaatacaaaatatacgagcagaaagcggtccgggaaatgaaagttatcaagaaagcaggctaagcgtttacggtttattacaaatctgttatgttatacattaagaatgtgacaggagaggacaaagcatgaaaaaagagcaggtattaattgtcgaagatgatgcggatattcgtgatggggtgcggattttactcgagagtgaaggatatgctgttatggaagcggaagatggaagacaggggctttattgtctgaatgatgaagtggatcttgtaatacttgacgttatgatgcctggtatgtccggactccgaacttgtgaggaaatccgtaaaatatcgaatgtgccgattctttttttgacggcgaaagcacaggaatcagataagctgataggtcttatggcaggcggggatgattatctcgcaaaaccgttttcttatgcggagcttttagggcgtgtgaaagcattactgaggcgttataatgtatacagaggaaggagctgcgaatgggatgaaaatgaaaactcttatctgacactgaatggaattaaaattcatgaaaagttcaacgaggtctatatagatggagtgatgaaagatatgtcagatattgaatatcatattctgctgcttatgatgcagcatgccggaaaaatattttctgcacaaaatctttatgagagtgtgtggcaggaaccttatttctactcctgcaacagcacggtaatggtacatatccgaaaactccgggtaaaaatagaggatgaccctaaaaatcctaagtatataaaaacggtatggggaaaggggtacaaatttgacacagatagtaagtaagaatcattctatttatgtacagttgctgtatctcttaaccggcgcagcaattgctgcaatcgttttttttcagatattttattcaacgggaaactatgttcttgaccattatctggaaagctctacgtatatagaaaagcaaaacctgaaatatcttgctaaaatgcaaaaatatgtgacggcagagcatatttcatcgagtgatatagcacagcttaatacatgggttcaaaggcagaagatgatatatgtcagaatatataaggatcaaatccagatatatgattctgattatcctaaggaagatgtcagcgtaagcgaaattgcggcgggtaattatccgtgggaaagctattatgatctggaattgtctgatataacggtggaagtcatgatttccggaagtttcagctatcagctatataactggctattggtggcatcaatctgtctttctttcgctgtttttcttggcattgttctgcttggaatacgaaagaaaatgaagtatattttaaaactgagtgatgaaattgctattctggaaggtggtagccttgattattccatcacggtcaaggggaaagatgaattggccatgctagcagagggaattgaaaatatgcggattgcgttccagagtctgttgaatcaggaaatggaaatgatgaaggaaaatcagcggattgtgacagaaatgtcacacgatatcagaacaccggttactgcaatcatgctatattcggaaatacttcagaaagaacagtataaaacagaagagcagcggaaagagtatgtgaaaaagataaacaaaaaagcatatcggttaaaacagctggtggatcatctgtttgagtatgctcttgttgccggggacgaggagatagagttggaagaaccggaactatttgagaccgttttttttgatttgttttctgagacatgtaattatctggaacagaaagagtttactgtagatttcgatgtagaatgggtggagcagaagataagcatatcgacagattatatgatacgcattatggataacgtgacatcaaacatcatcaaatatgcagaccctggggaggctgtcaggattttttccaggaaagaaaaggatcgggtaggcattttgtttgaaaacagagtgcgcctgccggaagagaaagttgaaagtaatggaattggaatacagaatatcaaaaatatgatgaaaaaaatgaatggggaatgcattgtggaaaaggaaaatcaggagtatcgaatcatattagtgtttccatatgttaattagaatgagccgtcataaaaagcgccggcaccgatgggtgaagttcatcggtgccggcgcttttgggatgtgttacatcctgtgttttatgatgcggatgtcagaatctgcatcgtttatcctgtgtgtaattaacatccgaggttaaagtatttgcaaagagcagtaaataactcggaacagctattgaagttaaagcacatagtttcgtcctccttatttttatttgtgttagctaagcacaaaagaattgtaacaattatgtaacaactctgcaataggaggatattggaaataggattacgcttcaagctcgtcttcggacaggcagtcagcgagccggcaggcgagcgtggaaagaacatagagactggaacagtcggtcagggaaggctccgggtttttctgttatgatatgcgtaaagtgcggcggggagtctgaccaccaaagataaaataaaagcccggtaaaatccataacggattctaccgggcttttaaggtaagcagacaacgggaatcgaacccgcctcctcagcttgggaagctgatatactaccgatgtactatgtctgcaaaacacatattattattatagcgtaaataaaaaagattgcaaccactttctatgagagttgttcggcaaaattgtttctgtacaggattagttgtttaaatcgtgtatcggaagaagccttgccagaaacatggaaagacagaagctatgcttacaaaaacaaaaccagaatcattgacacataatttgtgcaaatagacgaaaaaataaatgaaaacgcatgaaaagtaaaaaagtgttgaaaacaggatagaattctaggggttttttgtttggagttatatataatgtagatataaggaggaaggaggaagcgtagatgcaaatgaaacttggaaagcttctggcagagaccaagacgggagaaaaaagacagattgagcctgaaaaagatggaagaggacaaaagtatgaatttgaactggcggggtatcatttttttgtaaaagacatggtaaaaaaaacagaagaaagtgatgaagagaatcaagaatattttatcacaagaagaattgtgggaaagagaaaggaagcttctggaaagaaggaaggaattgcactatcaatgtaccttgagtttggagaggaaacggatatttttcgagtgggaataccgtcagcggtatatggtgcatatgtaagtcgagaggaaagtacatatcactcctttatggaggatcgcctgacaggagtgatgctgcttttatttgatgaggatcataagaaatcaacggttgtgcagaagatgaaccctgcaaaatatatagaaaaggaagagcggaaacgtggagagggcaggtacctgcataaaacagagactacgtccatagggtatggcttcggggaagcaacttatgtaaaactctgctggccttatgaggaacgggaaaaaagtgtggcgcttgattcaatggagactcctgcacaggcgttctatccgttggaggaggaacagatagaacttgttttggaatacagggtggcacacaaagaatgcaaaacctttacggatggtctgtatcaggaatatcaggaactttcgcggcggcttgtgaagagaggagagaagacagtgcgcttgcctttttctagggaagagggaatacaactccgaagaaagtgtgtaggcagaacttaccgggaatttggtccggatggagcgggttttttcttcgatttcgaccctgaatatgggtatgagtcggaaccttccggattcgggacgtctttccacacgattccacataagacttacacgcatattctggaatacgggtttaccggacgtcagcttaatattgcgcttgatctggcaatgcatagtgaggactatttcaggaaagctgagagggtcatagatttctttgtgaattactgtataacggaaaatgggtgggtgtactcattgtacgatacagaaaagggagcgccctttgcgtccttcggagatgcttcagcgcctcggttgcactatatgtactacgaaaaatgtaagggcaattatttgagaactatgacagagccaatgctggatttgttggaggcatatctttggtatcggaaaaaaggagtaaaaaaggaaaagtggctggagagcgttatacgctttgccaattttctgttagagaagcagaatgcggatggctcctggtgtcgggcttattccatgaccggagagccagtgtatatgaatgatcgggaggactacactacggaagaaaatgacagagggagaaaagcttctacgattattccggtaatgtttttgtgtgcgctggcaaactgcctgggcgaggaaaaataccttcaatcggctaaaaaagcgggcaattatgcattggagcatgaggtgagatgggaactttaccaaggcggaaccatggataatcccaatgtcgtggataaggaggcctcccaatatatgatggcaggtctgtatcatctctaccagatgacaaagtctccagaatatctggaaggggcactgtgcgctgccaagcagtttgttacatggaattatatctggaacgcacctatgagaaaaggaaatattcttttttccagaggattttgtacgaagggaatgggagccattaattccatctggtgcggtggtgtggttgacatatactcgctcttccatatccgggagctatacttgcttgggaaagaagcagaggaatcatttcttatagaaatggcagaagatatcagcattgcaacccaacagattctgtcatggtctggagataccatgggcttttgcgatagtggcatgcagccggagggatttggaatctgccctcagggaatggatgagggaatgattgaaaagggagatatctggggaactctgggttggatctactcagctggaatctcaggaatggagcggtatttgaaggtgataacatagaggctgttctctgtccaggcgccggacagaatagtatgataaaagaaagcaaaaacaaaaggaggatttactatgaagagaagaattacaagcatgctgcttgcagcggcaatgaccattactatgctgacaggatgtggcagtcaggggaaagaaacagaaaaaacagatacgggtgcaattgtattggacatgtatcatagctggagcaccgacagcgaaagaggagcggctttggacaaactgatacaggaatttaataaggaatatgagggaaagattgaagtaaaagttacaattaatcccgatttcccagcatatcaggaaaaggtaaaaaccatgatttccactgacacaacgccggatatttttcattataattttaatcctaacgatttatcgagacagaagtcaggaaaactgatggacttttcggaatatatggatgacgagtggagagctagatttggagagggagatcttgaaaatctgaccatagacggagagattacatctattccttttgaaaaggcaggagcagttttctattataataaagaagtatttgaaaaagctggaattacggaatttccaaaaacctgggacgagcttttggaggcgtgcaaaaagattaaagacagcggtgtgacaccaatttccctttacacggcagatgatgcatggtatacctgtaatctgtttacatatcttgcggcaggctatgcaggtgtggatgcactgaacaagggcggcgatatcaatactgaacagatgaaggcggcagctgcaaagctgaaagagttctggaattatacgacaggagatgctataggagcaaactattctgtggcaatgaataattttgcatctggtaagactgcgatggtaattgacggaccttggctgattggctctcttggtaacgatatcaaggataagattggaattgctcaggcgcctacttttggagacggaaccgtatctgaaaattatgtgattacagatgcacaaacaccatgggcagctgcaaagacagatgataaggaaaaggcggaggctatcgtaacctttatgaaatacattacttctgaggaaagtgtaaagcaacttaccctggaaggggcggtgttcctttctccgaagcttgatatggaagatccagatgtacagggaacaggcgggcttctgggagaatacctcgctctgaacgcgaacgctgaggagagtaccgtaaatatccagagaaacttaagcacagcagccaattcgaagctgccgtccctgttggaagagcttgcccttgacaggctcacgccggatgcattcattgaacagcttgcggcagaaaataagtagataacccaaggaaagagaaggagcgtgtactatgaaaggacaacaaagactgttgtatttacttcccgcctgtatattggtgtttgcctttttcctattcccattggcttatctttcctatataagtttttttgagtgggatggtttaggaccaaagacattcgtgggatttgagaattttgaatatgtgttttcggatccgattttccggacagcagtgaaaaacacgattgtgtggcttttatcggcactgctccttcatatcccttttgggcttttgttggcacttttgctgaatcgaaaaccaagagggtggaaggtatttcgggtaatgtattttatacctaatgtgatctcaaccacagccattgcatttttgtggtattttatttaccatgtggacgtaggacttttgaacaatatgttgaatgcggtagggttaaagaaactgacccatgcatggcttaatgatccaacaacagctctgtggtgcaatctggttccatttgtcgtgtatgtggggttgacgatgattatctttatgacgcagctttcgacgataccgaaagaactttatgaggcagcggtcgtagatggagcaaccagcctgcaggtggatcttaaggtgtatctgccattactgaaaccagcgtttatcacgaatattatgttgaatctggcattctgtctacgtacctttgagtatccgtttttaatgacgggaggaggaccggcaaacagcaccatgaatctgtcgctttatatttataaagagatggtgggagcaaaccggtatggcatttccatggtagcaggtcttgtgacagtatttatgggattgattgtaatggtattcgtcaatattctgcagagagaaaggaggaactgccatgcataagaagaaaataacaccaacgggagcattgctttatgtatttctgacggttgtactggtatttatgatgattccgtttgtctggcttctgatttcctctttgagaccgaatgcagatttgttcaatgaaccatttgcagtgcccaaaacgttgtcctttgaaaatttccgggcggttatggagagccatcccatgcttttgtactttgcaaattcggttgccattgcagcgattgccacggtaatagctgttggggcggctacgcttgccgcctacgctatgcagcagagatttttaacaaggaagagtctgacggtattattttccatgtgcctttttattcctaccaatgcatttatggtgccatattatgttatgattaataaaataggactgtacgataatgtactcggaattgccttagtatatgcgggagtgaatctgcctatgagttttatggtaattaagggctatatggatacgattccgggtgaacttttggagtcagcaaagattgatggagctactgcaggacagtctttctggaagattattcttccggtatcgaagccgggaattgtgactgcatgtatctttctggtcatcaattcatggaacgaactcctttttgcaaacctgctgaatcaaagtgactcttccagaaccattcaggtggcgatccggtcgttccttacgacttttgaggctaattatgcatatgcttttgcagctatggtaatttctatactgcctacaattattatctatgcattgctgacagatcggattatcggaggtatgactgcaggcgcagtaaagggatgattgcaatgaaaatcatgatagtagaggatgaggaaaatataagagatggcattagaaatctcgtagactggaatcaggaggggtttgaagaacccctgctgttttccagtgctgtggaggcgcttgtgtttttagagacagagacagtggatgtggtgctgacggatctctatatgccggtgctgaatggaattgaatttatccgtatgctacgagagcagaaccaagtgtgcgaggtaattattctgacaggacacgaacgttttgaacttgccagagaggccattgcattaggagtaaagcagtatctgctaaagccggtgacggggcagacgcttttaacagaactgcacaaagtcagccgggaaattcaagagcggatgaggttaaaggactgggtcgatattgcgaagaaaaagcttcatgactatcttccggtcattcagaatcagttttggaatgatcttttgttaggaaatttaattgaactgaagaaaattaaggagagagcggaggaggcggagataagcattccggagtcggaaatgacctgccttgcggtgcaaaggaagggggaacagctggaaagagacaggatcaccagagaaatggcgcttcgggaacttacagaagaaatattaggggaaaaatatttgggtgctcttttttataacggaatggagatggtgatatgcaagggacggatttctagagactatgtggagattctgaatgagtctgtcaagcataatttcggctattctatttcaattggagtaagcacggcacaaaaagatgcgacaaatctgagaaatctggcaagagaggcgatggatgcggtgcagtccattcatgaagaggatgtaatatcttatatctattaccgggatattgaaaataaaaagaaggaaagggtggaatacccgtacgaggaggaacgaaggattttacatgagattcgatttcagaggcttccagacaggaacttgcttcggaaatttttagaaaagcttcttcctccccggtattcggtggaaaagtctaaaatgctgcttttacagttccttttagcacttgtacggatggcagatgaactagagatagatgttgcgacggagtttggaaaagcggaagcaagcattgagagtctgcagaaggtggaagaagcattggagagaatgatcacaagaatggtcagtgagaaagagaaaatgtccagaagatatacagagattcttgtacagtcggcaagaaactatattcaggagcattttgctgacgaggagctttcggccggaaaaatagcagaagcagtgggagtgacacctaattatctgtccagaatttttaagagtattacaggagatacctgtgtcagtttcctgggcaaggtaagattggatgaggcaaagaaacttttgcgtgactcttcatttaaaagctatgaggtggcggaggcggtggggtacaagaatcctaattattttggtgctatgtttaaaagatataccgggtatacaccgaaggagtaccgggaggcttcgtatgaagataagaattaagtctgtcaaaagcaagataatcgttttctttatcggtctggcagcgttccagatctgtgtgatggcagggtttgccaaattgcagttggagccatccattgtgagtatgtattcagaacatttagaacgatttgcagatgtggcgttaacagaaacgacacaggagacggagaagatagaacgttatatggtaaatatcatcggtgatgcccagattcaggatttcctccgcagagcggacgaggagcagagtgcagaactgccgccggtgttgtctacagaacttcgcaaccggattcttagctatacagattacgataatattattacggcaatatatctcgtggataattatggaaggatttacagtaatcttgggaaaagccctatgcagacctttatgaaccgcaatcaggagttgaaagacaggaaggaggagtctgctgtctggtatggaggggaaaatggaaataccataacggtgtaccggaacgtcaataataacaccacagatctcacacaaaagatcggagcgttgtgtatttttatagaccgcaagatgtttcaggaacgcattgacgatctgatgatggaagaagaacagcattatgttctggaaaatgaggagcggcacctaaagatttcttcagatcaggatgagacagaagaaagggacagtattgtggtgatgagaacggatggcaggtgggggctgagaacctggattgaaaaggatatcatttaccgaccggtgaagatgatgatgcggatcctgctagcagaactttttgcactgcttctggtgagtattgctctggtggtatttctgtcagaacggattacaagaccaatacgtaagcttactattgccatgaaggaaattggagcgggaaatattgatacggtggtattagatgagggggaggatgaactagggcttcttgcagcaaccctgaaccgaatgtcaaaaagcatcaaaaagctcatggagcagattcatgaggatgagaaacagaaacgatatctggagctaaaggctatgcagtatcagattaatcctcattttctctataacacactggactctattgccatgtctgccagaagaaatcaggataggcagagtgaggaaatgacccatgctctggctgaatttttcagaatcggactaagccacggagcggaatatgtaacagtggaaatggaggttcggtatgtaaaagcctaccttgaaattcaaaatatgcgatttcccgatttattgacatgggagtgcagtatagaacatggacttgaggagataaaaattttaaaatttattttgcagccgctggcggagaatagtatttatcatggctttcgtgactcgggagagtgcggtcacatagagattcgtgtatataccagcggaaaaaatctgcaactttgtgtatccgataatggaattggaatgatgccggaacaactggaaattctaaaaagcaggatggcttggaaacagatgacagaacagagtattcaggaggggggatttgggctgcagaatgtacagcagagattgcagcttgtgtatggtacgaaagccggacttcacatagaaagtgagtgggaggaaggcaccaggatcacggtagtgattccggatataataaaaacacattcagaaaaggaagggagtgtttgatatggaaaaagcaagaccggtttcgttgaaagagatacgtattagggataacttttgggataaatatcggagacttgtaagggaggagattctgaaatatcagtggtgcgctatgaatgatcagattgagggcgcgcctaaaagtcattgtattgaaaatttccgcattgcagcaggagaaaaacagggagagttttacggggctgtgtttcaggactcagatgtggctaaatggctggaagcggtagcatatacattggcagagaaaccggataaggaactgaagaaactggcagacagtgtaattgaactgatcggtagggcacaggagccggatgggtattttaatacatattttattctgaaagagccgggacagcggtttagaaacttaagagaagggcatgaactatatactttggggcatatgattgaagcggcagtggcatataagcgggcgactggtgaaaaacggtttctggagattgtacagaagatggcggatctggtggcaaatactttcggagtggaagagggaaaacgcatgggaatgcctgggcatcaggaaattgagctggctcttatgaaactttatgaggaaacgggtaaagagagctataaggaactggcaaaatattttattgatgtacgtggctgtggaaatagaaattattttctggaggagatgaaacaaaaggacgtaaaacgtatttttccggagcttaacgactatcgtccggaatattcacagtctcaccttccggtgcgcaaacagcgcacggcggaaggacatgcagtgcgggcagtttatatgtatgcggcaatggcagatattgcagcggaatatgatgatgaagagctgcttggcgcgtgtgagacgttatggaataatatggtgcatagacggatgtatgtgacaggaggaatcggatcatccgggattttggaacgctttactgcggattatgatcttcctaacgattataattactgtgagtcctgtgcatctatcggactggcgttttttgcgcggcgcatgatgcagattacaaaaaaagcaaagtatgtagaggtgatggaacgggctttgtacaatacggttcttgcaggtattgcaatggatggaaagagttttttctatgtcaatccgttggaagtatggccaccgagctgtatggagcgaacctccaaagagcatgtgaaaagtgtaaggcaaaagtggttcggagtagcatgctgcccggccaatatttcaagaacgcttgcgtcattgggagaatatatttatgcctgtgagaaagatactatctatgtgaatttgtttataggaaatgagacgcagattacagtgggagaacagaaggttcacctgtcattggagactgacttcccgtggaaaaatcaattcaaaatcaacgtttccggcgtgaaggaaagcgtacagcttgcagttcgtatcccagaatatgcgcaggattataaaattttctgcgagggaagggagcagttttacaaggaaaaagatggatatgcctacataacctgtgaaaagaacggaaggtatgaagttcagtttgtttcagagccacgctttgtgagggcaaatccaaaagtaagagcagatgaaggaaaggtctgtgtgatgtggggaccactggtatatacagtagaggagacggacaatggagaaaatcttcaggctctttacatagatactgccaagccggtaaaaaaaagtgaaaaagaggaatttccaatgttgattgcagcaggaaagcgtatatgtgaaagcggttggggcgaggaagaactttatggaagtcatcctttggaatttgcagaaacagagattacgttggtaccttatgcttattggggtaaccgggaaaacggagagatggcagtgtggttgaaggagtatctgtctgatagaaataataagtaaaaaaggatatgttccacttgatatactaccctcataataggacaatgaaatataaaagtcctatatgagggcagtttcatgtccagaaaaagtaagataagtccaatataaaaggtcaaaatagttgagcaatagttatatgttttgtgagagatcagtgttgaagtggagacgaatatgatataatgaatcctatcggattcatattagaagttcctacggaacttcggatgcgcagaaagcagcgcaaaaagatgatagggcgaatgcccgtcagtccgggaaatctttgatttcccggacgagcactgcgctacaggaaaagggaaagttattgtgccgcgcccggacatttgccggagcgtagctgatttgcatgccgggcactgcgctactaccagaggagaaaacaatgaaaacagttgcaatcgtggcgtgttccaacgggcagaaagaagaatatcgaagccagaacgaggaactggcacggtatctggagaaaacaggacacaaggttttatggagcaatgatatctatgaaaaaaatgccgcattttcaggtacgggagcagagcgcgccgcggaactgatgcgtttcttcaatgatccggaggtggaggagatctatgacatttccggaggagatctcgccaatcaggtgctggacgggctggattatgccgccatcggaaaaagcagggcagttttctggggctacagcgatctgacgacggtcatcaacgccatctatgcacagaccgggaaaagcagcgtgctctatcaggtcaagaacatggtctggggagagataaaagaggtgcagcgacggagatttgagaaccgtacggcgctgtttgacccgcaggttcgctttgtgcagggggagaagatggaaggcgttgtcgtcggcgggaatatccgctgctttttgaagctggcgggaacccgttatttcccggatctttgggacaagattctgctgttggaagcatacggcggtgaggtgccgcagatggcgacgtatctggcgcagctaaagcagctgggggcttttgagaaggttggaggaattttactcggaacatttacggcgatggaggcgcatgcatgcagcccggatatcactgcactggtgaaggaggcggcaggaacgaagattacgattgcaaagacacaggaaatcggtcacggaaatgacgcgaaagcaatccggatcggagaaaagatatactgctgcggagacgaagcatgtcgaagcgttgttacagatgctgaaaggagacagttggaaaccagatgaaaaaagagatgacatacacagaactagcgaaagagacggcaatcctgacggctgccgtggcgattatcgccgcagccgtatacttttttctggtgccgagccacgcatccgtcagcagtatctccggtctcggaatcgtgctgtccaactttataccgctgccgctgtccgcgatcacgatgatcttaaatgttgtgctcttaatcattggattttttacctgcggaaaggaatttggcgtgaagacggtttacaccagtgtggcgctgccggtatttctgggaatttttgagagaatcttcccggattacgaatcgctcaccggcagccaggaactggatgtgctgtgctatattctggtggtcagtgtgggactcagcattctgtttaaccggaatgcgtcttccggcggactggacattgtggcaaagatcatgaacaaatatctgcatatggaactgggaaaagccatgtcgctgtccggcatgtgtgtggcgctttcggcggcactcgtctatgacaagaagacggttgtgctcagtatccttggaacctattttaacggcattgtgctggatcattttatttttgaccatgacatgaagcgccgtgtctgcatcatcaccgaaaaggaagaagaactgcgcaggtttattatagaagacctgcacagcggagcaacgatctatgagtcgattggtgcgtataatatgcagaagcggaacgaaatcattgctatcgtagacaaggtggagtatcagaaactcatgaattatatcagccgtgaggacccgcatgcatttattacggtatatacggtgtcggatatccgctatcagccgaagcggtagcagacaaaatgcgataggaatgaggcaaaaaaggagaaatatacatgggaagctatgacaacacagacatttcatacaaagctgcaggcgcagagacttatcatctgccgattctctatacagaggacgagcgcagcagttacgccgcgtggggcataaaaaaagaaaaactgttgctgccgttcgccgttgccacgatcctgattgacgcgtttgtgctctgtgccacggtcgtttatctgtttgtgaaacagcggcagacgccggcattttccgtctggatttcgtgctggggcggtctggtcggtgatgtctcctacggtgtggcgcttgttttgacggttcttattttaaagccgctcgactggctgttggataaaatcatgcacagaccggaggaaccaaagatgctgcaggtgacaccgaaggaaacgggcgtctcgtatttcctgcttcgcggtacaacggtacttgcgcagggaatgctcacgtgggatgcgtgggaggctgcgcttgctgtggagacgaatgagatattgctcgaggggcagagactgcggatcggaagcaatacgatcgcatcgatctatccgcctgagaaacagaagccgtggatggatcatccggcggagcagataacgggaaccatcagcctggcgcatatccggaaaaatatgcaggggtaccgggcgtccctggaagaacagaaaagggaagcagagtggagacggcagaacccatagatctgccggtggaaaataaaagaaaatggagacagacacagatgagatatccgaaaaatttatccgaacatggaacgattggttttgtggcgccatccttcgggtgtgcgactgagccgtatcacaccgcatttttgaacgcacagaaaaaattccgggaaatgggacatcccctggatctcggaccgaattgttatgccgactgcggaatcgggatcagcaacacgccggaggcgtgcggcagagaactgacagagtattattgcagcgataagaatgaggtgctgatctcctgcggtggcggggaactgatgtgtgagacactggacgcggtggattttgaacagatccgggcagcggtaccgaagtggtacatgggatattccgacaatacgaacatgacatatcttctggcgacgctctgcgataccgcatcggtctacggcccgtgtgcggcggcgttcggcatggagccgtggcatcagagtctttcggatgcatatgcacttctgcgcggacagaagcatacggtaaacggatatgatctctgggaaaaggaaagcttaaaagatgccgagcatccgcttgtgccataccatgtcacggaacagcggattttgcatgttttcccggaaccgacggaggcacttacggtgcagggacgcctgatcggcggatgtgtggactgtctggtgaatcttctggggacaacttatgataaaacaaccgggtttgtggaaaagtataagaatgacggtatgatctggttcctggaatcctgtgatcttaatgtgatggcgatccggcgggcggtctggcagatgaagcatgccggctggttttcccatgtgaaagcttttctgatcggaagacctgccgtctacgggcaggaactgatggggctggaccagtaccatgcggtgtgggatctgttgaaagattacggggtgccggtcattatggatgtggatatcggacacctcgcaccgatgatgccgctggtgtgcggaagctatgcaacggtgcaggtgaacggaaatgacatctccgtgaagatggagtatttatagaataatgttaatatttttgccgatgccggtgtttaagagggtatccagatccagactctgggatacgatctgtgccgcagtggtggcagtgccgtcatccggactctctgtggcaccggatgtggtggtgccgtctgttgcggaagaacctgtggcagcggcattttttttctgcatcagcaggttgttatcagaggtaacgagcgcctcgccgcggcttgcaaaccgtttggcatatgttgaggtgcgctgcatgtaagccgcatcagcggaaaaaagttccttgaacttggagagatccgcactctcaaataaggttgtacggcttgtgagtgtgccgtcatcattgacggtgatgccgatcttatcgagttcggaagagtattcgctggtaatatttttcaactgctttgcactgcgctccaaggtacggtccgaggaactgccggcagaggaaagcatgttgttgtaggtctgaatataggcgagcacgctgttgcgcgtgttggcgtcctggtcatccgaaaaatcagaggaagtcagccggcgtactgcctgacgaagcgccctgccgtctgcgagagcgagctggttgccactgaattcacggcgtttggaggaagtcccggcttcccggttggaacggtagaaactgcgcaggtaatatttggaacttaaggtggtgccggatccgatatacgctgtatttgacatagtgattcctccttaaaaagattctctaatatgtttcggcagaatgcggcatagaattaaccatagaaaacaaaaaacggatatgctatactaaattccaaagaattcagcctgggaacagaaactactgaattctggcgactgggatgtatgagaggaggatatcatatggaagcaatgatctggataggtctgattattctttttgtggtggttgagattgcgacggtaggactgacgtccatctggttcgcagggggcgcgctgatttccctgattctgtgcctgtgcggcgtgggactgggctggcagatcggcgtatttttcgtggtctccctgattctggtggcatttacccggccgtgggcggtgaagtatttaaagccgcatctgatccggaccaactacgagcaggcaatcggtgaaaacgtatgtctgacggagacggtagacaaccagagaggaaccggtactgcagtctacaagggacaggagtggacggcgagagccagtgaggatggaaaaagatatgaggcgggaacgatcgtgaaggtaaaggagatccgcggtgtgaccatgtatgtcactgaaagcggactgatgccgcaggttccgacgacaccgcagacagagcaagaggcagaataatatgaagcttggaatggtatttgagggaggcgccaaccgtacggtgttctcctgcggagtgatggatgcgtttcttaaggaggggctgatgccggattatctgatcggcgtctccgccgggatcgcatacggtgtatcctacctgtcgggacagaagggcaggaatattgaggttgtggaaaattatatcgcggacaagcggtatatgggcatgcggcatctttttaaccggaacgagaaagcgtatttcaatacgaagttcgtgtttgaggaagtgccgaatgaactgattccgtttgactatgacgcgtttgcggcgtatccgggaaaagtcgaagcagcagtgaccaacattcataccggaaaagccgaatatgtcgaagtgccgaggggacgggacatgcgcgatacgctggtggcgagctgttcgctgccgatccttttccagccagtgaagcttggcagacattattatctggacggcgggattgccgattccatcccgtatgagcacgcgctggcggagggatgcgacagactcatcgtggtgctcacaagagagcgcggatatgtgaagaagacggagaaggcagtccgctttacggacaagctgtacaaaaaatatccgaagattgtggagagcatggattcccgggcggagcgctacaatgaatgtatggccagactgcaggaacttgagcaggagggaaaaatcttcgtcatcgctccagaatccacctatggggtgggacggacgaccacggacgtcatcaagctccgaaggctttacgacgagggttatgaactgacagaaaagcgcatgcaggaactgcgtgcatatctgggataagaaagagaggaaacaaacgatgaagatcgtatttttggatgcaaagacgatcggtgatgacatcgatctgtccggttatgacgcgctgggcgaggttgtaaaatacggattttccacacccgaggaggcgagagaacgcaccaaagacgcggatgtgatcgttctcaacaaggttgtgatcaacgagcagtccatcggtgaggcggagcacttaaagctggtatgtgtgacggcgacgggaaccaacaatcttgacaaggaatatctggatcagcgcgggattgcatggcgcaacgtggcgggatactccacggagacagtggcacagcatacgtttgcattattgttctatctgctggaaaagttacattattatgatgaatatgtaaaatcagaaaaatatgtgggggatgtttcctttacacattttgacaatgtgtttcatgagctgagcgggaagacatggggcgtcatcggccttggcgcgatcggcagaagagtggcggacattgcgggcatgttcgggtgccgggtgctctactattccacctccggaaaacacgatcagccgggatacgagagagtagattttgatacgttgctcgcggagtcggacatcgtgtcggtgcatgcgccgctggatgccaatacggaagggcttatgaacgccggagcgtttgcaaaaatgaaaaaatctgcgattttcctgaatcttggaagaggaccgattgtggtggagaaagatctcgcggaggcgttaaagagcggtacgatcgcggcagcaggactggatgtgctctcggcggagccgatgcgggcagacaatccgctgcgtgagatcaaggacagtgataagctgatgattacgccgcatatcgcatgggcgagcatcgaggcgcgcacgcgtctgatgaagatcattgaggggcagatccgggaatttttccatctgtaaaagaatgcgcccatttgggggcgcatcagcttggaatccgcgcatccagaccgctgtggaaggacagattgccgtattcttttagaaattccagagtgagctgtttctgcagctcactttttggttctgtatgcagtaatgtgtgaagctttcgtatcatggtaaggcagcgcgcactgcttttttcgtacagatcaaaaaagctttccgtggagacgcgtgtggcatcccagggattcttccaggaggcatgcctcaagttaaaaggatccgtgcggaaaaacagtgtgtcgctcggtatcaacggggaaaataacgggtatcccagaaaatgcttctccatgaaccggaaaagaacctttttttgtccggtttcatcgtgaagaatccgcatgccgagcggaagcgagatgattcccatccacatggtgctgcgatgaatggaaagttcggggaatgcgtaatgataggcatcgtacaggagcccggcaatcacgcgtttctgggcaaaagtcagctggatcgtatcggcggcgtggaattcacagggtgtcttgtggcgctttctggcaagcagttcggtgtcgatctctgtctcgagataggcatgtctggaaaaatagcttttctccttcttgtcatggtaatgcgtcatggcatagatatagggatggcatgtggtgtcgagcagatagtgccccaggaaaccggagatgtaggcttcggcaatgccccggtctgcagcggacgagagacgcccgtaactttccagcagtccgcggaaaaaggcacgcggctccgtggtgtgtgcgagggcaccgagattgtggcggtgcagggcataggacggaagataatagaaaaacagatccggtccctgcagtccgaacgcataagcactgcggttataaaacagattttttttctgggaattacattttaactggtgatagatttcttcgccaaacagataatgtgtaacaaaacctggcatgggaattcctcctttcgttcatcatgagtataaccattttataggaaggtgttaagtgaggaatggaagatttaagaaaaatgtaataaaacaaatagattgacaatcaaaaaaagagtgttatactatcacgtagtaatggaaactatataatatagttcggtgataatcaaagcagtcagattgtcataagatgatagacaaaacaaggaaaatgtatatcgggtggcaacacttaaaatgcattgcatatgtaaaaaaagagcagtattccttatactttcatcttagaaaagaattagtgtgtatggaagaaaacggaggattaagtgatggcaaatttagcacagtcagtagagagaaaggcattcagcgtggcgattgatgcagcattgaagcatctgaataaggatcgtgaaaaaggcctgcttcagattgttgatcttgcagaaaagttcatgggcgataacttccgtaaggaagcgtatgacggagccagaaagatgattcaggatccggacaataaatggatgcattatgtaaatcgtcttctggatgagaccgatccccatgtagcaaagatgacagcattaaatctgggatatcaggcagcatttgtgggaacgaagacgattcgtaagatgagggaagtacataactgtaacatcccgtggctgatcttaatggatccgaccagtgcatgtaacctgcgttgcaccggctgctgggctgctgagtacggacacaagctcaatcttacgtttgatgagcttgacaatatcgtgacacagggtaaggagcttggtatttacttttatatgatgaccggtggtgagccgttagtcagaaaagacgatatcattaagctctgtgagaagcacaacgagtgtgcatttcactgctacacaaacggaactctcgtagaccaggcattctgtgacgagatgaagcgtgtcggcaacctgtccttatccatcagccttgagggatttgaggaggccaatgatttccgccgcggcgaaggtgtatttgacaaggttcttcatgcaatggatctgcttcatgagaacgggctgatcttcggtaacagcgtatgctacaccagcaagaacatggatgccgtcacatcggatgagttctttgatcttctgatcgagcacggaagccgtttcgcatggtacttccatctgatgccggtaggtatgaaggcttcaccggaactgatgccgaccagagaacagagagaatatatttaccacagaatccgtgaggtacgtggatttacaggcggtaaagagatcttcgttatggacttccagaacgatggagagtatgttggcggatgtatcgccggaggaagaaactactgccacatcaacccgaagggtgatgttgagccgtgtgtatttattcactattcaggagcaaatatccgtgagaagtctctgttagagtgtttacagcagccgctgttcatggcatacagagacggccagccgttcaatgagaacatgcttcgtccatgtccaatgttagagaatccggagctgctccagaagatggtacacgagagcggtgcacactcaacggatgttgaggaggcggagccggtagagcatctttgcggaaaatgtatggagtatgcatgccagtggaaagagacagcagataagctgtgggcagagcatccgtaccagcagaagggctacaccaactttaagaaaaaataaggggcgatcgttatcagcaaggcgaaaaaacagatcttaaaatgggcattggtacttgtcatcatcggaatcattgtttatacattccgggattcagcaggaccgatcttagaacaattagaaaaaacgacaccggcggtcattgcaggcatctgtgcaatgactgtcgtgtatcactgtgtcgagggcgtgattaccacgctgcttgcaaaacaatataatcgtgaattcacattaggcatgggtattaccaatgcctttttgtgctccttttaccgcgtggcgacacttggcagcggagcaggggttgccgcgattgtctatctgggtgagcacggcatagagtattccaagagcttcggaatgtatatgctgcaatacgcgtttcataagatcagtatcgcgtttttctcaatgattctgttcacactgaactggaattatatgcgggtacattttggggagtatatgtggctgctgctggcaggatatcttataacgctgatcatcaccgtggttttaattctgttcagctgttccagacagtttcaccgcatgctgctttgggtggtggatttcttcaatggaaagatgaaaggacggtttgatccgcaggcggcaatgcttcatgaacagtgtcagatgttggaggacgcatccagacagctgatgggaaaaaaacggctggtcgcgggcgcagtgggattgaacctcatcaagttcgcattctggtattccatcccgtatctgatctttctgggacagggagagattacgcttccgcagaccatggcggtcacatcgctttccgtcatgctggcggcagtcattccgtcgccggcgggaatcggctcgaccgagtttgtctttatcgcacttttttccggtattgtcggaacggggctggcaggctccgcgtcgcttctgtaccgcttcggcacctttgtattcccgtttctggtgggggcggttgtggtcatcatacgccgcatctacctcaaaaaaacgggacaagccaaacgatagcgccagctgtgatatgaggctggtacacagggcggagaatagactggcagtgatacgataacagtaagtacagcagagttccagaatagaaacagtgcgtaggaattcggaccgcaaaatacggaatttctaactctgccgctttttacatctgtgatgatccgtgtttttccaagttttgagcactccgcaggtgtgtccgcaggccgacagacaatttaaggacttttgtgtgttccttacatcaccaatgaacaaaacataaccgcgcgaagccgatgtctgaattggcatctgccttattttcaatagcagatgccaacgagtttcggttcgcgcggttttatattgtctgtgaagcggtgatgttaggaacactaaaaagtccgctcattgtctgcggcgtgtcggacacatcccgcggattgtcaaaacgtggaaagacacggaattggatataaaaagcggcagagaagaaattctcgcattttgttccaacgaatatcctacgccctgtttctagctggaactttattgcatcctacattttattgcagccggtaatccattctccgccctgtgtgcgagcctcatttcgcgcttttttcaaaagtttaaggtttgggaaattgacaaacgcacaagtcatgataaaattaacgttggcatgcaaaaaatgtgtaaagaaagtgtaaataagggaacatatgaaaataaaattatattttgacaagggtaatttgggcagacttgcggtggcgatgatctttgccgcggtattgttctggaaaatcggcttttcggtgtgggcgctgccggtattcggagcgtgctacttcctatttaagagcctggaggtggaactgtcagagaagatcccgtgggtctggaccggactgatgatcggcgccagcagtattttcacggcgtatcatgtgcagtatctgctgctggatgcagagcttcgcgccaagatcacacagccgaagatgctgctcaatatcttgtgctgtctggtggtatttctggcggtacaggtttttaccaataatacgggacttacctgcatgatttcccacatttttctggtgtcattggcgggaatcaactatttcgtatatctgttccgcgggaacgaatttattttcagcgacctgaaatccatccagaccggactttcggtggcgggcaattatgagttcgtgatggatgaccgggcgggctatgtgattctgatttccacgctctatgtggcgctgatccgcaagcttcacgtttcctttaaaaagagagtgccgatggcgatcatctgtatctctcttgccgtgctgagcggcgtgtatatcggtcataagacggagtacatagtgacagagacctgggagcagaaaggaagctaccgcaacggatatattctgaattttgtgctgagcataagagactgttttatcgctgcacctgacgggtattccggtgaggcggtgaaagcgctggaagagcagtattccggcggggatagcgacgggaagaagcagggagagaaagatgctgcctcggcatatgcggatgtggcagctgatccgggagaaaagccggccattatcgtggtcatgagcgagtcgtatgcggatctttcagtggtgggagatttttccacgaatatcgatgtggcgccttattttcactccctgaaggagaacacgattcatggatatgcgctgtcctccgtgttcggtgcgaagacgccgaattcggagtgggagtttatgaccgggaattccatggcatttctgccgagcggttctgtggtatatcagcagtatatttccaagacgccgacctcgattgtgtccaacttaaagaacgacggctatacctgtgtggcaatgcatccgtactatgagactggatggagccgcaacgcggtgtatccggatctcgggtttgatgagacacattttatcgacgattttgaccagacgaagattctgcgggaatatatcaccgaccgggaactgtatgaaaaaatcattaaccgctatgagagccgtgcggcgaatgaggatctgtttatcatgagtatttccatgcagaaccatggcggttatacggaaaagtacgataattttgatgagaaggtacgcctgctgggattaaactatccggacgtcaatcagtatctctctctggtgcacgagagcgattcggcgttggagtatctgatctcctattttcaaaatgtggatgatccggtggagatcgtatttttcggcgatcaccagccaagcctttcgtccagtttttatccgaacttaaacggcaagggactttcgggactgaccgaggatgaactggaagatctgtatacgataccgtttttcatatggacgaactatgagagcacggaggtggaactgccgatcaccagcatcaattatctctcgacgctggcgctggagcgggcaggaatagaacttccggcgtacaatcagttcctggcggatatgatggagaccattccggcaatcaattccagaggctattattccaagtccgccggcggatttttgcacatcgaggaagcgacgggtgaggaagcggactggatccggaactataatattttgcagtacaacaacatgtttgacaaaaaggaaaagagtgaagtattctttccttatctgaagtagtattaagaaagcaatagagatacagctttttagcgggcaatgtgtataagaaaaatgtggaggcgaaaaaatggagagagtgacacttggaaaaacagggattaccgtcaataagaacgggtttggcgcacttccgatccagcggatcagcacggaggacgccgtgaagctggcgcgaaaggcatatgatgccggcatcactttttttgataccgcgcggttctacacggacagcgaggagaagcttggagaagcgtttgagggcatgcgggaaaaagtctatattgcgacgaaaacggcggctgccaacgcggacgaattctgggagcagcttggcatttccctgcacaatctgcgcacggattacattgacatctatcagttccacaatccatccttctgcccgaagccgggcgacggaaccggactttacgaggcgatgctggaagcgaaggcacagggaaaaatccgccacatcggtatcacgaaccaccggcttgccgtggcagatgaggcgatcgagtcaggactttatgagacgcttcagttcccgttctgctatctggcgacagagaaggacatcgagctggtggagaagtgtaagcaggcgggaatgggatttattgcaatgaaagcgctctcgggaggattgatcaacaattcggctgcagcgtacgtgtttgaggcacagtatgagaatgtgctgccaatctggggcgtgcagagagagcgggaactggacgagttcatttcctacattgaacatccgccggtcatgacggaggagatcgcagcggtgattgagcatgacagaaaagaactctcgggcgaattctgccgtggctgcggttactgcatgccatgtcctgccggaattgagatcaacaattgtgcgagaatgtccctgatgctgcgccgcgcgccgtcggaggcacagctgacgccggagatgcaggcgaagatgaaaaaaattgagggctgcctgcactgtaacaaatgcaagagcaaatgtccgtacggactggacacaccggcactgcttgcgaagaattatgaagattacaagcgggtactggcgggagaagtcagcgtaaaataagagatgtgcagatatgcagaacgacatgcaatgcgcgtaatgcacacgtgaggcgaagaggagtgggagaatgaagaaatatgagaccgtcatttttgatctggatggaacacttttgtatacactggaggatctgacaaaagcgacaaactatgcgctgcgcaggatgaatatgccggagcgcacactggatgatgtgcgccggtttgtcggaaacggtgtggcgcgcctgatcgagctggcggttccggagggaacggcaccggaagtctttgagcagacgcttgcgattttccgggagtattatgatattcactgcaatgacaatacaaaagcctatgacggagtgattgatctgctccgggaactgaaggcggacggatatgcgcttgcgatcgtgtcgaacaagccggattctgcagtgaaggaactggcggagatttattttgagggaattgtgaaagtggcaatcggcgagagtgccggagtggcgaaaaaaccggcgccggatacggtctatgcggcattaaaggagcttggcatgccaaaggagggcgccgtgtatgtcggagattccgaggtggatgtgatgacagcgaaaaattccggtctgccgtgcatttccgtcctgtggggattccgggaggaagcgttcttaaaagaacatggtgcagatcattttgtccgcgaaccggaggagatcagagatttcctgaatgcgtaggtctgttgagaaatgtttcacttttagtaaggaagtaccattgcatgatttttgtacataaagtacaataaaaataatgagaaacacagaagagttgtgcggaatcacaacaaggaaggcggcatggtatgaacagaagaagtgtgaaacatacgttaacgatgacctgtctgatgctggtattactggcatccctgttgcttggggcaacttccattttcagtatccggaatacgaccaatatggcgctgacggaatatgaaagtgcgatggattccggttacaacacagagatcaagtctgaggtccagacggtgattgctgtgctgcaggcagaatatgataagagccaggcaggggaactgacagaggaagaagcgaaagcagaagcgaaggagatcgtccgcgccatgcgttaccgcgatgacggaagcggatatttctggattgatgatacggattacaatctggtaatgcatccgattctggcggagcaggaaggaaataaccgctacgatctggaggatcagaatggtgtcatgatcatccaggagattatgaaggtctgtaacagtgccgacggaggcggattcaatgaattttactttacgaaggcggacggtgtgacggttgcgccgaaggtagcatattccgagttgtttgcaccgtggggatgggcagtctccaccggtaactacgttgatgacatgcaggtagagatgacgggtgtggaaggacgcatcaaccagaagttcgaggttctctgcattgtgatagtgataatgatggctgttatgcttgtgatggcgttcgtgtgggcgagaatctatgcggcgaagctctgcaagccgctggtggagatccaggggcttgcatccagactttccgacggagatctgacaacgaccgtgaacgtaagggagaagaacgagctgggagacacggcagaggcactcaatgccgcgcagaagcagattgtttccctgataggaagcatcagcacggcatcaacagatctgcggaatgcactgcagtcgtttactggtaatttctcctcgatgcaggagtccatcggaaacgttgcggttgccgtcaatgagattgcggaaaacagcacgacgcaggcaggatccacgacggaagcgtccaacggtatcatgacgatcgcggaaggcatcgagaagatctccagcgagatggaagaactggtcggcaatgccaatcagatgcaggagtattccaataagtcgctcgctaagcttcgtgaattgatcgatacgaacaataagacagaggcggatatcgagtcgatgtatacacagacggagagtaccaatgcatccgtcaataagatcagcaaggcggcgacgctgatcagtgagatcgcagatcagacgaatctgctttcactgaatgcttcgatcgaggcggcgcgcgcgggagaagccggacgcggatttgcggtagttgcggaagagatcggaagccttgcgacacagtcggcggatacagcgcatgagattaacgatattatcggagagctgacagagaattccgagaagtcgatgggcattatggtacagatgaatgatgcgtcgaagcagcaggtagaggcactgaatcataccagcgagatgtttctggatatgcagaaagcactggaggcgtgcacgaattctatacgtgtggtgacggatatgatccgcactgcgaatgaggagcgtgagaaagttacacagagcatcgaggtgctgacgcatcttgcgacagataatgcggcatccacggaggagacttccagtatgacaaccgaactggagggaacggtggagcgctccagcggaatgatcgagaagctggagggcgacatgaaagtgcttgcagacagcatggagcatttccggttgtaggaagactgcggcaagaatacaaatgataagatgagaatgaaagcgggcgtgtcagaaactgacacgcccgtaatttcatgtctgcagatattctgcgaatgtgaatatatagctgggtacgaatagggaaaaaaccttttatatttcacatgctgcatcatatgctgatttaatggcatgatcgatattgctcggacgctctccagcacaatcgccaatataatgaagcgggagcggacaagccgaaagatccggaagattctttcttgcaccaacagccattacaacgaaatccgatctgatctctaagaccgaggttttttcattttctgttttctcaacaataactgcatggtcattgatctctgatagttttgcagaggtaaggatctggacattggaatgctctaattcactcatcaaagttgggagaatcgtgctgctttcttcctttgcaatctgatccatcatttcaataattgtaacgttacatccgcgggcagcaaggtattccgcagtttcaacacctacaagaccaccgccgatgacagatacgttgccgaatacaatttcttttttagcaagaatatcccatgcacttgtaacggttggaagatctttgcccggaacgggaatgattgcattcgttgcacctgttgcaacaattacttcatcaaacgaatcatagtcttttccggtaaattcctgccccagacggaatgtcactgataattcgggaagcacgttaagatagtagttaatgcttctcatcatttcttcttttcggggtggaacgctggcaataagaagctgaccaccgatctggagtgacttttcaaatatagttacctgatggcctctcagagcggcgacacgtgctgcttcaagtcctgcaattcctgcaccgataattgcaattcgctttgctgtgactgcaggagtaatctgacggcttgtctcataaccattctcggcatttaatacacagcttaggaatgcacggttttggatattgtctgtacatcctttattacacatcatacatgttctgacatcgcagcagtgtccatcggcacacttgtttgcaaaatcaggatcggtaagcagtgaacgcccgagtgcaacgatgtcagcagagccatttgtaataacggcttcagcagcttccggtgttacaatacgaccaaccacggatacgggaatggaaacgagttccttgatttttttagagtatgaaaccataaaaccgtatggctgtgttcccatggcagggatggtatctcccatatttccggtatggttagcctgcgcgacatgcaatgtgtcaacaccggcagcttctaattcttttgcaaaaatgcaggcctcatcaaatggaagaccaccttttccccgaaagccgttatctccaagaggagttacgattggaagcttgtagtcgataaccatatctgggacaattgcttttaaacgccgtacaagagttaaggcgaaacgtgtacggtttgcaaggtctccgccatattcatctgttctgtgatttaaaataggagagcagagcgatccgacaaggcggtctccatgtacttcgatacagtcaacgcctgctttgtgggctaaaacagcacaattttccatgtgcttaataatttcatccagttcttccgcagttacttcatttacaaagtgctgcatatcatggtgaagtttggctcttgcctcctgcatttttccctggtgaaacatttcgtttaaagctgcgacgttatagtctggatggaacagctggattccaagctttgcaccgtatttatgacatgcatcggcaagccgctggaagccttctgcctgttgaggagagtaaagttttggtgtaggagagaatgttgaaagaggagcaacgtctccaatgacaatgtatccaacaccaccttttgcaaggcgctcatagaaacgaaaactctgttcgccgatagatccatctttttcttcgtatcctgttgtaagtgggggaaacataatacggtttttaaattcaatgtttccaactttaatgggctctaataatttcattgtgcacacatcctttcaaagtgattatcttatttcaatggtgttaaaaactctaatatgagcctgtctaattcagctcttgcagaaccgcttgcaaagttgtgatttgcgccttcaattgttttgtaactgcatttgccattatagagtgcttcatatcgatgacaggtagcatcatctaccagatcgtctgccgttcctctgataagaagaacagcacctgtatatcccgctgcggatgaaaacggttcatactgatataaatcatggttaaaagaagtagggaagcaaagcccttctatatctgcttttgtgattccctgtgcttccattgcctcggcgcggtctttacatccaaaccacatgccggctcccgggcacatgagtatgagagcatgtggattaacgataggcgcagcagtggcagctgcatagccgcccatgctctggcctgataaaataattttatcaggattggcaaaatcctgctgttttgtccagtttataatatcttcgatatcatgtaagataccggtgaatgtcatgtcctcgaactcaccgtcgctttcgccatttccgtataaatcaaagcggacgctggcaaatccgttttcagccagaaatctggctgtgtgggtatagatatttttgtatccgcttttatttccggtaaatccgtgtacgttaatgatggcggggaagcgcgagccttcatccggaatatttacaattccgcgtaagacatgacctgagcggtttgttatttcaacttgttttgtcaatgcaagatacctcggtttctgaagttattctgcgtttgcagcatttcgtttgtctgataaattctgtaacatttcagctgttttctcttttgtaagagggtatacaaactttaatacaagtacagctaataagtacccggctacatataatccggtatatgttttccagagacgtccggagaatgcttcgctctgaacggcctcatttacgttaaagcctgcgattgcaagtgcaaagctgctcatacttccggatacggcattagcaagcttacggaaaaatgtatatgcagagtacacgataccttcgttacgttttccggtctgaagttcctgatagtcaattgcgtcatttacaagggcccagactaatacctggaaaccgctgacaccaagataacagattccgttgataataataaagagcattgggttctcaagagggaaaaagaataaaatagcataaacaacaactgagaaagttgcactatacataatccattctttctttccaaatttctttgcaacaaattttgtcccaatgaatgcgataagcgaccagataacgcttaacatgcctgaaactgccataatggcgacatttccgaaatagtcacggaataagtaggtatttaagccgtttaccataccggcaccaacgataccaataaagctggataacataacaccaagtaaagctttgtttttggagatggctttcagcacgtctaaatagttaagcttctctttttctttggcaactggctcggtgataatacgctccttgcaccagtgtgatgtaaacataaggcagatgaaaccgataacagcacagatggctgccataataaggaagtggcttggtacaggctggttgtctttgtataagaataatggaccggcaataacgatgacggtcataaagattgtgccgccaagacttctgaagcgtgaaaggtcggtccgttggtttacatcatctgtcataacacttgaaagacttccaaatggtacgcttacacatgtgtacataatttcatatacaacatatgtgatgaacatgtaagcaagacgggcgccataagcaaaattgcttacgttgacgaagcctaagatacaaaggactgcggttgggaaagcaaagaatttaatccacggaatgaatttacccttgcccttgttctggtgactgtcaacaagtgcaccgattaatggatcgtttatggcatcccaaagctttgtgataagcataaggattcctacgtgcaccgggttgaccttcagcaccagggtataaaaaatagcaagatacatggctcggaactgttctgtacagcaacatcccaaatcgccaagagtgtaaccgattttgtccttcatggaaaatggtcttgtttctttcataataaaatacctctcatttttgtgttgttttggtagctacatgttcattatatggggattagagagataaacatatacaaaaattgcttgcaaactatggaaaattgatgtattgtataaattgacaaaatgaacaaaaatatggatgctggaatgtgcaaaattaacatatgaaaaaacagagttatgagatggaatatataaaaatagaagatagcggacagcgcagttttggacagaagaaaaaccatacaattatttttgtgacaggtggtatgggatatttacgtcaggaaaatgaaaaggcggtctgtaccatggaggacttaatatttattaagcctgacaataaagtgaagattgaatatcgaaaaaacaaatatccgttagaactatatgtgctctatgtgggaacagagttattgcagagcttatcagatgaaaatacaagacttgacgaggcatttgatatcgttccctttcaggttaagacagttcattctgagagtgaatctgccatgcttataaagaatatttccaaaaagctgtattcaatgcttaaggaatctcctaaatttgcgcacacattgtatgagaaaagcctgctgacaatgcttctggtacttgcgttgcggtcgtctgtcaaggaggacgtacagctaaaattaaataagaaaaagcatgttgtaatggatgatattttcatatatataagagaacacctgacagaagatatatcattggagcgcctggaaaacgagttttatgtaagccgctatcatattgtgagagaattcaagaagatgacaggcgaaacgccacattcatatattgtaaagagcagactggatctgtgcagacactatatagagcagggaaaaagtatccgtgaggtttatgaacttggaggatttggcggatacaatcattttttcagggcatttaagaaagagtatggtgttactccaatgcaatattataaaaatctgcagatcgacaggaatgaaagataaattgataaaaacagcagtatcatgtttgaaataatgcaatggctaacggacagtttcccgaataaattttcagttttcccatatactaactcccaagctaatatatagcaaataagagaggctttatccacagagatggaaacagacaaagcgctcttgcgaaaataaagcattggaggaaaatttatgaaagcaacgggaatcgtgcgtagaatagatgatctgggcagaattgtggtgcccaaagaaatccgcagaacgctccgcatacgtgagggagatccgcttgagatatttaccgaccgtgagggagagattattttaaaaaaatattcgcccatcggagaattgagccagtttgccggggaatatgccgagagtctggcgcacacgacgggatatctggtgctgatcacggacggggatcatgtggtcgcggcgtccggcagtggcaagagagattttgagggcaagcccatcagcggacagttggaggagatcatcggtgagcggaaaagtctggtagcttctgacgacgaaaagacatttgtaaagctgacggcggacgatgccggcgagtacagacagcaggcaatcagcacgattatctgtgagggggacgccattggcgcagtgatcctctgctcacgggaagaacgggagaaaatgggagagacagagagcaaacttgtcgcggcggcggcaggctttctgggcagacagatggaacagtagaacagaactggaaaaaggcatttgaaacagtgtgtttcaggtgcctttttgggcatatgccttgaaagaagccgggagacatgataatctcataaggcaaatgagtttcatggaaagttagaaaggtggaaacatatgagcgaaaaacctgacgtgacgatgggggaaatgaccaaaacaaatgaaaagtctggcaggaaggtgccgaaaaaaatcatatggacgatcggcgcagtggctgtggcggcaattattttgatcattggaatttgcagcggagcatttttgagcagaagtaacaggattctgcttgcagcaagaaataccataaaagatctgcccacggttgttgagaataggaatgttgcagatattatagcatccggaaaatatacgattggtgtaaaaggggctgtcaggggaaaagactttgatggaacgtttaaatacaaagatacacagctgcaggcagggggaacgatttcacttttcggtagggagaatctggattttctggcaaacctggatgatgagcagctctgcgcaagcatcccgatgcttacagataatctgctggtatacattacaaagaagagaaagacggctacatagtggatcttctgggagcggatggggttgcatcgatcgatgcggcacttcgtgaacttacctcgaaagaagaacagaacagagcggcgcaggagatcctgtccgtaatatacgatgagtacaagacgctcgatataaaaaaagcagaaaaagaagaattcatagtggacggcagcgtcagaaaatgtaacgggtatgaatttaccgtcacagaggatgaacttctgcaggtaatggatggagtgaaggaggtatacgatgcgtattacggtggagcagcagatgcattgaagctgaagctgggggatgacttttcgcagctcagagatagagcatgcagtatgggggatatcaatgtaaaagtctatgtgtatcagaataaactggcagcggttgttgcggaggcggaaaattctgatacggcattccacctgctgttcaagggaggagaatacagaatgcagaatctggaattgctcgcagaggatttggagggtgagcattccatactggaactgacaggaaaagcagcaggggaagaagggggctatgagtttttgattgataatggtgagcatgatataaaccttgtgatttcgatcagtggggaggttcaatttgaaaaaatgagcggcgacagaatagatgtgggcaacatgtctgaagcagatctgagaaaatttattttgcgtacggttggaacaatcatcacaagccacatcaggtaaccgcaagacggggataagaataccagtatcccggagagagatgtgacagcagccgggcgtgtgagtggagatgagactgtattacggtgcacggagattggaaagatacagagaagaacaaatatggcaaaataaagccaagttgtgtaattgttccacagtatggatctgtcctataatgaggacaaagaaaaaaggcggcgtctgacgggggagaagacgatcagatgctgcgggcagggggaaaacatggagaagtatggttttggcgtagatgtcgggggcacaagctgcaaacttggtctgtttacagacagcgggaaactgatggaaaaatgggagattccaacggataccagtgaacagggggaacatattatagaacatgtggcagcctcactggaacgcagacagagagagcgggggcttgcggatgagcagatcataggcgtcggcattgacacaccgggaattgccgggcgggatggagttgtcagaggcgctgtgaatctgggatgggaggcatgtccggtgcaggagcagttaaagatgcgcctgcagaaaaaggtctgtgtctgcaacgacgcaaatgcggcggctctcggagaactgtggcagggcggcggcagggggtaccgcgatatggtgatggtaacgcttggaacgggcgtgggcggagcggtcatcctgaatggaaaagtgctcgcaggcgcccatggaatcgcgggcgagatcgggcatatgaccgtgttccacaaggagattgagcggtgtgcctgtggaaaatacgggtgcgtggagcagtacgcttccgcaaagggactgatccgcataacgagacaattattggagaaaaaggatccctacacggtactcgtcgacacgccggaactgtcggcaaaacagattctggatgcggcaaagagaggcgaccgtctggcactggatgctgtggaggttctgggaaaagcgctgggaagcgcgctcgcagccgtggcggaagtgatagatccagaggtctttgtgatcggtggaggaatcgccggggcgggagagatcatcccgcgtatcgtacagaagtattacagacccgatgtactgccggcaggtgcggacattccgtttgaactggcacgtctgggaaatgatgccggcatgtacggcagcatgaaacttctgctggactcctcagacgaaaaataactgccggatttctgaagccggaatggaagatgttttatgatggagatgtcagaaaatacgaagttccagaatacagccggcagcggcattctgatcgcaaaatccggtatttctaaccatgccgcgtcgaacatcctcgatgatctgtgtttttccaagtttggaacattccacggggggtgtccgcaatccgcagacaattttaggacttttttgtgtgccccttcgtggcaccactgaacaaaacataaccgcgcgaagccgctgtctgagttgtcatctgccctgttttcaatagcagatgacagcgagttcggttcgcgcggttttatattgtctgtgaagcggtgccactaggggcaccagaaagtccgctcattgtctgcggtttgtcggacactccccgtgaactgtccaaacgtggaaagacacagaattcgatgtccgacgcggcacggaagaaatactcggattttactccaaagaatgccgctgccggctgcatctggaacttatcgttttctctctctccatataaaacatatgccgttctatgcttcagaaatccggcagttatttttgggagagggtacatgccggataaacttgtgaaacatgccgcgacagtgtacaatagaggtaattaacgcagaacggagaagatgcagtttgaaatttatacatatcgcagacgtacatctcggggtaaagccggatcagggaaagccgtggagtgagcagcgggcgcggcagatctgggattcttttgcagatgtgatcggggtggcaaaaagagaaaaaccggagtttctgtttgtgacgggggatcttttccacgcacagccgctcaaaaaggaggtgcgggaggtcagccgccttttcggagagattccggacacacaggttcttttgattgccggcaatcatgattatctcagggaaaagtcgtattacctcgcggatttgtggccggacaacgtgacggtatttaagaaagaggaagcggaagcagtcgattttccggaatacaacacgaccgtatacgggctaagctactggcacagggagatccgtgacagacggtatgatgatctgcgccctgtaaaccgcagcaggtgcaacatcctgctggcgcatggcggcgatgagcgccatattccgttttcggcggagcggatattacagaacggatttgattatattgcggcgggacacattcacaggagcggctggctcatgccgcacaaggcggtaatggcgggaagcctggagccgacagactgcaacgacaccgggccgcacggatactggatgggaacgttcggtgcagcgggggcagatgtgtatttttatccgctgcgccattgcgaatattgtcatgagatgtatcaggcagaccggaacacgacagaccgtatgctgtgggactgggcaaaggagctgttggagcagagaccggagtatcagtatttccgtctgtatatcaaagggaaaaaagatccggagtattcctttgatgtgcaggagatcgggaagctcgaccggattgtggatattacagaccagacggtgccggattacgattacgggaagctgctggaggagcacgcggattcgatacttggggaatacatacgcagtatgcgaaaaaaagaaccgggcgtctgcaccgcaaaggcactggagtacggtgtgaatgcgctgctcggctatgactgctgacggaatgcctgaagtatgacaaagagcaaaggatgggacagacatgcagattgacagagccgcaatttttcgctttggaaagctggcagatagaaccgtggattttgccccggggatcaacattgtatatggaaaaaacgaagccggtaagacgacgctgcacgcgtttctgaccgcgatgctgttcgggctggaaaaaggccggggacgggcaaaggggacggagggctatctgcgctatgagccgtggcatgcaccgtcctattacagcggtgcgctgcagtttagcgtcggaggcagaccgttttatctggaacgcaatttttaccataaagaaccgagagcacgcctctgcaacctggcggacggggaggaactgtccgtcgcgtacggagatcttggaatgcttttaggcggggtcacccgggaggcgtatgagaacacctgtgacattccgcagtgcaaggcggtgacgggagcagagctgaccgggcttctggcagagtatctttccgatatgtcggacgggggcaatgcgggaatccgcgtgacgcgtgcggtggaaaaactggagcagaaaaagagaagcctgcagtcgcagatcaaaagtgaacaggagaagcgggaacaacagctgcagcagcttactgtgaagcggcgcatgctcgaggaggactgcggcaggcttcgtgagcagatcgagaaggcggcagcggatatgcgggcgtatgccaggatgcacccgcaggtgagagacggacagcgaccggaagatgcccgaactgcggaaaatgcggggactgcgtcagacagggaaaggagagctgacggaaacggttttcctgtgagaagcctttttctgggactggcggcagcagtgggactggcaggaaatgcatggtggtatcaccgcgcgggttatgcgccggagctgtttgcggcggcggaaggcgttcttgccattctgctcggcatcggagtggcaggcatactgcgccataggagcgcggggcaggcgcgtgcaggagaaaatgggaaggagacgacggaggcgccagagagcgcggcagcggaggacgcggtgcgcatccggcttgcggagtcggaaaagcagagcagacgcctgcttgcagggttggaggaaacactcgcggagaaggaaacgagacgatgcaatctggcggaacagctggaagtatgcagcggagcgggcgcacgggagagagaactccagctggaacttgatgccgtcgagatggcaaaaaatgagatcatccgcctgtcaagggaatacggggacgagcggagagatgagatcaacagtgtggtatccagatatgtctctgcgattacagagggaaaatacgatctggcggaagtggacgaaacgggaaagctccgcgtgcagacggagggaagagaggttttgccggaggcgctcagcagaggaacgctggaacagttctattttgcgttccgcatggcagtcgggagcattgtgacacaggaagaaccgctgccgctgcttctggatgaaacctttgcaatgtatgacgatgaccgtctgcggcagacgctgcggcttctggcggcaaacggatcgcagacgatcctgtttacctgccagagacgggaacagaagctgttagaggaactgggaatcgcataccatatgatagagttatagtaccgtttgcgttatgtgcaaagtggggcaggacggcactgcgcgacacgtgagaaaagggcagggaggaatacggtggctgcaaagaaaaagaagaaaaaatatcggggattctggatatttgtcaaagtacagtttgttctttccctgctggtgctcggcgggctgggctactatgtccttggcggatatgcctcagaggtgagcagcatccacaaggaagcggacagtctggtacggaattccacggaggagacgttccggagataccgcacaagcgttgtgtatgcggcggacggcagtgtgatatccaagctcaatgaccagggagcgtcctattatctaaagcgcgacgagataccgcagtccgtgatagatgcggtggtctgtatggaggatcagcggttttaccagcatagaggtgtggacttcagagcgcttgtgcgcgcggcgaaatcactgattgaaaaccggaagatcacgcaggggggaagcacgatcacaatgcagcttgccagaaatgtatttctgacgcaggagaagacctggcagcgcaaggtggaagagatttttattgcacagaatctggagaaaaaatataccaaggatcagattctggaattttatctgaataatatttattatggcaacggctactatggaatcggggcggcaggcagaggctactttgacagcggggttgatgaactggatctctcgcagatcgcgtttttatgcgcgattccgaataatccgaccgtgtatgacccggttacccatatggatcatgcgattgagcggcgcgaccggattctggggaaaatgcgggatgacggtaagattacacagatggcatatgcggcggcggtggtggaaaatattaccttaaagcggccggaggcgatggaaaaaaataattatgtggaaacatatgcctattattgtgcgacgcgtgcactgatggagcaggcagggtttgtgtttcagtatcagtttgcgacggaggacgagagggaagcttacgagcgggcttacagcgaatcctacagcgattgccagaagcggctgtacacggagggctatcagatttatacgtcttttgatctgcagcttcaggaggaactgcaggtagcagttgacgataccttatccggttttacggagaaaaatgacgagggtgtttatgatctgcagggggcggcagtctgcattgacaacgataacggctacgtgcgcgcgatggtgggcggcagggagcaggattttgacggatacacgttaaaccgcgcctaccagagttaccgtcagccgggaagtgcgattaagccgctcacggtatacacgccgtcgttcgagcggaattatacgccggagagcattgttgtggatgaaccggtggaagacggaccgaaaaatgcgaacggtacctaccttggaaatgtgacggtgcgcaccgcagtcgaaaaatcaatcaataccattgcgtggaagctctatgaagaactgacgccgcaggtcggtctgtcctatcttgagaatatgcatttttccagattggatgcggcggattatgtaccggcgacagcgctgggcggttttaccaacggtgtgtcgcctctggagatggcagccggatatgcggcgctcgccaatgacggaatgtaccgcgagccgacctgtattatgcggattacggatgacactggagcggaagtgtatctcgctgcacaggagggacaggaagtctaccggcagaatgcggcacggatgatgacagacgttttaaagggtgtatttatcaacggtacggggcgcggactgggactttcagatatgccgtgcgccggaaagacgggaacgaccaacgaccacaaggacggctggctggtcggttatacgagatactacacgaccagcgtatgggttggatacgatatgcccaaagagatggacagcctgatgggtaatacctatccgggaaaaatctggcagacatttatggagcaggcgcatgagggactggaatggctggattttctgccctatacgcagattccggatgcttcttccggggagatggaagcagaggatgcagcgacggatgagggaaatgcacagggggaaacgccggcggagaatggagacacaccgcaggagaatgtgacggatacaccggacacgccacagggaagtgcgacggatgttccgtcatcttcacaggaaaacgggcaggggatatcggatacgccggatgccacacaggaacagccgtcagacgctccgcagcagaatacaacaggaacgtcacaggaaaatgcatccgacgtatcgcaggaaaatgcagcgcagtcatctggggaaaatgcagcgcagtcatccggggagaatgcttcggatacgccgcaggagacagcgcccggggcaccttaagagaatacaccttaacattgacagataagactggaaacgttatcataagcatgggtaaaggcatcggcagagtacataacagacagaaaacgatgtaaggatacaaatagggaacaggagaatggaagaatgaaaaaatatgcatttggagttgacgtagggggaacgacctgcaagatcggattttttgagacggatggaaagctcattgacaaatgggagatcaagacgaataaggaaaacggcggagcatcgattctgccggatgtggctcaggcgattgagggaaagctgacagaaaagggaatctccagggacgatgtgcagggtatcggcgtcggcgtgccgggaccggtaaaaaatgacggtgtggtacaccgctgtgtgaacgtcggctggggtgttgtaaatgtagaaaaagaactgggagatctgaccggactgaaggtgaaggcaggaaatgatgcaaacgtggcagcactcggcgagatgtggcagggtgcggcaaaaggctgcagagacgtcatcatggtaacgctgggaaccggagtcggcggcggtattattgtcgacggcaaagttgtagccggatttgacggagccggcggtgagatcggtcatattacagtgaatgcacacgagaaggagcagtgtaactgcggacagtacggctgtctggagcagtatgcgtctgcaaccggagttgtgcgtgtggcgaagcgtaccctggagaagacatcggaagataccgcgcttagaaatcatgcagatctgaccgcaaaggacgtatttgacgaagccaaagcgggtgataaagtggcgcttgaagttgtcgatgaggtatgtggcattttaggagcagcactttccaatatcgcatgtgttgtgaatccggaggtcatcgtaatcggtggaggcgtctccaaagccggtgatattctcacggatgcagtgaagaagcactttgttgccacttcattccacgcatgcgccaacacaaagttcgtacttgcgggactcgggaatgacgccggaatgtacggctgcgtagagatgctcttagattaaaaagggctttcgcccgcgtgcactgcactataaacgggatacgtttcattataagaatattggagaatatgaagttccagaatgcaaccagaggcggcaattctttgaagcaaaatccgaggatttcttccgtgccgcatcgaacatcgagttctgtgtctttccacgtttggacagtccccggggtgtgtccgacaaaacacagacaatgagcggactttctggtgcccctagtggcaccgcttcacagacaatataaaaccgcgcgaaccgaaactcgttatcatctgctattgaaaacaaggcagatgataactcagacatcggcttcgcgcggttatgttgtgttcagtggtgccaacaaggggcacacacaaaagtccttaaattgtctgcggtttgcggacacaccacgtggaatgttccaaacttggaaaaacacagatgatcagggatgttcgacgcggcatggttagaaataccggattttgcgcttagaattgccgcctctggttgcatctggaacgtgatagtctctgcttcccataataaaacatatcccgttttaaagtgcaaagcgcgggggcggcagtcctttttatagcgctgcctacgcttctacggcgcgtttgcggacttccgcaagtgcatgtgataccggcggaatgcagataataatcaaggtgatgattgcctccggaacaaggtaggatgcctgatagccggcagaatatgccagcgggctcatgccttccggtgcgtatgctgcgaaaaatacaacgccggagatcgttgcaaatacaaaacgtccgatgacgccggcgatatagccgatctgaagtccccactttttcttattgaagaagccggcaagacccagagcaccgaatgccagcgggtagtctaagagcatctgcgggattgtgtagaaaatcggctccagtacgaactgcaccaggccgtaagccactgcggtcataatgccgacatacggaccataccagtaagcgatcagaacgatgaaaagcatggacagcagagtgacggaaccacccattggcatgtcgaacagcttgatcatcgagcatacaacggccagcgcgatcgcaacagcagagtagacgagctgctttgtggtcagtgcggacttgtgcgtggcgttcttgtggcgcacgatagcggcaacaatcagaagaagggcgatgactgcgatgacgattgcaataccgacggtagtcagatggacggaaccgtcaccccagccgccttccggtgtagcaaaaaagttattcataaaaaaatcctccttggtgaatatgtagccaggaggatttgtctgcgttattgcaaaaagcttccttacgccggtattatccggttcaagtaataagggtcgatgaacgatcatctctcagcagaatctgcacccctagcgttttcatattcgatattattataacgaactttactataacgattctatttggaattgtcaagtacgattgtgttcttctccagttcttctgtgagcggcgcaatctgtgtgagcagattggtcatgtcctcgaagagggaactcttggtggtcccgagatcattggcgtgattgatatgctccataacagcgtcaaactgccgttcctcaaggctgaaagactggctgacttcatccagcttctgctctgcggcggacatggcggttgtaatctgctggtgtacggtgtccgcaccgccggcagcggttgtgatctgatcaaacacttcatacgtggaatcaacattttccatactctggttcagggcgtcctgcgaggtggaaatactggtattcaggttggcggtgccctgctcgacgtcgccgatgctgatatctaccgtgctgacaagactcttgatctcactcgcaagatttttgacctcctcggcaacgaccgcaaagccttttccctgctctccggcgcgggcagcctcaatcgaagcattcagggcaagcatgtttgtctggttggcaattgagatgatctgtgccatgcagtccttgatcttctgaacggaaacctggaaatcggaaaaggtgttctgcatttccaaaaagcgctcctgcacttctttggagctgtctttcaatccgtcaacacgctgctgtgcaagaccgacagagctggcaatgtcagatttgacggaagcaaattcaccggaagccctgtccacatcgccgaacagctcatgaaaggaatccagcttttcgcggagtgcggcattttcgtccagaacgagctggaatgcctgtgtgatggactgcagttcatctaaagagtgcacttcgctggtggagagctgcttctggtaatctaacaggcagtccgcaatatgcgcaacgggatgaagatctaagcggctggtggacgtggctggtgcagccgctgcattctttggtgtttttaatgaaaacatagaaatcctcctctttctatcacagattattcaaatacgacacaggtcatggtctggttgacgaactgctgattataatgttctccgaatccgatcagaccggcgtgatcaccgagtgtggacatggttttcagataatcttccatatggtgttcctgtgagaacagaaggtaacggaaaacacagttgatggagaaaacaccggaaatatggttgaaatcgcggcggatgcgctgcagcgtctcatccagaatctcgttgtaatcctgttcttccagaagaacgagcacatcggaatcattgacctgtctgtaacagcagagaccattcccggatacttcctttaaggaaataatacagatgtcctgtccgttcattttgccgatcggattgtggaaggtctggttgatgatattgctctcgctgatatgtaaggcgtccatataagcctgcttggaagacctgccgtttaactcgccgacatagtatttgctccggtcagtattggaagcgatgaagcggtagcccggcatcggtttgtagagattctccttgtagacggcaacttttccgcagttgtttttcacgaaggcatagacgtctgcatcttcatagaccgttccgttgacagagacttttccgccatccccggtgccgccgacaagcggaattcccgccttgccgagaatgctgtggatcgtggtcagcacacaggcgtcatttccggtacacaggtcaatacagacggtatctttagaacttgcgtggacgttttttaaatcctgttccatgcgttcgatatatttgaccggcatggtggatgcctgctccaaaacgttggcaacagcggtgacattgtcataaaaagcaaccagaccgactcccttttcgacgaccctggtactgtaactcatgccgatacagccaatgctcgggactcccgggaaaagggactccagttctgtaacgtgtgcctcaaactggtctgcgttggacatcaggataagaagtcccggagcgtgaacgccctgtgcagcttcttttaagtttcctgtctggctcattccaaaatattgtttcatcagcgaactcctcccacatcttattacaaatattgtaagcaattttgcatgatatttcaacgcattaatgcaattttagagaaacgtttccaaaaaataccttgacaatcaaacaggagagacatatactttgaaaagcaaataatttgattatcaaaatatttgaaaagcaaataattaaaaggaacagggaaaaggagaagaaacatgttagagaagatgagaccgatcattgcggagcagttaaacgtacaggagtctgagattaaagagaacacaaagttaaaggaagatctgggtgcggattcgctggatctgtttgaacttgtcatggcgctggaggaggaattcggcgtggagattccgtcggaggatctggaatcgatcgtgacggtcggagatgtgatcacatatttgaagaaccgcggggttacagcataggcgaagacagcagccgggacataccggtgtttaagggtaagaaaacagaccggcaggaagaaaagaggagaagcatggaaacaagggtaagcagattgcttggaacaaaatatccggtcattcagggtggtatggcatgggtggcggaatatcacctggcggcagcggtgtcgaatgcgggcggactcggaatcatcggggcggcaagcgcgccgccggaagtggtaagagaacagatccgtgaggtaaaggcgcggacggaccgtccgtttggcgtgaacgtcatgctgctcaatccaaacgcgccggaagtggcgaagattgtcatagaagagaaagtgccggttgtcacaaccggtgcgggaagtccggcaaagttcatggaggcatggaagcaggcgggcgtggtggtcatcccggttgtggcgagcgttgccatggcgaagatgatggagcgtgctggcgcggacgccgtggttgcagagggaatggagtccggcggacatatcggtgcacagacgacgatgacgctggtgccgcaggtggcggacgcggtgtcagttccggtcattgcggcgggcggtatcgcggacggaagagggatcgcagcctcctttatgcttggtgcagagggggtacagatgggaacccggtttgtcgtggcgaaggagtctattgtacatgaaaattacaaggaacggatcgtaaaggcgcgcgacattgattccgaggttacaggcatgagcaccggacatccaatccgggttctgcgcaatgcgatgagccgcgaatatttaaagctcgaaaaagagggcgccggatttgaggaactggagcagctgacgcttggctccttgcgaaaggcagtgatggacggggatgtggtgcacggcagcctgatggcaggacagtgcgcgggacttgtgaaaaaagaacagacctgtcaggagatgatagaggaactgatggcgcagaccgcggggcttttaggtgacggagatttttgggaaaagaagagcgtcttcttgggacgcacatcggataagggagaatgacatgggaaagacagcatttttgttcccgggacagggagcacagtacatcggtatgggcagagatttttacgagcagattcccgtgagcagggacgtgtttgcggcggcatccgaggcgtccggtctggatattgcggcgctctgctttgaagaaaatgagaaaataaatatcaccgaatacacacagattggcatgctgaccgtggaggcggcgatccttcaggcgttgcttgcagaaggaagaacaccggatgtggcggcaggattaagtctcggagagtacggggcactgctggcaagcggcgtgatggagcagagggatgcgtttgcgcttgtgagaaagcgcggcatctacatgcaggaggcggtgccggccggcggcgcgatggcggcggtgttgggactggatgcggaaaaaatagaggaaatctgtggacagactgctggcacggtatccattgcgaattacaactgcccgggacagatcgtgatcaccggggaggaagcggcagttgccgcggcaggcgaacagtgcaaagagagcggtgcgaagcgtgtggtgccgcttaaggtcagcggaccgtttcactcgtccatgctaaaagaggcgggagaaaagctgggagaggcgcttgcgtcggtaacactccgggagataaagctgccgtatctggcgaatgtgacggcggactatgtccgggaggcggaggctgtgaagccactgctgaaacagcaggtgtgtgcaccggtacgctggcagcagtccgtggagcgtctgcttgcggatggcgtggatacgtttgtggagatcggtccgggtcatacactgaccggatttatgaaaaagatcttaaagcaggccaaagtcccggcagataccgtgcaggtatacaatgtggaaaccatggatgacttcaaggaatatatgtcaaagtagaggagagagtcagatgctggaaggaaaagtagcgcttgtgaccggagcgggaagagggatcggcagtacgatcgcagaaacacttgcaagggaaggcgcgtttgttgtcgtgaactaccgcggatcgggacaggcggcacaggaactggcagaaaaaatcggcggagtcgccatgcagtgcgatgtggcggattttgaagcctgcgaaaacatgatcaaaacgatgatagagacgtatgggcatctcgatattttagtcaacaacgccggaatcacaagggacggtctgctgatgaagatgagcgaggcggattttgaagcggttctttcgacaaatctgaagggaacatttcatacgatacggcacgcgtcccgctattttttaaaacagcgttatggaagaattgtcaatatttcgtccgtgtccggtgtgatggggaatgccgggcaggcaaattacagtgcaagcaaggcgggggtgatcggactgacgaaaagtgtggcaagggaactggcgtcgcgggggatcacctgcaatgcggtggcacccggttttatcgagacggatatgacagatgccatgacagagagcgcaaaggaagccgttcaaaaacagattccgctggggagatgcggaaatacaaaggatgtggcagaacttgtgacatttctggcatcagacaaggccgcgtatatcaccggtcaggtgatctcggtggatggcggcatgtgtatgtaagggagtagtaactgaaagaaagtgaggcaggtatgagaagacgggtcgtagtaaccggaatgggcgtgataacgccgatcgggaactctgtagaagaattttggaatgcggtgcgggaagaaaagacaggatttggggaaatcacgcattttgacgcatctggatataaatgccatctggcagcggaagtaaagaattttgacgggaaaaattatatggatcccaaggcggcaaaacgcatggaactgttttgccagtatgcggtggcggcaacgaaagaggccatcgcggatgccggacttgagatggagaaggaagacccgtatctggtgggaacagcgatcggaagcggcgtcggaagtctgcaggcgatcgagcgcgaatataagaagcttctggagaagggaccggggcgagtcaatccgcttctggtgccgatgatgatctccaacatggcggcaggcaatgtgtcgatccagtttggcttcaagggaaaaagcatcaacgatgtgacggcttgtgcgaccggtaccaacacgatcggcgaggcgttccggagcatccagtacggcgaggcagacgtcatgatcgcggggggtacggagggcagcatctgtccgatcggaattgcaggatttacggcgctgacggcactgtcgtccgagaccgatccgaagcgatgttccctgccgtttgataaggagcggagcgggtttgtcatgggagagggcgcgggaatcgtcgtgctggaggagttagagcatgcgaagcagcgtggagcgaagatttatgcagaggtagccggctacggatgttcctcggatgcctaccatattacatctccggcggaggacggtgcgggcgcagcgcgtgcgatggaaaacgccatgaaggatgcgggggtaaaaccggacgagattccatacatcaatgcacatggaacggcgacacatctgaatgatctgtttgagacgcgcgcaatcaggcttgcgtttggggaacatgccacgaagcttaaaatcaattccacaaaatcgatgatcggacatctgctcggggctgcgggcgccgtggagtttgtaacctgcgtcaaggaaatgcgggaaaattatgtgcacgcgaccgtcggctatcagacaccggatgaggaactggatcttgactactgcagggaggcggtggcgatggaggtgccgtacgcgctcagcaactcccttggattcggcgggcacaatgcgagccttttacttaagagatatggaggcgaggcgtgatggaactggagatcggacagatcatggagatccttccgcacagacagccgtttctgctgatcgatgcggtggaagaactggagcccggaaaacgcgcggtggcgcgaaaatgcgtcagctacaacgaaccttatttcggaggacatttcccgggggaaccggtgatgcccggggtactgattgtcgaggcactggcgcagaccggtgcggtggcaatcttaagtatggaggaaaactgtggaaagaccgcgtattttgcggagattaaccgtgccagatttaagaaaaaagtggtgccgggggatgtgctgaccctgacgacggagatcatccggcagaaaggaccgatcggtatcggcagtgcgacggcatctgtgcgcggggaggtcgtctgcacggcggagcttacgtttgcaatcggcagcaaggaggagtagaggaaaaatggcggctttgtttcagaagcggaaaaaagaaccggcagaaaaaacaccggtggaggcagcacaggcgctgcaggagacgattgtgtgcccggcctgcggcagggagatcaataaaaaggaagcggaaaaaaatctgtatgtctgctatgaatgtggcagttatttcagggtgcgcaccagaaaccgcatccgcatggtggcggatgccggaacgtttaccccgtggtttgaggatctggcggaggcgaatccgctggagttcccgggatatgaggacaaagtaaaagcggcaaaggaaaagaccggactgcatgaggcggtcaccattgggcactgtaaaatatacggcgaggatgcagtgctcggtatttgtgacgcaagatttctgatgagcagcatgggacatgtgatgggggagaaaattgcctgcgctgtggaacgcgcgacagaggaaggtctgccggtcatcctgttttgctgctccggtggcgccagaatgcaggaggggatcgtttccctgatgcagatggcaaaaacatctgcggcattgaagcggcattcggaagcggggctattgtatattccggtgctgacagacccgacgaccgggggcgtgacggcaagttttgccatgcttggagacatcatcctggcggagccgggggcactgatcggttttgcgggaccgcgcgtgattgagcagacgatcggggaaaagctgccggaaggttttcagcgggcacagtttcagctggagcacggatttgttgacaggattgtggagaggaaggagctaaagcttaccctgtaccgcatcttaaagctgcatcacaaaaaagaaggttatgccaatttcgatccggtgcgggaggcagactgcctcgaggcgacagaactgatgaaagagcgcgccacaaaggcgaaagcattgtccgcgtgggagaaggtcaaggcagcgagaaaggtggaccggctggcgtctgtggactacatagagcagatttttgacgaatttatggaattacatggagaccggcagttccgggacgatccggcgattgttggcggtgtggcgtatctggatggccagccagtcacagtgatcggtgtgcataagggaaaagatttaaaggaatgtatgcaccggaattatggaatgccgtcgccggagggatatcggaaagcactccggctgatgaagcaggcggaaaaatttaagcgtccggtcattacatttgtgaacacctccggcgccttctgcggcatggaggcggaggagcgcggacagggcgaggcgatcgcgagaaacctgtatgagatgtccggcttaaaggttccggttctttgcattatgatcggggaaggcggaagcggcggtgcgctggcactctctgttggaaatgaggtctggatgcttgagaatgcgacctacagcattttatcgccggaagggtttgcatcgattctctggaaggatggcagacgggcaaaagaagcgagtggcgtcatgaaaattaccgcgcaggatttaaaagcgctcggcgtgattgaggagatcataccggagtacggcatggcggatcagccggcactgatttccatatcgcgttacatgaagaggcatataaaaacatttttgaaaaaacagaacggaaaaaccggggatcagatcgctgcggagcgctatcagagattccgcgtgttttaaaaggaaggagacccgatatgaaggtaaagatcgtgggcaccggaagtgcagtccccgaaaaatgtgtgacgaacgatgatcttagtcaatggatggatacatcggatgagtggatcagaagccggacgggaattgagaccagacatctggctgtgagagagacaacgacagaaatggcagtggaggcggcgaagcgggcacttgcatctgcacatatggacgcggaggagctggatctcatcattgcggcgacgatcacgccggaccggctgatcccgaaccttgcctgcgaggtgcagagcgcactcggggcatgccgggcggtcgcctttgacgtcagtgccgcctgctcgggttttttatacgcgatggatattgcacgccactatctggaagccggcggaagccggcgggcgctggtgattggtgcggagacattgtcgcggatcatggactggagcgaccggagtacctgtgtgttgtttggggatggcgcaggtgcggcagtgctggaagcagatgaggcggaggagcatgcgggcatcttaagcaccgtgcttggaacggacggcgcgggcgggatggtattgcgctgtgacaaccgcagaaatcacaatccgtatgtgaagggcgacaccgcgctctcgtacgtgtccatgaacgggcaggaggtctataagtttgcggtgcgcacggtgccgaaagtaattgctggggcggtggaagcggcagggctttcgatggatgaaatcgattttttcctgctgcaccaggcgaaccttagaatcatcgaggcagtggcgaaacgcctgcatcagccgatggaaaaatttcccacaaatctgcagaagtatggaaatatttcctcggcgagcgtaccgattttacttgataatgtcaataatcatggtatgataggagaaggcagtaaaatagtactggcaggctttggagccggtcttacgtggggcgcagcagtgctccgctggcaggcggtgtaggcggtgtggtcgggaacagatactgctatgaacaggagtatgatacatgaccacggatgagacattgaacgaattactggtaaggctattcaaggatattatggagattgaggcgagatgtctggtgaatgaggaatttaaggacatcagctacaacgattttcatattatagaagccatcggattaaaggagccgaaaagcatgacggcggtggcaaagctgatggatgtcacgaccggtacgctgacgaaggcgatggatggcctgactgagaaggggtatgccgtaagagaacgcagcaagcaggacaaacgcgtggtgtgggtgtacctgacggacaaaggaaaagcggcatatgcgcatcacgaagagtttcaccgcaaaatgatcgccaacatcaagggacagctgaatgagcaggagacgccgattttgatctatacgctggcaaagctcgtggactattttcaagaggaatatggattggaggaggaatagacatatgagcagaggagcgttgggcaagaataactgggcgctgtttttaatgcttctggcaggaattatgctgggcggttttatcggaaatgctgctgcaggtgtttcgggacttagctggctgaattatgggcagagcttcggcttcgccagcccgattgtgctggatctgggcattctggtgatcacattcggattatcgatcaagattaccgtcgccagcattatcggcgtgctgattgcgattattatttatcgcttgatttaagttcacaagaaatagaaaagcctcgggcaggggaaaactcctgcccgaggctttttgcgtatgtctgatgcggggacataaatcgttccggggacactatcctgcgccaaagctttaacaatttagcggaataaagaaaaaaagattgcacatgaaaacattttatactaaaatgtatctgatgaaaatattgcagtgtatacacgcacaatatactaagagtaaggagacaaaaaaaatgggatatgtagatgaagttcttgcaaaagtaaaagagaaaaatgcttccgagccagagttccttcaggcagttgaagaggtgctggagtctttaagaccggtgattgaggcaaatgaggaactgtataaaaagaatgcgattttagagcgcattacagagccggatcgtcagatcatgttccgtgttccgtgggtggatgacaatggacaggttcaggtaaacagaggtttccgtgtacagttcaacaatgccattggaccatacaagggaggattaagacttcatccttctgtaaacttaagcatcatcaaattcttgggatttgagcaggtatttaagaattcacttacaacacttccgatcggcggcggcaagggtggttccgattttgacccgaagggcaagtctgacagagagatcatggcattctgccagagcttcatgacagagctttacaaatatatcggtgcagataccgacgtacctgccggagatatcggaacaggtgcaagagagatcggtttcttattcggccagtacaagagaatccgcggattatacgagggagttctcacgggtaagggacttacatacggcggttctctcgcacgtacacaggcaaccggatacggtctgttatacctgaccaacgcattgctgaaggatcacggcatcgacatcgcaggcaagacctgtgcagtttccggttccggtaatgttgcaatctatgcgattgaaaaagcacatcagttaggagcaaaggttgtgacctgctctgactctaccggatggatctatgatccggaaggaatcgatgttgcattattaaaagaagtaaaagaggtaaaacgtgcgcgtctcaccgagtacgcggcagcaagaccttctgcagaatatcatgcaaagcagaatggtgagcacggtgtatggcagtacaaggtagatctggcacttccgtgtgcaacacagaacgagcttgacatcgaggatgcgaagatgctggttgcaaacggcgttacatctgttacagagggtgcgaacatgcctaccacactggaagcgaccaaatatcttcaggcaaacggcgtattattcgtaggcggtaaagctgccaatgccggtggtgttgctacttctgcactggagatgagccagaactccgagagactttcctggacattcgaggaagtggatggaaagctcaagggcatcatggagaccatctacgcaaacatttcagatgctgcaaagagatacaatgcaaccgttggcggacagacagactacgttgcaggtgcaaatattgccggatttgagaaggtagtagatgctatgctcgctcagggtgtttgctaatcgagaatttctaagataatataagatatggttaagtcctgtaaacaaatcaaatcttcgatttgactggtgtttatgggacttttctttatgcatatataagacatgtgaatggtgagaatattgataaatggaagggatgttattaaaaaaatttgaagctgtagaattttacgttgaattttacagcttaatttcgtataatatatgtaaataaagaaaagatatccaggaaaggaagttgattttatgccgaatatattacctgtatcagacttaagaaattataatgaagtgttgaaaaattgccaggttggagagccagtgttcctgacaaaaaatggcagaggcaagtttgtaattatggatattgaggactatgagcgtgagaaggcagagaaaaagctgttgatgaagctacaggaagcagaagaagcagttaaggatgaaagcgcctggatgagtttggatgaactgaagaaatctgtcggggtatagcctatgatgaaattacggattaattctattgtggcagaggacttgaagaaaatgaaagagtatattgcggaagacaatgaagaaatggcagtaaagaccattcaggagatatatgctcgaattgagaatatacagcaacttccgtatatgggatcggagcttgctaaaagggtcagcttccggacggattataaatatgtgatttgtgggaattatgttgtgctgtataagattggaaaagagtatgtggagatttaccgggtggtgaatcggcatcaggacattacgaagatattttaaattaaacggaagaaaatgatggaataacaagcaaaagtaaaaataaaaataaaaataaaaataaaaataaaaatgcctaccttcgtacctgactggtggaaggtaggcatttaattaccatagtaattatgcgtaatatacaaaacgctatgaaagctttatttttaggtggttcttctatccttatgccatctctttttccccgatcttatttacgatcgtcctaaaaatccggaacatgaagaggattgtcatgataatggagatcagctctgcgatcgggaacgcccaccagatcaggttgacattgccgaactgcgccagaaagtaagcaaccggcagcagtgcaaccagctgtcttgcgatcgagacaaacatactgtagactgctttgccgagcgcctggaaaatgctgctgcaggagatgccgaatcctgcaaggataaagcttaagctgataatccggagcgccgggacgccgagagaaagcatggtgtcggaagcgctgaacattttaagcagctgcgttgggaagagctggaagatcagaagtccgaccgccatgatgcagacggcataggtgaccgtgtggcgtaaggtcttgaccacgcgctcgcggctgccggcgccgtagttgtatgccatgaccgggatgacaccgttgttgagaccgaacgcaggcataaacacgaagctctgtaatttaaagtaaacgccgaacactgccgttgccgtggaggagaaactgatcagaatacggttcataccgtaattcatgaccgaaccgatcgcctgcatgacaatggaaggcacgccgatggcatagatctgaccgatgatggtgccgtccgggcgaaagccttttaaactcagctgaatctccttatttctggtctggttgatgacgacagcgagaaccgcagcaatcatctgaccgatgacggtggcggctgcagcaccggtgatgcccattttcggaaaaccaaacagaccaaagatcaggatcggatctaagatgatgttgatgaccgctccagtggtctgggtaatcatggtgtagacggtttttccggttgcctgcagcatacgctcgaacataagctgggtaaagcagccaaaggacaggcagcagcatacagtaagatactgctttccgtagagaacaatttcttcaatatccgtctggctgcggaaaaaaggttccgcgaaaaacagaccgatgataaggaacagcagatagctgagcaataccagaaaaacagcgttttccgcaatcttgttgactttgtcgaaatccctctctccgagtgagcgggcgaggagcgcattgacgccgaccgcagtacctacacctacggcaatcatcagattctggatcgggaaagccatggatacggcagtgagtgcgttttcactgatctgagccacgaaaatactgtccacgatgttatagagagcctgtaccagcatggagatcatgattggcagagacatggatatgatcaatttatcgataggcattgtgcccattttattttcctgcatgggaaacctcctttgttgaatggtataacgttaaaacgacctttctatactaccattttgcggtagcgattacaaggcatggtgcaaggattggggaatcttttgtgaaacggtggcactgtgccgcaatttttggtaaaatagatgagaaaaaaagaacaacaggagattatacagatcatgaatatattattttttctgaccccgaaggaagatgtggcgcatgtagatgaggacgataccatgcgtcaggttctggagaagatggagcatcacggctatacggcaatcccgctgcttagccgcgagggaaaatatatcggaacgatcacggagggcgatttgctctggtttttaaaggaccgcaattttccggatttgaagttgcttgaggatatgccgatcacctccatccagcgccgcagggacaatgaggcagtcaagattgacgagtcgatggaagacctcttcggcaaggtgatgaaccagaacttcgttcccgtcgtggacgacaagcgtgtgtttatcggtattgtgacgagaaaagatattctggcataccttgggaagaaggccgctgcgcaggagaatggcgtgcggggcatggatcaggcatagtgatggtaagccatacggattatgtgacagagctttctgtcagaattatcagcaaataagcgagacagaacaaaagaatttcttaaatttgttatttttttcacaaaacagaatggtaatccgctataatatgaaggagagacaaggcataacatttatacaaaagaaaggggaatttacaaatgaattcaattttatcagcgacagtattgattccactgattgtgatcgtgctgctcatcgtactgctgtgcgtcggatacgtgaaagcaccaccggatatggcgtacattatttccggtgtcaagaagaagtccaaggtggtcatcggaaaagcgagcatccgcattccgttttttgagcgtctggataagctgaacctgcggctgattccgatcgacgtcaagacgagcaatgccgtgccgacagcggattacatcaatatcaatgtcgatgcgaccgtcaacatcaagatcagcaacgatccggagaagctgcggcttgcggcagagaacttcttaaataaaaacaccgagtatattgccggggtggcaagagaggttctcgagggtaatgtgcgtgagatcgtcggtaagatgaagctcgaggagatggtatccgaccgccagaagtttgccaacctggtcaaggaaaatgcggagccggatcttgcggcgatgggactcgacatcatcagctttaatgtccagaatttcgtggacggcaatgaggtcattgaaaatctgggtattgacaacattgtaaagatcaagaagagtgcggcgattgcccgtgccgagagtgagagagacatcaaggttgcacaggcagcggcagacaaagagtccaatgatgcagcggttgcggcgcagacggagatcgcgaagaagcagaatgagcttgccatcaagaagtccgaacttcagatggaggcggacacgaagaaggctatggccgatgcggcttacgagatccagaaagaggagcagcgtaagacgatcgaggtgacaaccgccaacgcggatattgcaaagcaggagcgtgagattgagctgaagcagaaagaggttgcagtcaaggagcagtctctggaggcggagatcaagaaacaggcggaagcggataagtatgcggcgcagcagcgcgcggaagcagaactttaccagcgtcagaaggacgcggaggcgagacagttcgaggcacagcgcgaggcggaggcgagaaaagcgcaggcagaggcagagcgttacgccaaggaacaggaggctgccggtatccgtgcggtcggtgaggcagaggcatctgcgatccaggccaaaggtattgcagaggcggaagcgatggagaagaaagcggaggcgtacgcaaagtacaataaagcggcagtggcagagatgatgatcaaggtacttccggacattgcagccaaagtggcagagccgctcggccagatcgacaagatcacgattatcggcggcggagaaggtggaaacggtgtggatcaggttgccggcaatgtgccggttgtcatggcaaaagtatttgagagcatgaaagaggcgaccggtattgatctggcagacatcatcaacgcagagtcctacgatgcgcaggtgaaccgcaacatcaatgtgtcgggactggattctgtcaatcttgtggtaaaagatgaaaagaaaggcgcagaacagccggatacgcaggacggggcaacgacagagtgatgacggtggaagttggcgtcaaccgcagagcgggaacgggacagtctgttacggcagcagtttttatcgtgatggcggcaggatcgatagcggtgatcccgttgcttgcagcaaaccttgaccatagagcactcgggattgcggcgtgtgttctcacattagttttctgggtcgggtttattggggcaatctgctgcgtgggggagattgtaaatacgccgaccagggcgttccttctcaccagtgactggcagttgtattatgttcattttgcagcccgcgactacggacctgcaccggtgacaaaagctggggagatcgtacataattacaaggtgctctccgaggagaaaaagggacggaaatggcgccgggagtatctgggcagcgaggagttccgcagcatggtacagcagtacctcgagggagtgcggacggatacgatggggtgcgtgatcgagcatcttcagaagccctctatccgttccgaaggcatcgacggaagtgtgctgcgctactgggatgacacccggaaaaagtgggcaacgatccggcttttaagaacaaataccggatatgagaaaatctgccgtacggtaaagctccgccaggagctcggacgctaagaacatctataaaaacgggactgccgcataaagcggacagtcccgtttgacgtgataagtaatataaggaggaagatcatcctatcgatttcagatggaaatgtagatggaacattcgttgaaaaaaatgcgcgcatttcttcctgccggatttttgcatcgaattccgtgtctcttccacgttttgacaatccacggaatgtgtccgacaaaccgcagacaatgagcggattccctagtgtccctagcggcactgcttcacagacaatataaaaccgcgcgaaccgaactcgccgtcatctgctattgaagttaaggcagatgacggctcaaacagcggcttcgcgcggttatgttttattcagcagtgccacaagggacacacgagaatcctaaaattgtctgcgggttgcggacacgcccgtggagtgttcaaaacttggaaaaacacggatcatcggagatgcaaaaaccggctggttagaaatgccacatttttgatccgaatttccagatgcattccatctgaaatcgaaggacatggtcattcttcatactacttaccacatcaaacaggactggctgtttgatgcgacagtcccgttttgtatggaagagaaaagattactgtgtatttttctgcagttcattggcattttcctgaagctgctgcatgatcagggcaatgtcgtccacgctttgcagattggtgcggcagccggcaagggtcgtaccagcgcttgcggtaacttcctgtgtcagggcggatacattttcgatgctctggataatctggctgttggaatcagataccgcatccacaccctgctttaactcggacatgccggaggtaatgcttgcggtatttttctcaatgagatcaaaatatccggcagcggaagtaatgtattcactctggtgcctgttgctgtcgaacagttcagtgacggagtcggtaacggaggaaatggactgcgagatgtgctcaatcaactgattgatatctcccgtagcaccattggtctgaccggcaaggctggaaatctcctcggcgacaacggcaaaaccgcgtccggcttcaccggcgcgtgctgcctcaatgctggcattgagcgctaaaaggcttgtctgggaagcaacactgctgattaaggcaacgatgctctgcattttgtcagcatattccttcagctcttccatagaatccgcgacgcgtgtactggaagcctctgagacctgtacctgctgcacaagattcttcataacatctttgcttgccgtcagattggcagaggtctctgcggtggaggagagaagttcggcagtgacggatgatacgttctgtacctgctggtcaatgttttctgtctgctgttgctgcacctggatggcagcggcggtctcggaagtgccgctggtaagatcctccatggcggtctgcgtgccggcgatggaatctcgaagctgtgaggtgctgtgtgaaacctgatcgatatttcctgccatatctccggcaacctttaaggtcagctgcagaagatcatcggactggctgcggtcagagtcagcctttttgatgttggcatcgttgatctgcgcaatctttgtgacagacatcaatacaaaaatataggaaaggataatgcaggcgattataatctcggcattggtaatctgggcagcggtgaaaccctgtgtaacggcacgaaagaccagaacaaggatattgatcaccagtgcataagtacacagcagggaaacgagctttttatctgcatacaccagaagaatcaacagcattacgattacatagcagaacgtcagatctgttgatgaggtaaacatcacataggcatacagaagggcaaagccgccgccgcagagatagcgcacactagaggtatccttctgctttgtgtaggcaagaatggatgtgacacagggcagcagacagagcagaagaaaaatcagatacgacggaagactgcgcacgccttttaagacttctgcgatgtaggccgccgcaagtaccgtattcattgtgcaggtgccggcaatggctgtcttattgcggctttgtgctgcaactgccggatgggaaagatcggtcaaacgattatccatagaaagaatcctcctttgtaaataccgtattactctaaatgtaaaaaaggcaccggtgcatcttgtgcaccgatgcctttttcctgctattattgtaacagtttggcggatgttcataaagtagatgtaagaggaacaggactattttaccagattttctgcataatccagagcttctacgatatttgcatggaaattttgggctccgacgtactcggtaaagccatctttgaccattacggacatcggctgttcgttgacgtgggagaaaaccagtgtaatctttttcttttttgcacggtcggccagttcgcgcagtgatttcatggcactggcgtcgatggcagggacgctgcgcatgcggatgacaatcacgcgggtagccttgtcactgttgatctgtaagatctggtctgcggcggcgaaaaacagcggaccactgatctcgaagacacggatggtgtgaggaatatcgcgcagtttttccgcttcgcccggggtaacgtccggctcatccagatatttccatgcggtcacatcggcggtttctgccatacgcttcatgaaaagcatggcggcgagcacaacgccgacttcaatcgcgatcacaagatcgaaaaatacggtgagcaggaaagttgccaccagcacaatgacatcgctttttggcgctgttttgcagagacggaaaaaggaagtccagtctgccatgttggcagccacaatcagaagaacagcggcaagcgttgtcatcgggatcaaagcggcaagcggcatgagcaccagaaggataatggttaaggtaatacagtgcacgatgccggcgaccggggtgcggccgccgttgcggacgttggctgcggtacgggcgatcgcaccggttgccgggataccgccgaaaataccggaaaaaatatttccgagtccctgaccgaccagctcggcgttggatttgtgggtatcaccgatcattccgtccgagacgacagcggacagcagggattcgatgcctgccagcagcgcgatggtaaatgccggtgagagcatttcctgcaccagtttcatggacagtgccggaacatgcggtgtcgggaaggaggaagaaagctctccgtagacactgccgattgtattgaccgggagatccgcgaagtagacaacggcggtcgtgacaataatcgcaatcagagatcccggaatcttgtcggtgactttcggccagagcagcatgatgacaatagctgcagcgcccacagcggtggcagtccagttgatggtggaaatatttgtggcgtaggcaatgaccttatccacgaacccggacggcacggatgcgatggagagtccgaagaaatccttgagctggccgacaaacagggtcacagcgataccgcaggtaaaaccggttgtgatggtataaggaatatatttaatgagagaaccaaagtggcagattcccattacgatcagaaaaatgccggcaagaatggttgcgacagtaaggcctgccgtgccataatccgtgacaatgccatagatgatgactacaaaggctgccgtaggaccaccgatctgcacacggctgccgccgaaaaacgagataaaaaatccagcgatgatggcagtatagagcccctgctccggcccgacgccggatgcgatgacaagcgcgatcgacagtggcagggcaatgatggcaacgatgataccggagatcacgtcgcgcatggcctgttctttgctgtagtcctttaagacgtcaaatagttttggtttcaattcattcattttcatttcctcagtctgtaattattaaatttttataaacacaagtcaaaattttagcactttacaaacgcgaacgcaagaacgcacgggaaaaaatacaagcacatggaaaggtgagcaaaactgggaaaaatggaagacattttacaggaaaaagaagatgtgaaaagccggattgtatgttaagatagatgataataaatgatataggaagaaaggcggcaatcatggcggagtcgggcaattcttatcagaagatctatgaaatcgtaaagcagattccaaagggatgtgtggcatcttacggacaggtggcggcgcttgcagggaatcccagatgggcaagagtggttggctacgcgcttcacgtgaacccggatccagcgcatattccctgttaccgtgtggtgaaccgggaaggcagactctcggatgcctttgcatttggcggtgtgaatgagcagaagctgctgctggaggcagagggcgtcgaagtaactgacggctatgtggatatggaactgtatcagtggaagaagttccggatttaagagagacggaggagaaatatgcaaaaaaaggaactggcacttcaggtgatagagcgtttgaaaaaggagtatccggacacgggatgttcactggattatgacgatgcatggaagcttctggtcagtgtgagactggcggcacagtgtacggatgcgagagtcaatgtggtcgtgcaggatctgtaccgggaattcccggatgtggatgcacttgcggatgcagatgtggaggagattgagcgtattgtaaaaccgtgcgggctgggacatagcaaggcgcgcgacatctccgcctgcatgaagatgctgaaggaaaagtaccagggaaaagtaccggaagattttgatgcgctgttagaacttccgggagtcggcagaaaaagcgccaatctggtgatgggggacgtctttggacagccggcaatcgtcactgatacgcactgtatccgcctggcgaaccgcattgggctcgtggacgggatcagggaaccaaagaaagtggagatggcactctggaagctgattccgccggaggagagcaatgatttctgccacaggctcgtggatcacgggcgtgcagtctgtaccgcgcggacagcgccatactgcgaccgctgctgtctcaatgacatctgcaaaaaggccggaatttagaaaaagataaaataaatcaatatatttgattaaaaacgcaccttgcggaagcataaggggtatgatagtatatacgaaatgaataacagaaatcaactttcttgaattattttgtatggaggaaagacatgaatattgcagcaaaatacggaaaatcatactttatgccgccggaggtgacatatgactgggtgaagaaggacagcattgagaagccgcccatctggtgcagcgtggatctgcgggatggtaatcaggcgctgattgagccgatgggactggaggaaaagcttgaatttttccggatgctggtcgacatcggatttaaggagatcgaggtcggttttccggcagcttcggacacggaatacaactttatgcgcgcgttaatcgagcgcgacatgatcccgaaggatgtgacggtgcaggttttaactcaggcgagagaacatattataaggaagacatttgaggcggtcaagggagcgcctcacgccgtcatccatctgtacaattccacatcggtggcacagcgggagcaggtgtttaagaagagcaaggaagaagtcaggcagctggcagtggacggggcagaattgttaaagacactcgcggcggagacggacggcaattttacgtttgagtacagtccggaaagcttcccgggcacagaggtggactatgcggttgaggtctgcaatgcagtgctcgatgtctggaagccggatgcagagcacaaggcgatcatcaacattccgaccacggtacagattgcgatgccgcatgtatttgcctgccagatcgagtatattcacaagcatttgaaatacagggataatgtggtgttgagcgttcacccgcacaatgacagaggatgcggtatcagcgatgcggagttcggtattcttgccggtgcggaccgcgtggagggcactcttttcggaaacggagagcgcaccggaaacgttgatattgtgacgctggcgatgaatatggtgtgccacggtgtcgatccgaagcttgatttttccaatatcagcgagatccgcgagaaatacgagcgctttaccggtatgcgggtttacgagcgtacaccgtatgccggagatctggtatttaccgcattttccggttcccatcaggatgccatctccaagggtatggcgtggagagaagcgggcaagagcggcgaccgctgggatgtgccgtacctgccgctggatccgaaggatgtcggaagggaatacgagtcggatgtcatccgcatcaacagccagtccggcaagggcggagtcgcattcgtattaaagcagaacttcggtatggatctgccggataagatgaaggaagaagtcggttatctggtcaagggtgtatcggatcgcagacatcaggaactctcgccggaagcaatttaccggatttttgaagaacattatgtcaacctgtgcgatgtttttcagatttcagagtgtcatttcgagcagaaggacggcatcacatcacgcctggtgatcgagcacaacaaggagcgccgcacgattgagacgacaggaaacggccgcctggacgccgtgagcaacgcaatcaagatgtatttcggcatcagctacgagcttgccgtatacgaggagcacgccatttcagaaggatcatcatccaaggctgcggcgtatgtggagatcatctgcaagggcaagaattactggggcgtcggaattgacgaagatatcatcaccagctcgatcgcggcattggtatccgctgccaacaagatgttaaagagtgagaacattgtggagggacgcgaggagcggatcgtcgacatcatgaattacatacagaatcactatgcggatgtgacgctggatgtgctggcagatcagtttaatctctccaaaccgtacctttccaaatacattaaggaaaagtctgggatgaccttccaggatgcggtaaagaaagcacgcatgaaaaaagcacgcactatgttaaaggagacgaaccagacggtagagtcgattgccgcctacgtgggttacgagaatgtggagcattttaaccggctgttcaaaaaagcgtatgagatgacgccggtgcagtttcgcagaaaatatcagtaattctcaaagaatagaatgacaactgggaacagggaaaaagtattgtggtactttttccctgcttttttactgacagacagaaacaataatggtataataggagaatcttaggtaaggagggtgcatgatggaatggtttaaacagcttggaatctacctgtttcctatagtgatgctccttaccatcggaatgaataactggaagcgggaggaacggacgcagggggacagggtctttgggtttcttccgtttctgattatctgcatgatgggcagcgatgtggcgtaccatgcactgcagctttatgtacatcggtttacggtgctgtatgccgggtatctggtgtactgcttctttttgacagcagtaccgcatgcctggcttttgtatgtgaacggaaagctttctgcgcggcataaccggcggtggacggctgcggtatgccatgttatgacgggaaccgctattgctgtggtgctgcttacggtgatcattccctggagactgagcacggaaggatggggcgtgcatgcggtgtcctacagcttaaatcacggcagtctgccggcaaagatggtaagtattgcgatgtatctgatgggacttattctgacagcgacggcgtatccgaaggaggttaccaaggaagggcagaaagagacgcgctatctgcttgaggcaggcgtgttcagccttgtgggcgggatggtgcagagctttgcggagagctggcgcacgggaggaccttttgtggcactggcagtactgtttatttatctgaatgcgcagaaccggcagatcacgacagacgggttgaccggactgaataaccgcagggagtttgacgcacatctgcagcggaagatcgaattgtgcccggagcacgagtggggacttctgatgattgatgtggatgatttcaagcggatcaacgatgaactgggacatgcggtgggcgatgaggcgctctggcatacagcggatattctgcggggggtgttcggcaaagatccggtatttctcgcacgctatggaggggatgagtttgcggtgctcggagactggtttgggcaggaacagattgaggaagcgatcgcgcggatccaggaaggtatcgaccggtttaacaaagagggacagcttccgctgcagctgtccatgagtatcggctacgcgttctggcatgaagccggaaggcgcggggagaacctgatacagcaggcggatgagcggatgtatgaggagaaacagaaaaagaaacgtatgcgcgcatagagcgcggtgcatggggaggcggactgcgtgagtacggcagcatttttacagatcaatttcataccggcgattgcgctgctcatgatgcgccataataccaggcagacgctgtctttttcgtggaggacacgcgtgctgcgcacggaaatgctgctgtttgtactgcttttactgtgccgcacagcgattttgtgcaatctcggaaaaggcggatttggtccaaggattttgttaaaggggctgggggtgtggtatgcgttcggccttctggcatgcgcctacctgtgctttttgtatgtgctggatgtggcgcaggacggaaacggacagagagggataaaatgctggattctggcgataccggcactgatcggcagcgctgtgctgctctcaaacccgtggacgaaggcggtctattttatcaatatggtgaattactataaaaagggacctgcggcatatctgatacctgccgtgggcatgttataccttgtggtggcattccttcttgctgcgtttggtgcgcgccgtgccggaagtgcgcagcgcaggggagaactggggaagcttgccgccgcttttttgttccctgctgcgggcattctggtagaaaaaatattttccatggatgccgcgtgggcgtttacggttgctgcattgctgtgggtgtatcttggtattcagaaaggtcaggtaacgcaggatggtctgaccggtctcaacaacagacgcagactggatcagtacatgtgggaacttgacgagcgcagcggagagcgggagacctgctgctatctgctgatggatgtgaacaagttcaagaaagtaaacgatacctacggtcacgtgaccggcgacgaggtgctcaggctggtggcggagcagttaaagcgcacctttggcaatatgcaggcgtttctggcacgctacggcggggatgaattcgttgtgattgtaaaaggtaagacgcaggacgagatggacgtgatcattcatcagacacaggagaatgtaaatgcaattgcctggggagcggataccccgtggcagctgtcgatcagtatcggctgcgcgatgcggggagagcaggggaagcaaaaaagccatgaactgctggcgcttgcggatgagcgcatgtaccgccagaaaaaaggtatacaggacagataatccgggcatactctcttcatacgttccgatgggagcagaagacggagggttagtgcaatgaaggatggagaagtgagagactttggcaggcgggataagattggctacatgttcggtgactttggcaacgattttacctttatttttgccagctcgtttctgatggtattctataccaaggtgctcggtatcagcggcggaatggtggggacactgtttctggtcgcacgatttgtggatgcattcacggatgtgacgatgggacgcatcgtcgacgcagcgccgccggcgcgggatggaaagttccgctgctggatccgcaggatgtgcggaccggtggcgttgtcgagttttttgatgtaccagactgccatggcgcaggcatctatgccgtggaagattgtctacatgtatgttacttatcttttgtggggaagtattttttatacatcgatcaacattccgtatggttcgatggcatctgcgatcacgacggaggcatcggagcggacggcgttatctacctcccggtcgattggggcgacactggcggggcttgtgatcggcatcgtgacgccgctttttctgtacacgaccgatgcagacggcaatcaggtcgtgcgcggcggcggaacatttacggtggttgcgggcattttctcgattctcgcgttactctgctatctggtctgttaccgcatgactacggaacgggtggcggtggagcgtgacgtggacgcggaatctgtgagttttgcgacaacgctcggtgcgattgcgaggagccgtgcgcttctcggaatgattggagccgcggtatttctgctgctctcccagctgttaatcagcacgatgaacaattatatttatccggattacttcggggatgcccgcggcatctcgctgttcacgctgctgtccacactggtgattctgctggtggcagcaccgctcggtgtgcctgtttccagacgatttgggaaaaaggaggcgtccgtggcggggatgttgttctctggtgttgtatttgcagtcatgtatgtgctgaaattacagaatatgtggctgtttctgtggcttggggcaatcggatatctcgggcttggtttttttaatacagtgatctgggcgaatatcacggatgtcatcgatgatcaggaagtgcagaccgggcaccgggatgacggaaccgtctatgcggtatattcgtttgccagaaaggtcggacaggcgctggcaggaggcatcggaggatgggcgctgcaggtgatcgggtatgagccggctgcggcggcgcagacggatgccgtgcggcgtggattgtacaccacagcaacgctggtgcctgcgatcggattttttgttgtggcagcgattctgtggtttgtgtacccgctggataagcggcgcgtggagaaaaacgtggaggaactcaagaaaaaacatctgcccgctgagcactgactggtgcggcgggcagatgttttttctctgccggggattactcgatttcgatgacgctcaccgggcagccatcagcggcttcctgcgtggcatcttcctgttccggcgtcggctgatgatagacctccgatacattttcatcgttcatccggaagacctccggacatacactggcacacagcccgcagctgatacagccttcgatcacatttgctttcatagggcatcctttctgtgaacctcccgggggaggtgaatgatggttacctgtttagggttgccggtgtaaacgcgtcatatacgaaaaagccgctaagaaaccgctaagaaattaagaaaaagatgattttacaaatacaagtttgatataaaaagaatatatgttacaataattagtaaatacggaaaggatggtgggagaaatggcgaacagcaaaagacataagttggtatgctgtctgatggcgatggctctcctgctgtcttttttttatgtggtaccggatccggcgggcagggcggagcgtggaaatgctgcagcctgcgtggcagacgggcaggctgctctgacgggagagatgaggcacgaaggttcctggcagaatatgatgtctgcgcagacgctgctggagacaagggacgcaaagccggatgcctgcacagatacgttcacgatgattcattccgtgctggatgaagtcgtcatgcgggagcaggcgggcatgcgcagcctgctgtccaaactgctggcggtggttgtgtgggtgatgcttctggtatgcgttgtctgccggattctaagccgccgttacggatgccgcatgatttaccattgggagaatatctattatatacaccagacagatggaaagaaaggagattgccttctgaattacttacatatatagaaaaacgtaatgacaggaggcagtttcagtgaactataaaaaccaaataagcgacagagtaaagattttgctgattgatgaggatgaaagtattttttatctgatccgcagggtgctgcagcgggagaactataggctttatacttccaccagcggacgctccggcatggagatgagcaccagtatctgcccggatctgattctgatggatacccagctttccgatatggatgggattggtctgatccagtggttcagagagtggacggattgtccgattctcgttgtatccggacagacgggatatatggataaagtcaacgccctgtatgcgggagcggacgactacattgtcaagccgtttcatgagcaggagcttgcggcgagaatttacactgcgctgcgcagaaggattccgggaggacagggaagcttttatcaggcaggagatctgaagattgatttttcaagacggcaggtaagccttgccggggaggagattcatttttcgccagtggaataccggattctggagtgtcttgccctcaattcgggaactgtggtgacgtatcagatgttgttagagaagatatggggaccgtatgcaagcagcggcagccgtattctgcgggtcaatatgacaaatatccgcaagaagatagagaagatcccgatggatccgacgtacattaccacgatcccgcgtgtgggctaccgcatgcttgagagtcagacggcatcggttgtctgagctgaggttgaagcggaagctttggatgatgaagtgcctttgccttcaaaataggaatcatagattccgtagataaaacctccgataatgataagaataccgatcacagaaaaaatgtgttcaaagattgtcatataaaatccccctttggttttagttgtcatcaagtataacagccaggaaaacggagggggattttgccgcttttttttaattttttcatagtgtaccaggaagagacttaacacttttttagcatcgggagccgtgcagaggcaatattgtatgttttttgaacaaaatggctatattaaataaagcactttttcgtagaaatatatggcaatatttgtgttttttgctataataagggtaatatgttaagaaacagggagaaggttatcaatatgaaaaaggggaagaagcaggcaaagcgaagaaacgcgaatgttacgatggcatttggaatccgggagaagatcgtgctgtgttttcttgtgccggttctgtttatgattgtgcttggaattatttcctaccgcaaggcggcggacggaatgagcagttcctatcgcgattccacgcagcagacgatcgagatggcgttgcagaatatcgatacgagcaactcgttcatcagtgcagaggcattaaaatacgtggtggattcggatcttggaaagtattttgtggggatttacgacaatgatccgacgtccaagcggacgttgattgaccaggtgaagacaagaattcttgcttcccaggttggcaactcctatatcagcaacatctatattattccttccggcgatctgcagatgatctcgacgaagaacaaggcgcagaagggcatttaccaggagtacatggatgagatggcggttgatggcaagctgggacagtgggatgaccatcacaatgcgctggatgagtatctgagcatcgactcgtccagatacattatggtatatcaggcaaccgcgcagaacggtaaggcggttatcgtaatcgacatcaaggcggaggcagtcacagagttcatgcagggactgaatctgggagacggaagcattgtgggattcgtgacggcaggcggcagagagcttgcagtgaagcgcaatgcgggagacgaacagggaacgccggtcgagggagagacgatttttgcagacaaggatttttatctgcaggcgagtgagacggacggcgtaagacaggtgcagtacaacggaacagattatctgtttttccacagcaagagtgaggataccggggcaacgatgtgtgcgctggtgccgttgaaggtcattaccggacaggcagagtccattaagcagatcacgatagcgggagttctgatctccagtatcattgcacttttgatcggaactgcagtgacaagcggaatccgcaagaatatgaagcgtatttccggaagccttgaggttgtggcggaaggtaatctggcaacgaccgtgtccgtgaagggacgcgacgagttccgcggacttgctgctgcggcaaatgacatgatcgcacacaacaagcagctggtgcagaaggtcagtcaggcgacggataagctggcggcatctgccggtgaagtgacgaatgcatccggtattatccaggaatattcgcaggacatagcaaacgcgatcggtgagatcaacgagggcatggagcggcagtccacacatgcgcaggagtgcgtgagcaagacgggaacgctttccgaggagattcaggaagtcaaccgtgtggcgcgcgaggtagagacgcttgtgtctgaggcggaggagatgatccgcaaaggtatggaccggatcgaacagctgggacagcgcgcgaatgagacgacagctgtgactgcgaaggtggaagaaagcatcgaagacttgaagcgcgaatcggagacgatcaatcagtttgtttctgtcattacagatatttcggagcagacgaacctgttatcgctcaatgcatcgattgaggcggcaagagccggagaggcaggacgcggatttgcggttgtagccgaggagatccgtaagcttgcagacaattcggcggaggctgccggagagatccgcaataatgtggagaatatcagtgcgcagaccggcgtgagcgtcgagagcgcaaagcaggcgggcgagatggttgcacagcagaccgaagcagtgcgtgaggttatcggtgtattccaggatatgagcgacgccatggataagctgtttgacggattaaaggagattcttgccggaacggagcgtgccgataaggagcgcgaggatacgcttgaggcagtacataatatttcttctatcattgaagagacggcagcaagcgctgaagtggtgaagaaggttgcagcaagtctggagcagaatgtagagaacttaaacggcacggcggagagcctgggaggtaatatgacaggtcttaagaccgagatcgccgtatttaagacagaataggcgaagaacatttagagaatataatagaagataaaaaagcggcagccagtcgatcatgagatcggttggctgccgctttctgaccgcaaaatgcattttatgaagcaaacgcacttcgcaggggttacactgcgtcagaacgcgcaatcagcggttcaggcaggaaagattaagcagaaactgccggtgcagcaattctctggagagtgctgcagactgaaaggagtcaagcgcaagctgatagacattcgcatactgtacatagtgccagtgaagttccgtctgccagttgtcgagtgtgatcaggcggtcttcatccagatgaaaatcaaacagatggctgcgcagctcgtaaagggcggcatagcggaacaggttggcgagcatatggcatgccttatctgtgtcagctatggcaggcagacgcacgatgccatagcgcttaagccctgcaaaccgggagccggttccggaaaggttctgggcgatctcggtctcgagaagtgtgccaaaatcggtgttgtagtagtttaaggtggcagcgaccagggtatccgtcaactggacaaaggacggatggtgcagacagtcatgctgctcaaaatactcgtccataaagtcatagagaacaaaagactcgcagctgaagtgatattccggacggtatgcatttaaaaactgcggcagcaaagcagccagtgcgtccgtgtgatgcatcaggcacaggcagagtgctgcgtagaagttccggcagtccacgagcagggcatccagcggcagatttccgtctgcgtaaggcaggctggcagcctctggcgcatgatcttctatcagagagtcgataaccggtgtggtggtgccgaaaggaacccctgcagtcagcacaatggcggcatacagataaaacggttcaaagccgtccgttgcgatggaaggcgagaaatagtcgtctgcagagagataatcctccagtatctcaaagctgtcctcggccgacgggcaggaaacctgatctgcgaggaattgtgcgagatccggatgctcttctgacacgcaggatagaaaacgaaagagcgagtaggtgagaacacgctgtctgccggcaggctccttcgtgtagtttacaagaaatgcggggggaaataattgatcgttataagtttccatgaagaactccttttccaaaagtaatccgtatgtgtgtgcggacggatgcccgcagcgcataccgacatcatagcacattttagaattagatgccatcatgcgttttcattttccgtcaggtgtgttacaataacaagcagacatagaaagcagacagagggaaaaagatgccaaaacagaatcaaccaaaggaagagaaaagagaaaaggggacagcacaagcggtcatccgtgagattttaagctgggtgataccgtttgtgatcgcgcttgccgttgcgatgtttttgaaaaattatattatcatcaatgccgatgtgccgaccgggtcgatggagaacaccatcatgccgggggatcgtctgatcggaaaccgtctggcataccggagcaagtcgccggagcgcggtgatattgtcattttccgttatccggacaacgaggaagaactgtatgtgaagcgtgtgatcgggcttccgggcgagaccgtggatatccgggacggatacatttatattgacggagcggatacgccgctggacgaggattatctcaaagaggactggacggtggcgacggggaattatcattttgaggtgccggaagactcttatctgatgctgggggataatcggaacgattcgtgggacgcacgatactggacgaatccgtatgtgagagaggataagattctgggcaaggcggcagtgatctactggccggtgcatgatattggaaagcttgagtaggggagaagcgatcgagggggtagttttatggttacattattggcgaagatattcattcaggagaagaacgatcaggcgaagattcgtgaagaatatggtgtgctgtgcggtgtggtaggtattctgttcaatgtactgctctttgcgggaaaatttcttgcgggcaccatcagccattccattgccattacggcagatgcggtcaacaacctgtcggatgcaggctcttcgatcgtgacgctggcaggcttcaagctggcaggcacaaagccggatccggagcatccgttcggacatggcaggatcgagtatatctcggggctggtggtggcagcagcgattcttctgatggcgtatgaattgatccgggattcggtgggcaaaatcgtacatccggaggagacagagttctccgggctgattgttgtgattctggtgttgtcgattctggtgaagctgtatatgtatttttacaatcacacgatcgggaaaaagcttgattctgcggcaatgcaggcaacagccatcgacagcctgagtgacacctgtgcgacaatggcagttcttgcggcaacattgatcggacattttaccggacttcacatcgacggatggtgcggtgtgctggttggcgtattcatcctgtatgcggggatcagcgcggcgaaggagacactcaatccgctgttgggacagccgccggcagaggattttgtcatgcagatcgaccggattgtcatgtcgcatccggagatctgcgggatccatgatctgatcgtgcacgattacggcccggggcgcaagatggtgacgctgcatgcggaagtgccggcagacggcgatattctggaagtacatgatgtgattgacaacgtagagaatgaactgcgggagaagctggggtgtgaggcgacgatacatatggacccgattgtgacctccgatgagcacgtcagtgaactgaaagccgctgtcgtatcgatcacaaagggaatagatgatgtgattacgatccatgattttagggtagtcagcggtccgacccattccaacctgatcttcgatgtgctggtgccgttccagttcaagatgagcgatgaggagctggttgcggcgatctgcggaagagtcacggaatgcctgggggataattactacccgaagattaaggttgaccatgcctatgtaaaataaaacgaagaagattgcggatgtaaaggaattgccgcaataagcagagtcctctttggagtgataagtaatattacaggaagcgcatgatgcagatttcgggtggaactgcatatgaaacattcgttggagaaaaatgtgtgtatttcttccagccggatgactgcatctgattccgtgtctcttccacgtttggactctcccggagtgtgtccgacaagccacagacaatgagcggactttctagtgtccctaatggcaccgcttcacagacaatataaaaccgcgcgaaccgaaacttgttggcatctgctattgaaaatagggcagatgccaattcagacatcggcttcgcgcggttatgttttgttcgacataaaggtggcatttatgccagctgttgtctggtgccaataagggacacacaaaagtcctaaaattgtctgttggcttgcggacacagtccgtagagtgctccaaacttggaaagacacggatcatcgcagatgcagtcaccggctggttagaaatgccgcattttttgaacagaatgttccataggcattccacccgaaatcgcaggggcatgcttctcataatattagttatcagagtaaagaacggtatgtttattgcggcagttccttttagcatctagttgttggaatctgatgcagcttcggaagtaaccgctgagctgtcggttttggaggttgtttcggagctgcctgtctcagagccttctgtttcggtgttcttcatctcggaactttctgtctcagagttcttcgtctcagagctttctgtctcggtatttttcatctcggtagcggtcgtatccggaatctcggtcggatcttctgtctccggaacaatatccggatcctcgtagacaacctcgccggtaccggcacggagcagtaggctcttggaaccgaggatattcacggtaatggtatcgccgttctgcacattgtccagactggtcgtaatcaggttcgatgtcaggaacgtggtaggaaccttattgccgtttacaaaaatcttcgtattcttggtaaagttcgcaccgtacaccgtcaaggtattgttgcttgtattcttgcggacagaggagacggtaacgtcctccacatccatcacaaggtcggatgcagggtagaggtcctctccgccgtaggtgtagcgtttgccgtacagcagatcgtactgcagatcctccagaccggaaagataggtctcggaagcggtctgtgtctgatgataacggaacatggttccctcatgaatgcctgcctgatcggtaatgtgcgcgagaagctggtaagcggtcagatcagcatctttttttgcaagccccatgttgttccaggtgatgtacttggtcttgaaaatatcaccggacttcatatccgcatcggtgagtcccatcgttggaagatgatcgccgaagaacacgatgatggtgtcctctccgcggcggtcaaccgctgtgatcagatctccgatgaagtcatccacttcatgaatcatgttgacataatattcccactggttgttggaagcctcatctgcggcgccggaaacaagaatatccggattttccagaagcttctcggtcgggtaatcgccgtgaccttccacggtaatggtatatacgaaatcggactggttttccgtcgcgttcatagcttttacagtctcctgtaccagcacatcatcagtcggccagttgccattcggcgtgtactgggagatgttcatgcactccttgctggtaaaggtatcgaatcccatcatggaaaaagcattgttgcggctgtagaaagtagcggtattgttatgtacgacatgcgtaccataaccgatctgggagagatcatcggcaatactttcgcagtccgtctgttttaagatcgtcttgtaaggatactcaccggtaccgaaatactgcatgctcattccggtcagaacctcgaactccgtattggcggtacctgcacccacgaccggtacggtaaggtaaccggtggaatagtttgcctcaaggttgtggaaattcggaatcggatcttcggacatatttaaaaagtttacttcgtaaggatcacagaaggactccagtaaaacacagataacatttggctcgctgcctgtggaaacagtggtcgggctgctggcggaatcaacaagggtgttgatcgcatcaacggtttcctcggaataatcctccggtttatccatgcctcttccgacaacactggtggaaaaaccgtacacaaaaccgtaatcagagtagccctgcgcaatatttgcaaaataggaagcaagaatgttggaactctgtgctgcctgtgtggtaatcggaagaccgattaaaatcagagcggcaatggagaccggaccaagcacggtatggcgcgttccctgataacggggtccctttgcaaagagaagaccaagaatgacaaagaaggcaaccacaacggacacgaccatggttgcttcctccgctgtaaaatagttggtgttctgcattgcgaacagatccggcagacattttaagtctgtgtagctgaacggtgtgacacggtttgacagaatcagaccgttgacggttccaaggaaaatccacaaaccgctgattaagatacgcatctgtgtacgatattttgtcagatagacaagggatagagatgcaaagataatcagcgcattatataagaatgcaagcgtgtgattgctgatgaaagttatagcgctcacaaagtcccgtctggaaatcgtctccacggcaagaattaacagacaggctaataaaaagtggaaaataagagaatacttattaaggaaagcaatccgtttatagtatttttcactgtgtggcttcttctgcggaagaatgctcttcagagattgaagcttactggaaagcggtgcaagcttttcttttagaatgttaaataattttttcatagaaccctcccaaaatgactgtaggcggtgtgaaacaccgatacgctcacgcgtgcaatatatgtgggcagccgggctgccgattctccagtgtaaaactcctgtaaaaaggaagtaaagctaaatttcgatactaagagaatatagcgctaattgcatcaaaaatcaatcgggaagatgaataaaaaaggtttaagatttcctggatttctataaaatatgaataaaaaatgaacaaactatgtccaaatgaaaaatgtatcactttacaaacttgtcgatcgcatcatttaagtcccggatgacctgctcatccccggtttcaacggcgtcgaccaggcagtggctgatgtgatcctctaaaatgattttaccgatattgttgatggcggaacgcaccgccgcaatctgaacaagcacttcgctgcagtccctgtcgtcttcgatcatcgtgcggacggcctccatatgtccgatcgcacggttcatgcggtttaagaccgccttggtattctcgtggtgatgcggatgtgtgtgagtggagctgtgggcatgagtatgaacggagccgctggcatgagtatgaacggtgtcgtcagcatgcgtgtgagtggagccgtcggcgtgtgcatgggtgatgccgtcaacgtgcgtatgagtgatgccgtcggcgtgtatatgtgtatttgctgtggaagtcttctgtgttttcatgggattcctccgattcgttgcatttcattcagtgtatcatattctcccgaaaaaaaacaggttgtcttttttgtacaatgcttatataataaggaaagaatttggcagacaagggggtatatcggggatataccccttattttacgcgaaaagcgcaaaggaaggaatagaaaaaggatgaatttactcgacatcataggacctgtgatggtaggaccgtcaagttcacatacagcgggagctgtgaagatcggcagagtcagcagaaagcttttagcggaggaggttgcggacgcaaaaatatattttcatggctcttttctggcaacgggcaagggacacggtacggataaggcgatcctggcaggactgctcgggatgcaggtggatgatccgagaatcccggagagctttacgatggcaaaggagtctgggatgagttttacactggagggaattgatcttggagatgtacatcccaactcggtcaagatgaatctgaccggaaaatccggccgtacgctggaagtcattgcggcgtcggtaggaggcggacagatccggatctgcgagctggacgggctgacagcgaatttcagcggggattatccgaccctgatcgtgcacaacatcgaccagccagggcatgtggctgaggtgacttcgatgctggcgcacaagtcggtaaatattgctacgatgcagctttaccgcgagagccggggcaccagggcggtcatggtcatcgagtgcgacagagaggtgccgggagaggcaatcgagtggctggagcatctggagggaattttaaaggttacctacttaagcatgctggaagcatagatacatcagatgggcagaaagatgcagcgtatgtgacgggaaggcggtgtgaaccgtctggatgatagaaaaacagagggaggatgacaatgtaccgatcattggaggaactgtgccggatggagagagagaccgggaagcctttttggaaaattgtgcaggaggatgactgcgtggagcagggcatcagcgcagaggagtcgtttgcacagatgcgcgggatgtaccaggcaatgcagtatgcagatgcacattacgatgagacgttaaagtcagcaagtggactggtcggaacagagggaaccaggatgaagcgggcgcgggaggcgggaacgctgctctgcggagactttatcggaaaagtgatggaaaaagcgctgaagaccagcgagtccaatgcctgcatgaagcggatcgtggcggcaccgaccgcaggctcctgcggtgtggtaccggcagtgtttttgagtgtgcaggaggagcgcggtttttctgaggagtgtatggtggaagccctgtatgtggcagccggaatcggcggcgtgattgcaaaccgggcgtttttggcaggcgcggcaggcggctgccaggcggagatcggttcggcttccgcgatggcggcaggcggtgtggcgtatcttctgggcggcggtgcggatgagattgccaatgcagcggcgctggcgcttaagaacctgcttggactggcatgcgatccggtggcgggactcgtggaagttccgtgtgtgaagcgcaatgtcatgggagccgtgaatgccatgacttctgcagatatgacgatggcggggatcttcagtaagattccgccggatgaagtgattgacgcgatgcgcagtatcgggcgcagcatgaatgaggatatccgtgagaccggaaaaggagggcttgcggggacaccgaccggagtagagatccgcgaccggatggctggaaccctgtagacaaccggttagtgccggaggacggctgacagatgggaagtggaatggtaacaggattgacaggatctgaaggggaagaatcatcctgttccagaatggaagcaggcgtggagaatcgttggagcaaaatacgtgaatttcttgcatgccgcttttgacattatattccgtgtctttgccacgtttggacaatccacaggaggtgtccggcaaaccgcagacaatgggcggactttctggtgtccctaagggcaccgcttcacagacaatataaaaccgcgcgaatcgaaactcgttggcatctgctattgaaaataaggcagatgccaattcaaacatcggcttcgcgcggttatgttctgttcagcggtgcccataagggacacacacaaaagtcctaaaattgtctgcaggttgcgaacaccttctgcggagtgttccaaacttggaaagacatggatcatcgaagatgtcaaaagcggcatgcttagaaattccgtatttggcgattggattctccacgcctgctttcatctggaacatggctgttcttctggcctcagatagtgaaactatatgcaacattccacgtcccgtccgtcagtcgtcctccggtactagcggttgcttcttctccagatgtgcatctgctccgcctctttgatgaggtcgtcgcggaaatcgggatgcgcgatcgagatcagagcctcggctctctgccaggtagacagaccctttaagttcaccttgccgtattcggttacaacatagtgtgtattcggtcttgcgtcggtaacgatggaaccgtttgccagcgtcgggcggatacgggactgcacctgaccgtccttggtcttgaaggtagaggataagcagataaagctcttgccgcccttggacagataagctccgagcacgaagtcaagctgtccgcctgcaccgctgatctgcttgatgcctgcagactctgcatttacctgaccatagagatcaatatccacggcattgttgatggaaataaagttatccagtgcggagatcgagcggatgtcgttcgtgtagtcgaccggagcgctcatcagttccgggttgtcgtccagataatcgtacattttcttggtgccggcgccgaaagcgtaggtctggcggtaacggtcgatattctttttggaaccgttgatcttacctgcctttgcaatatcgacaaatgcatccacgtacatctcagtgtgaacgccgagatccttcaagtcggactctgcaatcagggaaccgacagcgtttggcatgccgccgataccgagctgtaagcaggcaccgtctggaatctcatcgacgatcagctttgcgacagccttatccacatccgtagcaggaccgcctgcacccagttcgccgattggcgggttggagccttccacaatgtaggtaacatcggaaatatggatgccgcactcggtgccgccgaggcagcgtggcatattttcattgacttctacgatgatgtgctttgcgcgctcgcacattgcacccagatgtgaggcactcggaccgaagttaaagtagccgtgcgcatccattggggcgacctggaacatggcaacgtcatccgggcagtcaagctcgcggtagtagcgcggcagctcggagtagcggatcggacagtagtaagccacgcctctgtttatcatcttgcgctcgataccggacatatgccaggagttccagcagaaatgctcacctgcatcctcacgtgcaaaaacagccagcggcttcatcaggataccgccgcgcagcttgacgtctgtcagttcgtcggtgcgctttgcgagagcctgatccagtgcgtcaacggtgttggtgcaccagccgtaatctacccagtctccggatttgatgagctttaccgcctcatctgcggagacaagcttctgtttgtattcttcacgaaaatccatctcaaatacctcccacacaaaagattgttaaaattttaccatagtttcatcctatcactttatgttgtattttacaagccctgccggagcgtatttccggagatttgtaagatcaggtctcctccggcatccgccagtctctggaagcctcccggtatttgtcgagcatcatttcatactggatggtaagcgctgtgtcggaaggaattttggcttcctccccggcgaggagcgtctcgtaacattcgacgagaccgagcagcggaagatccccgcttgtgtgaacgtccaggatgctttccgtctcgtaggcggcattgtagaaccagagaaccgcttccgcgtagtcgcgctgtcccacaaaataggttcccagttcgtagcagatttctgcgcacggtgtggtgagcatgtccttcatggtcagcttgaaaaattcgttcttgttatcctccatgcggtaaatccgggctaggacgcaggcagcttcctttcgggcatcatctgccgggtcattgtcgaaaatgagctggaagatcggttttgcatcagtaaaatcctttttgtcgcccgtttttaaaagctctttggcatacatggtgcggatttttggggaaaattgcccgtcgtgttcaaacgctttgatgaagatggaaaaatcgcgcttgctgtgcagggactgcggacagtgcagaatctccacatcgctgtcaaaagtgaccggcgttaagcggacggtctcgtgaatcggatcgatccaggtaaacgtgcgcagtctgcggaacagctttggccggtattccttttttgcattcaaaacggtatcgaacgtgccctgcgtcacatacttcatctgtacaatctcgatctcaggcagaagggcatctttaagacggagaaaacgctcgcggtttgcgtcgtcgagaatttcatcggcgtcggcggtgtagatatattccatcgttgctttggaaaaggaaaaattgcgtgcggcggaaaagtcgctggtccatttgaaatcgtagatccgcgaggtgtactgtgcggcaatttctttcgtgttgtcggtggagccggtgtctacaatgatgatctcgtccatgagatcggcgatgctatccagacagcgcgccagcactgcggactcattttttacaatcatacataaactgatagttgccatagtttctcctttgtgggaggcagtgatatgccgctgccccgtgcgtgataacttctatcctaagtataacgcagcgggggatggcaggcaaacaggaaaataaattgtcgtggcaagatggaaggttctgtgctaaaatgagcggtggttatgtctgcagggcggacggaaggacagatggaaacggagtatacagataaatgagacaacaatttatgcagaagacgatcgtcgtgtggcagcccgggaaatgttgcagtcttagggtttatgaatccggtgtgcggtgtgatcctgtccgcggttctgcccggtgagacggacagcttaagcgtgatgtcggtggctgcgctggtgctggtatgcatgggaatttacattgtaaaccgccccaaaaaggcggaatagaaaaaggaggaacctatgagcgcgattgttacattgaaaaagggtgagggaagaaccatcaaagccggaggaatgtgggtgttcgacaatgagatcgacacggtgaccggaacatttgagaacggcgaagtggtgctggtacacgattttgacggttatccgatgggaagaggttttatcaacgtcaattccaagatccatgtccggatgctgacaagaaagatcgatcaggaaatagaccgcgcatttttgcagatgcgtgtgcagaatgcatgggattaccgcaagacgacggtggacacctcctcctgccgtgtgattttcggggaggcggatttcctgccggggctggttgtagataaatatgaggacgttctggtcgtggagtgtctggcgcttggaatggagcagttcaaggagacgatcgtggaacttttaaaggagacacttgcgcaggacgggatctgcattcgtggcgtttacgagagaagcgatgcgaacgagcgcacgaaggaaggcttgccgaaggtaaagggatttatcggagcagagtttgacacgaatgtggagattgtggagaatggcgtccattatatggtagacgttgtgaacggacagaagaccggattttttctggatcagaagtataatcgtcttgccatgcagcggatctgtaaagggaaaaaggttctggactgttttacccacatgggaacgtttgccttaaatgcaggaattgcgggcgccgcagaagtcacgggtcttgatatttccgggtatgcggtggagcaggcgcgggagaatgcgcgccggaacggactggaggacacggtgcagttccgctgtgccaatgtgctggatgaactgccgaagctggcacagagcggcgagcagtacgacgtcgtgattcttgatccgccggcattcacgaagtcgcgtcaggcgacgaaaaatgcaattaaaggttatcgtgagattaacatgaaaggtctaaagcttgtgaaggacggcggctatcttgccacctgctcgtgttcacactttatgacacaggagctgctcgccaagacgatccgcgaggcggcacgctcggcgcacaagaggctgcgccaggtcgagttccgcacgcaggcaccggatcacccgattctgtgggcggcggatgagagttattatctgaagttctacatttttcaggtcgttgacgagaagtaagggctggaaagtggcggtaatgcttgatttataagggctggaaggtgtctggtgattcgcctgcaaacctcataaagtatcgcaaaatatcgtatcacagtggtaagaaaagtggtaggaaaagtggtaagtctgagtggtaagcacctgaaatgtaatgaatggtaaccatgaaatgataatgatatcggagaaggttatatgttcgctcttcataatacggaaattgatagtatagatgtagcgttttgtggtatactatagaagatacaaatacctttctgtgaaagggaaaggagaaaggatacgcgtatgacagttgatagaagagtaagcagtattgaatccagtttcaaaatggaaggcatgccatttgacgcagaatgccgtcaaagagtaaaaaatgtcttagcaaaaaaggtttctgcagcagatgcaatttcagaattaaataagaaatacagagtatccaagaagcaggttgaaggatcaagagtatgattatttctatgatgatgaacaggatgctaagtactgttatccgggcacaaatgtattaaagaataaactggatataagagatttagatacattgcacgaggctgaaagagactattcggcagtacgccaggcagaacttgtaggtcaaggcgttactggagatttctcttttaagcatctttgttctatacataagcatttattcagtgatgtatattcttgggcgggcaagacgagaacggttgatatctccaaaggaaccgttttctgtttggtgcagtttatcgaaagccagtttgatgatttgtatcgtaagctgaaaaaggaaaatttcttagctgacataaccgataaggaagaaatgagcgggagactagcctattatctgggtgagattaatatgattcatccttttagagaaggcaatggaagaactcagagaatatacattgagcagttatgcttgaataatggtagatttgaaattgattttaccgatgtttcaaaagaagagatgatagctgccagtgtcagatcggcaaatgcgagtaatgatgtgctggaaaaattgattaagagttgtcttgttgaaaaatagttttagagaagaatgtacgttccgctttgagtataaaaactgatttttgaacttaccatatgttaacgacaggctaacgatagactaacgacggactaacaagaaactaacgacagactaacaacgatataattgtaatgccaaaacagatatgatattattatcatggatttggtaggacaaagcgaccaatcattcgtgtccacaaaagactactattttattacaaaaaactactaataaatttacatataaaactaataaatttacgtataaaactagtaaaaaactaatatataaccactttcatttttattgtggttgtagtaatattattatggcaatcgaaacagagatgttccggttgctttttttatgccatgaaagggtgaatctgatggaattatatacgagagagaaagaactgttaattatgttcgggagtgagagaaggcttgaattctctgtataaggtggctgctactgctttatggaataagctatacaacaacatatgcgatagccaatacgtacttatgtactggcgtacacgagcagaactgtctggcatagaaagcaatatcagcaggcgagccattaacaatgaataaagctacagaataagggaaggactgccggatgtggtatttcacagtcttcgtcatacgagtatacttgtctgaggagtttcatcagctggcagtccagaagaaagactcataatcttcttcataaaatgtgctccctttcattcatacaacgtaaaagactaacgaacatatttaatgaaacatcgaaaccatcttctttttgttgtttacctataataacgattggagtagtcgattatagacactgcaatcaaaaaaatctgaaaatatatttatcaacattgcataaaagtgtgtagatgcacataaaatgggaatacatattgaaattcaggtcgttctgtgatagaatatcattactaaaaagtgtgcagatgcacggaaatggggagtgtaacgatggagattaaaagagacgcttacctacagcagctgatcaagcgaaaagataatggaatgataaaggtgattaccggcattcgtagatgtggcaaatcctttttgctgtttaccatctttaagagatacttactggagaacggtgttgatgttgatcatattattgagattgcattggacggtattgaaaatgaggaactaagagatcctaaggtgtgtttcaagtacatcaaagatgccatgaaagacgatggcaaatactatctgcttcttgatgaagtgcagtttatgtcacaatttgaggaagtgctgaacagcctgctccgcatgagcaatattgatgtgtatgtcatcggaagtaattccaagttcctgtccagcgacattgtgaccgaattccgtggcagaggtgatgagattagaatctatcctctctcctttgcagagttttattctgtctatgacggcgattatgatgatgcatgggatgactacatgatctacggaggattgccgcagatcgtaagtttccagagcgaacgacagaaagcggactatctgaagaatatctttgcaaatgtctatctgaaggatgttattgaaagaaataagattcagaacgtggatgagattgggattctggttgatgtgcttgcatctgcaattggcgcaccgaccaacccttcaaagattgccaatacctttgccagtgagcgccagatgacttatgctaataaaaccatctccaagcatatcgactatttgacagatgcctttttgatttccaaggcaagccgatacgatattaagggcagaaagtatatcggtgcaaatctgaaatactactttacggatctgggactgagaaatgcatgtctgaatttcagacagcaggagcctactcatatcatggagaacattgtttataacgagctgttgatccgtggctacaatgttgatgtgggtgtcgcggatatcttcgataaggataaagagggcaaacgtgttcgcaagcagttggaggttgactttgtggtgaatcaaggaaaccagagatactatatccaggttgcatatgacatgacttcggaagaaaaacagacgcaggagttcaattctctgcgtaatatcccggactctttcaagaagatcgtcattgtaaatggcagcaaaaagccttggagaaatgatgaaggttttgtcatcatgggaatgaagtatttcttgctgaatgcgaatagtctggaattttaagtcgatttgagttgttgctgtggtgttgttctatttcaaaaaagagtgaaatgatataaataaggccagccgatgtggtagcatttatgtgggagtacatgaaagtaccggaggattcaagagaaaaagttaagaatctgcttaaagatgcaaatgaaaatggagtaaaaataagccatcaggcaccaacactgtatgatgttgttccgaaagaagaaattgctgaatttgaagagcttatgcgcaaaaccatagctgacattgtatcagaagccagtagcgttgcttgttgggtatatgtgcagaaatatgtgaagcacaaaaccctaaacgaaatgctgctagaattgccagacgtaagtcaattcatcctagctatggatacctggtttgaaaaactgatggttatcgaagctatcattgaagcagataatgaaatgcagagaataaaagacaaaattggtatgttacacgaaatttagggagaaaactgagcaagtaggaaggtggaatatatatgaaacaagatactttagagggcaaagcaaaaacaaaaaatggggtaaaacggctgtgtttttccataatctgcattcttctggaagtgatttttattattactatcgtaacacgcttgaatgaatatgcagaaatcataaatttatttacaaggattttgagtggaatcttggttttgggattgtacgcatcaaataagacatcctctatgaaaatgccttgggtcatcttaattctaattttcccaattatgggtgtaggcctgtatttgttgattggtttgaatggtggcacacataaaatgcgtgagcgatatgcagaaattgatagcaaattgttaccaatgcttccggacagtcaggagtgtttgagcagaataaaagaaacaattccgaaagcaggaaatatagcaagttacatacaaagaaattcgcagtatccaatctatcagaatacggatattgtgtattttgatgaagcagtgaaaggattagaggcacagcttaaggatttggagaaagcacagaagtttatctttatggaatatcatgcgatagaagacgctgaagcatggcataagattcaagatgttctggaagagcgagtaaaagcaggtgtggaagttagagtattctacgatgatatgggttctataggctttattaacacagattttgtgaaaaagatggaggcaataggaattcattgccgtgtattcaatccgtttatgccaggtttaaatctgtttttgaacaatcgtgatcatagaaaaataacagttattgatggaaaagtcggatttacaggtggatataatctagcaaacgaatattttaattacacacacccgtatggacagtggaaagatacaggtattcgtttagaaggagatgctgttcagtcgcttacggtgacatttttggaaatgtggaatgcagtaagtgataaggatgctaatgattctgattttagtaaataccttttccactatgattatgcggcacagcaaactgggtttgttcaaccttatgcagacagcccgatggataatgagcaagtaggagaagaagtttatatcagtatgataaataaagctgaaaaatattgttggtttatgactccatatctaatcataacagatgaaatgacgcatgcgttatgtctggctgctaagcgaggggtagacgtaagaattatcacacctggtatccctgataaaaaattcatttataatataactcgttctttttatcatggattagttaaacatggtgttcgtgtttatgagtggactcctggtttctgtcatgcaaaaatgagtgtggcagatgactgtatggcaacttgtggaacaattaatttggattatcgaagtttatatcaccattttgaaaacggctgttttatggcagattgtcaggcagttgtggaaataaaaaatgatctgataagaacgatgggagaatgtcgtgatgtgacagaccaatatcaaaccggacgaagtgcatatttgcgactgggacaattatttatgagattatttgctggattgctataagaatctgatggaacgacctttcaaaaaacagttgatttagaagttaactgtttttgaaaggccgtttttgctatatctaacagtctgttgtacaaagaagattttgcatggatgaaaaaacaaaccttgttgaggttaaattgagttttccattgtattgtattgctaatgaataagaataagaaaaagaacagacaatgctgaatgctctggaaacaagaatatctgagtatagtatgtaagttcgtaacagaatgaaaggagcgattcaaatgagcaatttggaaaattatatgaaacagcaagcaattttttgtgaacaaaatgatagcattagtaagaatctgtattcagagtatggtgtaaaaagaggcttacgagatgaaaaaggccaaggtgtgttgacggggcttacaaatatttctgatataaaagcttttgaatattgtgatggagtaaagagtccatgtgatggcgagttatcttatcgtggttataatataaaagatttagtaacaggaagtaaaggaaaaaggtttgtctttgaagaaggagcatatcttcttttattcggagaattgccaactgatacacagttaatggaatttcagggaagactatctgattgtatggaactaccgactaactttaccagagatgtcattatgaaagcacctacatcagatattatgggttctatgactcgaagtattcttacattgggctcttacgataaggagaaagaaagtcttgaaattccgaatgtgctaaggcagagtatgcagttgatcgcagtatttcctatgttagcagtatatgcataccatgcttattgtcattatgaaaaaaacgaaagtatgtatattcatagacctgaaaaagatttatctattgctgaaaatttcctgcgcctattaagaccagatacaaaattcacagaactggaagcaagagtactggatatagcattattgttacatatggaacatggtggtggtaacaattctacattcactacacgggtagtaacatcttcaggttcagatacttattctgttatttcagcagcaatgtcatccttaaaaggaaaaaaacatggcggtgcaaatctgatggtaatgaatatgatggatgatattaaaagtcatgtgaaagattatgaagacgaagaggaaattgcatcatatctgagtaagattttgaagaaagaggcgtttgatcagaaaggacttatttatggaatgggacatgctgtatattctatttccgatccgagagaaagggtgttcaaaggctttgtagaacaactcgcaagggataaaggacgtgagaaagatatgaccctttataacaatattgagaagattgcacctaagttgattgcaaagcagcgtcagatattcaaaggagtaagtcctaatatagatttctatagtggttttgtgtatgacatgttgaatattccaagagaattgtacacgccattatttgcgatagcaagaattgctggttggagtgcacatcgcctggaagaattgataactacagataagatcattcgcccggcatataagagtctagtcagcaaaaaagaatatatagaaagagaggaacgataatatgggagcaggaaccagtgcagaggagttttttttaaagagcatcaatgttgaaagtatatttgaatttgtcgaaagaacagattatttgttcctttatagtataaaggaatgtgttgaaaaatcagactgtcatgaaggagtatatctttcagaagtggcagaatacatgaaattatcgattccagaaacatctaagatggtaaaaagtcttgaaaataaaggatatattatctggaaattagatgaaaaaaaagaaagaacgtaccttgttttgacgaacaaggcaattgaattaagtaattgtcagaaagaaaaaatgatagaagcttatgaaaaaatcatatcgaatatacaagaagatgacctggaagttacacggtgtacattgagaaaaatccgacagcttatggaagaaataaaatagtgattaatacaacggagtaagaaaagctccttcatatattagaataaaaatatgactgtttctttaaaaagaagcctgtcatatttttttatgaaaaataaattttgttgaggttaaattgagattgactttgtattgtatcagtatgaaataaaaaggaatcaggtgatgtacaatgaaaaagtataaaatatgtaaaatccttcttgttatactggcaatttttttatgtatggctttttatgaattgctcggaatctgcgttgcatataaaaagcagccggaagtgtccaatacaaccaaaaaagaaacaaaaaatgggtcatggaacgaatgcagtgaaaatacagaacgggcagtaatcatagaaaagaatccagaagcgcttttacaaagagtgcgtttgatcaagaatgcaaaaaaggaaattattctttctacttttgcatttcaatccgatgaaagtggaaaattgattttaggagcactgcatgatgcggcagacagaggtgtacatattcgtctgttagtagatggaatggagagctggattgatatggaaggaaatccgtatttctatggattatcttcccatgagaatgttgaaattaaactatataataaggccaatccgttgaaaccatggaagatgatgggtagaatgcatgataaatatttgattgcagatggaaagagatatattcttgggggaagaaatacatacaattatttcctgggtgattttccgggacataagaactatgacagagacgtgttagtagtttgcgatgaacctgagaaagaaaattcagttaaccagttgttagagtattttgaaacgatatgggaacaagaagacagtggttattttcatgacaataaaaaactggcaaatagaaaatctgtaaagaacgcagttttagagctgcagaacggctatcagaaatattttgaagagaataaggaaagaatctgcgataccgattacacggacgaaacttttgagacagaaaagattgcattagtgtcaaatcctattcacacaggttccaaagaaccagtagtgtggtatcagttgggagaattgatgaaaaatgcaaaaaatcgtgtgaagatccacacgccatatattatctgtaatgatatgatgtataatacatgggaggagattgcagagaacgattcagatttttctatcatgacaaattcagttgcaaataatgggaatccatttggggctgccgattatgcgaaaaacagaaatagaatcttaagtacaggaattaatatctgggaatatgaaggcggttattcataccacggaaaaagtattctgattgacgatgatctgtctgtaatcggttcctttaatatggacatgagaagtgcatatctggatacggaactgatgcttgtaattcgcagtaaagatattaataaacagttggaagagggcatgatggaatatgaaagagtgtcccgccaggtattggaagatggaacctatcgtgatccatatcatgtagagccaatcgaattaacaaagaaacgtcagagaaaaatatttttggtacagcatctgcttggatgggcaaggtatctgttttaataaggaggaaggaaaacgtgtttcaaatattgattgtagaagatgataaagaattaagccagctattccaaaaagtgcttgagaagaatggatatcaggtcaaaagtgcatcggatggagcactggcattagaaatattggataaagagtatattgatctgatcatttccgatattatgatgccggttatggatggttatgaactggtgtcggaactccgttcagcaggatatcagataccggtacttatgatcactgcgaaaggttcctttgatgatatgcgccagggatttctttcgggaagtgacgattatatggtaaaaccggtaaatgtgaatgaaatggttttaagagttggagcactgcttcgccgtgcacagatactgaatgaacacaaaattgtgatcggttcaacagagtttgattatgatgcaatgacggttacaactgataaggaaagtcttgttttgcctaaaaaagaattcctgcttttatataagcttgcagcttcgccaggcagaacatttacaaaacaacagttgatggatgaagtatggggatacgagacggaggcagacccacatacgatagaggtacatataggaagaatcagagagcgttttaaagataaccctgattttgaaatcgtaacaatgcgtggaattggatacaaggtggtgaaaaaataatggaacaaaagaaagaaaaaggattgcggatccgatcctgtctgactggtgcaatctggctggcacttgtattttcaacagtcatatctgctttattatttgcttttttgaatcatttttttaatctgccgggcagcatacctgtgcttggctggcttttgattttcaatacattgattgcagggctgatcacttcctttattaatgcaaagttactggaaccaattaccagacttagtaaagcaatgaaggaagtttctcagggagattttgaacagcatttggaaacgaacagccgtatagcagaagttggagaatcttatcaaagttttaacgttatgacaaaagaacttcgtgcaacagaggtgctgcagatggattttgtatctgatgtttctcatgagtttaagaccccgattaatgccattgaaggatatacaatgctgcttcagggagaagaactgtctccggatcaagaggaatatgtagaaaaaatcttatttaacacccaaagactttccggattggttggtaatattttgctgttatccaagttagagaatcagaatataccaatgaaaaaaacagaatatcgtctggatgaacagatccgccaggcatttctttcattggaaacaaaatggacagaaaaagaaattggttttcaggtagaattggaggaagttaaatatactgggaatgaaggactttttatgcatatctggataaatcttttggataatgcgattaagttcagtccttcaaaggggacaattacgatgtttctgaaacaagaacaggattctgttaagttcattctggaagatgaaggaccaggaatagaggatgatgtaaaatccagaatatttgacaagttctatcaggtagatggatctcataaagcagaaggaaatggcctaggtcttgcacttgtaaaacggattgtagatagtgccggaggaacaatcaaagcagaaaaccgtgaatatggtggatgcaaatttgttgtagagcttccaatacagaaagatgagaccatataagtttaagaaaaacagatagaggaggaattacatgacattttatcaggagttgcagttaaatcaggcaggttctaaaaacctgttgaaaaagagtgaaacactaaaagaaaaattatatcatatgtgggtatatctggtgaagatagctgctacaatggcattttgttttttctttgttagtattttcagtatcctatttggaaatgagaacagcattgtaggtgtagtagtcttattatgtctcatggtgtttagaaatgcggatctggggatccacaccggacaatctacgatgcttttggctttgttctttgtaattatgactgtatgtccgcatttagcaaatcagttttcaccggtattgggaatgctgttaaatattgcggcactggctgtgttgattctgttcggatgccataatccattcatgtttaatcaatctacattggttcttgggtatctgctgctatatggttatgatgttacgggaaaaagctatcaaatgcgattagtcggaatggctttaggtgcagcacttacctgcttcgtattttatcgaaatcataaaaacagaacttataaaagaaatctgaaagatctgatacaagaatttgatatcacttcttccagaacaaaatggcagatatgtcagattttatgcgtaccgattgtcctttgcattgcagaactttgtaatatgccacgtgcaatgtgggctggtattgcggccatgtcagcgattttgccgtttatggaagatatgcactacagagtccgtaaaaggattgtcggaaatattgcaggtgttatatgttttacagtattatattttctgcttccttcgtcaatctatgcatatataggaattcttggtggaatcggtgtaggattttcagcacaatatggctggcaggcagtatttaacacatttggtgctttagccattgctacagagacttatggactacaaggagcggttagtcttagagtgattcaaaatgtttttggtgttgtgtttgctttagcattttgtgttatattttattggtttatgtctaaaaaaaacggttcatgcggggcttaatgtccgctttaatgaagaaaatcagattacttctgaggacgaaattcaaaagtgggcgaaacagattgtaaaatagtacttttagttgagctgatcagatgataggtaacatttacttccggatcagttaagggaatctgttttcgtcctttcagagtctgatctgaatcggtggttttactgctggaaaaacataataatgtggaagtccggacaagttcttcaaactcaaattcatctgtctgtatcagaaagcgggatgctggcattttgctctttaccagatttgtccagaaaccgatttcatcacgaagaaggcagttaaaaccgttaagctgtggaaggctcagctgtgaatgttctgccagtttgtgttctttcgggatgcagacatagagctgttccttaagataagggatgcagagaagatttttatctgaacaggactgtggaagaataccgatatcagcattgccggaactgacattttgaaggatttcatccatatttgtcagttttgaggaaataatattatcagggaatctgcgtgacaattcaggcaataatgaccatagaggtacgggagcacaggaatgaatggtaatcgtatgctgattgcgttcaaatgtctgtacggtctcaaccgctttttctgcttcagaaagcagagaccttgcctgttctaccgctacttcaccggtatcggttaattcgatacggtttttaccacgatgaaagagtggaacaccaaaagcatcttccacatcatgcatggttctggtaagagtgggctgagaaatatgaagtttatctgccgcagcagataaggtaccacagtctgcgtaggttacaaactggtaaaggtctgataagtctaacattttgatactcctttctattcataatatgaatagcagatttcgaaattgatattgtatatattcattttaacaggatataatttgagcgtaaacagaaaacaagaaatatcatatttcataaaatgaatacaaaaggaggacgaaacaatggattatgttacattaaataatggtgtaaaaatgcggcctgccaagagaggaacttttcattaccacaaagatctggatcagcaatgcaggatatgaaaaggcaaaggcttcgattgaggaatccttgaagaaactgaaaacagactatgtggatctgcttttgattcatcagccatttggtgattattacggaacataccgtgcaatggaggaagcctataaagcaggcaaggcacgtgcaatcggtgtttcaaacttctatccggaccgttatatcgacattgcacatttcgcggaagttgttccagcggtaaatcaggtggaaacacatgtattccagcagcagaaagtggctcgagaatatcttgcaaaatatcatacacagatcatgagctggggaccatttgcagaaggaaagaatgatttcttcaatactccggcactgaaagaaatcggagcaaaatatggaaagagtgtagctcaggtggcacttcgcttcctgcttcagaatggagtcgttgtgattccaaaatcaacgcacaaagaaagaatgcaggagaatttcaatgtgtttgattttgtgctgacagatgaggaaatgaagcagattgaaacacttgataccggaaagagtttgttcttttcccattattcaccggaaacagtggaatggtttatgagtattgtgtaacaaaatagcttcataaaggcaatagcgtattgcggtttatgtgaccggcaatacgcttttgctgtataataggatatgaaaattgttatacggaaaggataagaaaatgaaggaacagaatcatccgaatgtgattaaaattcgaaatgcacatgttcataacctgaaacatatcgatgtggatattccactaaataagattgtgggaattgccggagtgtccggttccggaaagtcatcccttgcactgggagtgctgtatgcggaaggttcacggagatatctggatgcgttatcgacctataccagaagaagaatgacacaggcaccgagagcacaggtggatgaggtactgcatattccagcggcactggcattacaccaaagaccgggggttccgggaatccggagtacgtttggaaccggatcggaactgttgaacacattacgactgatattttcaagacttgcaaatcactgttgtcccaatggccattatctggaacccacacttgatgtggcggcagggaaagaactttgttgtcctgtctgcggaacacattttttggcaccatcagcggaagaactctcttttaattcgcagggagcctgccagacttgtggcggaacgggatttgttaggaaagtagatgaagcttcgttggttccggatgaatcactgactattgatgaaggtgcggttcttccatggaaaacattgatgtggtcactcatgacagatgtatgcagggaaatgggagtccgtacagatgtaccatttcaggaacttacaaaagaggaaaaagagatcgtatatcatggcccggcagaaaaaaagcatattttttataaagcaaaaaatacaaaccagtccggcgaacttgattttacatatttcaatgctgtatataccgtggagaatgccttatccaaagtaaaagacgagaaaggcatgaaacgtgtggaacgtttcttgaaagaggatgtatgtccggattgcggcggaacaagactttctaagagagcgagactgccaaaattatgtggcatcacactggcagatgcctgtaagatgtcactttcagagcttgtagagtgggtaaatcatgtgccggatgccctgccagaagaaatgcggttaatggcagaaaatatctgtgaatcttttcagatggttgcaaaacggctgatggatctgggtctgggttatctgtcattggacagagcggcttctactctttcgacaggagaacggcagcgaatgcagcttgcacgggcagtcagaaatcggacaacaggagtattgtacgtgcttgatgagccgtctatcggtcttcacccatccaatatcgtgggactaacggatgtcatgcatgatctgattgcggatggcaattctgttattctggtggatcatgatacgcagattctttcagaggcagactggcttgtggagatgggaccaaaagccggggcagacggaggaagaatcattgcacaggggacgattcctgagattgaagcaaatccggattcccaaattggaacatttctgaaagaaatgcatcccatttatcggaagaaagcatctgaacaggaaatgttttctttgggaaccatccacctttcgacagatgctattcatacggtaaagccgctggaagcagatattccaaaagggagacttacagtggtgaccggtgtctccggttccgggaaaacgacattgatactggaaagtctgattccggcattagagtcgatgataaatggaacaaaacttccctctcatgtgaaaatattactgcggaagatattgaacaggtaaaactgattgatgcggcaccgattggaatcaatgtgcgttctacggtggcaacttatgcaaatgtgcatgatgagctgcgaaaggtatatgcaaaacttccggatgcaaaggaagcaggatataaagcaggggatttttcttacaatacaggaaaactgcgttgcccgacctgcgatggaacaggttctatcagccttgatgtgcagtttttaccggatgtggaagtaccttgtccggattgtcatggaagcagatataacagggacgctgggaatattaaaaggaaaacaaagtctggagagttatattctctgccggaactgatggatatggatgtacaacaggctctacgtgcctgtgaggatatgaaaaagatatgctcaagattgcagattataaaggatctgggactgggttatctgacattaggtgaagcaactccaaacttatccggtggagaggcacaaagactaaaacttgcatcggaaatggaacgcaaacaggatgcgtcggtgttcgtcttcgatgagccgacgattggtctgcatcctcttgatgtgcagactcttttgaaggtttttgaccgtctggtatccaagggtgctacagtcattgtcattgagcatgatctggacgtgatccgcaatgctgattatatcattgatatgggaccaggaggcggagaagccggtggaagaatcattgcaaaaggaaccccggaggaaattgccagtgacagaggaagcataacggggaaatatcttcgatgatcagcattatgaaaagaccgacaatctcagaaagtgaggatgccggtcttttcctataattctaaaatctcttgaagctggaagctgccgcaaagtttccggagattcttttccaccacgttttgcccaggtaatgagtgtgccagagatcatagatgaaagaagagtaggaaggcagtttgcttataataaaaaatgcggtaatgatatatatgacaaatcattggagtctgaaccaggtgtagtctttaaattcttttcagcttcccagcagtcaatgcgaagcatatagtctgcactggtataaacatcaatactgttacactgtggattgtattctgcaaatattgttctcatcgtatcttatctccttattgatcaataaatcatcagttacaaaaatcagaagcatttcaatcagttcaccatgtcagttttattttgtgttatactgttttatatgatttttcttggtctccgctgccgcttcggtcggcacagagcagatgtccaccggacatcttgtgcccttgtattttcccttatcagagttcgtaagcactggcgggacgatataacacaagggaaacaataagggaaagttcacctgcgacaaatccagtgttttcaagggtttgcagagaatttaataacaaaatataacagttattaaatctcttaaaacaggtgaaatctcaatcggaagttgaggaggtaaagagtgtatgaaaaagaaactgtgtattctggttattttaattgctgtgttattggtaggaacagtaggttgctatttcatgccaaaaaaattcggtaagaatgtaaatccttctgaggtagaccatataaatgtgttcgatggaaatacaggaactggttttactatcaccgattcagaagatatcgaatatatagtggcgaatattcaaggtatttcaatgaaaagagatggcatttcacttggaagaacaggatacagtttcaaaattagttatataaacagcaacgataaagatgtcatacctgtatttattctcaatagtgataatacaatttgtaaagatccatttttttatagatgtgatggcggattatgctttgattacttaaaagaatgtgaagagaaatatagaactaatgtaacagaatctatagaagaaaaataacatccagtttttgaaactaagaaatcggaattgaccgagctctttaaagcgagggacgcttcttgtccgaagggcaagaagatggagcatggaaagagttaaacaaatcgtaatttatataggcattatagaatcagtctgtatgtggaggaaatcaaatgaactgggtaaatgtacagtataaaagtaatttgagaaaatacgaaaagaaggatggaatgaaagctcttgtaacatactgcttaataatgtgtagtgctttctttcaaggttggctttatacaacaaatgcaaatgtttttgttttaaatttatcgcagatattgattccattggttttaattgcagtattcttttgctttttttactgtagtaaagagaatattagaagtattggaattaattctgataatatcaaaaatagtatagtatttggtttagcgggaggtttcgtactacttgctatacagacggcattatatataatccaagggaaatcagtatcatttatcaatcctacattattaaattgggttatatttctatttgctgcttttgaagaagaaatactatttagagggtacatacagacaagactgtttggactcataaacggtcaatggattgttagtgtaattaattcagttctttttttatccatacattatcctgtaagatggatagtatctggagcaatatttatcaatgcattatcggcggtatacatagtatcgcttcttgtactacattttttttgcgatgctgtatataaaaggacaaattgcctatggggagcattcctgttacatgtaatctataatgcagtaggagcaatgattcaaatttcctaaagatggaacaatgcgataacttctggtttgtagaattaagaaaatcgggaatcaacaggacaaatgaaaggaataatattatggacgataatcaaaggatgaaaatcagaaatttcgggtatttaaaccaaggagcattaaaagggcaaattctttttacaggatcatccctgatggaaatgtttcctgtctgtgaaattgcacgaagccagggtatcgaacaagtgatatataatcgcggcgttagtggattgaatacagatgagtttctggaaaatatcgatacattgcttttagatcttgagccatcaaagatatttatcaatatcggcactaatgatattacaaaagaacgatttggagatcagtggatgtcacatttaatggataatatctgtagaatcatggaaattatcaaattccgtattccagatgtggaaatttttatcatggcgttttatcctgcaaatcttcacctgccatggcagacagaacaatcaatccaatggatgaaacgccgtactcctgaaaatcttacattatgtaatcatcgattaaaagaaatagcagaaaaatacggttgtcgttatcttgattgtaatgaagcacttgttgatgaacatggtgaacagaaatcggagtatgccattgatggtgtacatatgtatgcaaatggatatttgaatgtttttaagtctttaaagccttatttgtaatgcatgaaagggttttattagtggaacaaaaagtaaaagaatcgggatttgtggaggtagaaaaacatgtatagaatatatagtgcacttatcgaaattgttgcggcagctgtttttataattcctatttggtgcatatataacaagttatgttttcatagctggaaacgaactattatttatatggtatttgggttttattttactgcagtcttagcacttgtaggattccctaatatagcatctctgaaaattgattttgcggtgaacattatcccgtttttggatatggtttcggatttcattaatgcttgtttgaatatacttttatttgttccatttggtttctttttgccgatattgtgggataaatttagaaacattaaaaatattgccttaatgggatttatagttacaagtttaattgaaatatcacagatttttacttttagaaccagtgatataaacgatattattacaaatactgttggtgctataattggatattttattgtacataggataactgataattttacgaagcgaatcttttcaaattcaaaaatgagtgacttttacataatatgtgtatctgtagcacttattatgttcttccttcaaccatttatttcatcattgttatggaaaatggtgctgtaaatttcatgtttatagaattaagaaaatcggtatttataggggagataatgtaatggagaaaataaaaaaatatattccaagaattatattattagatactattatttacacattaataattgttactttatacttaatattatctttctgtaaattaatgtttagagaatggatatatatagtatctgcaataataattatgtttggttttgttgctggaataatacaattacttttaaagattaagaaaaaaattgtaaaagttattctaataagcatatttgttatgttatttttactatctactccaataatttatttttttggagcatttggctatacccctgaacatgttgtcgaaaaggatgggcaaaagtttgttgcatatgtgaatggatttaatagaacttatgtgaattactatgattataaaaatatatttgtagttggaaatcaaaaaagaatagaagaatattatggcaagggtggatttgatccaatagagaaccaatatggatatgaatataatgttgaaaatacaacttattatgatgaaaacggtaaaattattaaaacgaaaccataaaaattcggttgacgagttgaaagtaagggacacttcttgtccgaagggcaagaaggtggaagatatacagtatattcttgaacaagttcaagactcatcgctcgcaaaagtgctcgttaaattcaaatttatagagataatacaaaaattatttttgcataaaataagaatcctgccggcaggattctccgcctgcggcgggtcgttcctgcgacatctttcgtctccgtttcgctcagatatcgtagctttgctgcaaaaagaaaaattgaatttgtaaagaaatcagcaggggttgaaaaaaggaatcgagaaatcggttctttttttagtttgcgcgccatgggcgctctgacgggtgcaagtcccgaacgcgcccagatagtgggaagcgggtggcaggattatggggaaaacggtatttatgaatgcactttccgtgatattgaaaactcggctacaggcggcaaaaaatgaatatttctttaattttggaatcatactatttacattaatgaaagactaaggtaatcttttgaaaagtattcacagagtacgaataataagaaatgaggtagattgaagatgaagaaaaaaataattatgattgtggcttgcgtgatgtgctgtgctggattatttggcggctgtggacagtccgggatgaagcaggataatactgcaataagcaatagcgaagagggaaaacaggaaggaacaacagaagaaaaagaagtgaccggaacgattgatgagataaaagatttcatgtttgtcgttacagatgagaatgatacaccatatagctttacttttgaggaaaagccggaaggactggagaatgtcagcaacggagatactgtgactgtaagatataccggaacaatttcagaggtagatccgtttgagggagaggtaatatctgttgaaaaggcacaataaggccagaaaagcgactgaattactggcggttattatactcgcatctgcgatactgggagcctgtgcagaaaatgtacagaaacagaagatacctgccgcaacttatatgggcgggaaggcttccattaccgggatctgcaaggaactggacgctgcaggagcttcccatgtagatttatttcaggagtgggtggtcgattttgcggattctgcggggaagaatgcaaagctggaggatgcctggtcagatcctgcgaagatgaaagcagatatcgtaaaatgtatggatggctgggaacagaatcatgattattcagacgctgactgcaggatgacagcgttccttttgctggatgggatgctttgctcggagtcaacagaaggcaattatacaggcacatatttaatgtttgacacggaagcgatagataacgtggacagatatgaaatcataaaaaagaatagggatatgtttactacactctatggcgaaaagcgtgtaacagagggcagctctccggaaactgtgttttccgacagctggaaatatcatggatttcaaataaatagtgacaggatatctcttcttagtattgtgatatatgacccgtattctgaggttgttttcgtagggcataccggcatactgataaagtacagtgactattatttatttgtagaaaagatcgcctttgaacagccctatcaggcgacaaaagtgcatactgtagatgaattgctcaatatcatgtcattaagagcggaatacttcggagaagagggggaagccggaccatttgtatataataatggagaatatattggaacgttaaagaaaaatattgacatggcagaaaaaataccctacaatcgttctaaatagaacgattgtaggcggggttgagatgtatttctgggataaacataaaacaattacaggatattatgaactgttatccggcgaggtatgcgaccggtacggattaacacagatggaatatgatatactgatgttcttacataacaatccacagcataataccgcagcagagattgtaaaggtgaggaaatcaacaaaatcgcatgtatcaacttcactgaaaaaattggaaaatgaaggtctgattgaaagaatacaaagcgaaaataataaaaagcatattgaaattgttttattagacaaggcagagttgattgtggaagccggaataaatgcacaaaaaaagttcgcaaaaaatgtattaagcgggttgacagaagaagaaatacatatgtgtatcaatgtatttgataagatctgtaacaatgcagaagaacatttgagagactacagggagaatgcaaatgagaactaaattttgtgtaaagaaaaaacattactgttgattgcaggcattgtctggatgatagcaggagttatttttaccagaaattatttgttttacagccgattgatgaaaaaggagcaggactaacgatgaaagaaaacaattacaaaccacagatcccagatgtgatggaagcaatatttgatgcagcgtatttgacttttgatctggttgctgcaatgctttttttcatattttcaaagggaaatatgttatttattctttatggaatattaacattgacactttgcggaggggatgcttttcatctggtaccgagaattatcagggcagtacgtggaagtaatgataaaataaagcggcagctgggaatcggactgcaggtatcgtctgttacaatgacagtattttatattattttgatgtatatctggaagcttacatttccggaatttaaaataccggtggtaattgaagctgttgtatggatatcagcggttgtcagaattgtgatatgcctgttcccgcagaacaactggtgcacagatgaaggaaatatgagattatctattatcagaaatacagtttttgcagttactggtacagggataattattttatatttaatttcgggaaatacctatggatatcatatggcaaggatggctgcggctattattatttcatttggctgttatcttccagtaacgttattcagtaaaacaaaaccaaaagtaggactattaatgattccgaagacctgtgcatatatgtggattattgtaatgggactacagattttgtcggaatattaaaaatgagctgggaaatagcaaaatatctgatgtggctatgtagctggatttgtgataatttcagaaaagcacagaacaaaaagcttgcattttgaaaacaggcgtgtataataaagctgttataaaacagaccattacgaagtgataaggataatgaaaaaggggtgctcgcacaggcgggctgagagtaagcggatgctttaacccagaacctgatttggataatgccaacgtagggagataataagtcacaagcattttttgtgcaggaatctttgcgttggattcctgcacttttttggttctttgcgccgtagggcagcagtaagaaaaatgatatatcacagcggcagattgggggcaccaccttaggtcgctatataaaattaatgcagaggaggattttatgtacacagcattaacaatcgctggaagtgattccagtggaggcgccggcatccaggcagatattaagacaatgaccgccaactgcgtatacgcgatgagtgcggtcacggctttgactgcccagaatacgaccggcgtaacagatattatggaagtaactccaaaatttttggcagagcagctggacagtatttttacggatatttatccggatgcagtaaagaccggaatggtctcatccagtgaactgatagagacgattgcggagaaactgacagagtatcacgcaaaaaatattgtggtagatcctgtcatggtggcaacgagtggagcaaggcttatcagcgaggatgccatcggcacattgaaaagtaaattattgccccttgcaactgttatcactccgaatatcccggaagcagaagttctttccggaatggagattaaaacagaagcagatatggaaaaagcagcagaaatcatctgtaacaccttaggctgtgcagttttattaaagggcggacatcagttaaacgatgctaatgaccttcttttccagaaaggaaaagaaccggtatggtttcacgggaagagaattgacaatcccaatacccatggaacaggctgcacgctttcttccgcgattgcatcgaatcttgcaaaaggaagggatttagaaacttccgtcaggtatgccaaaaattacatttccggcgcacttgccgccatgcttgaccttggaaaaggaagcggtcccatgaaccatgcatttgcagtcgaaggagagtacaaaggatgaataaaaagagaacttccgttttttcaaacggactaatctggtttggcgcaggcgtatctctggcggaaatactgacaggtacctattttgcaccgctcggtattggaaaagcaatggcagcaatcctgcttggtcatctgatcggcggtcttatgatgtttgcggcaggaatgatcggagcgaaagagcgcaaaagcgccatggaaactgtaaaaatgagcttcggcgagaagggaagccttctttttgccgtattaaatgtgttgcagcttgttggatggacggcgatcatgatctatgacggcgcacttgcagcggatggtgtgttacatattggaaactgggtgtgggcgctcgtcattggtgttctgattattgtctggattttcattgggctgaccaatctcggcaggctgaatacggttgccatgacagcactttttattttgtcactggtactatttaaagagatcttttttaattcagattttgtgatgctgattacagcaagtgatgacacaatgacgtttggtgcggcggtagaacttgcggtagcaatgccgctttcctggctgccgcttatcagcgattatacaagagaagcagaaaagccgtttgcagcaacacttgccagtgtgcttgtctacagtctggtcagcatttttatgtacatgatcggcatgggagcggctatttttaccggtgaatatgacattgcacagattatgttaaaaaccggttttggcgttgtcggacttcttattattgtattttccacggttacaaccacctttctggatgcttactccgcaggagtttccagtgtttccatttcttcaaagattcaggaaaaatgggcggcgatcgttgttaccgtgatcggaacggctgcagcgattgtgtatcccatggataacattacaaactttttatatctgatcggttctgtttttgctccgatgatcgcagtacagatcgcagattatttcattttaaagaaggcagatgccgaaaaatctgctttccagtggcgtaatctggtggtatggcttgccggttttataatttaccgcatattgatgcaggtggatacaccggtcggaaatacactgccggatatggtgatcacagtcattctctgcctgattgtggaaaaagctgcgggggcatcacacaacagaaaaagaggatgaaaaatgaagaaactgaatttaaagaaattgacggtcacagcaatcttagcagcggtagcagtggtgggaagcttgttttccttcccggtattcggttccaaatgcgcaccggtacagcatctggtaaatgttttatgcgcggttaccgtaggaccatggtgggcgctggcacaggcttttattgcgtcgctgatccgtaatctgctgggactgggaagccctctggcattcccgggaagcatgtgtggtgcattgcttggcggacttctttataagtacgggaagaaacttccgtttgcctatctcggcgaggtggcaggaaccggaatcatcggaggaatgctttcttatccggtggcatatcttgtcatggggaataaagcagcggcgttatttacgtttgttgttccgttcctgattagtacctgcggtggaacactcattgccattatcattacgctgccgctgaaaaaatcaggtctgcttggcagaatgaaggaaagcttagaagagtaaaatgttgaaggctctgctacttagagcgatatgtaagacagatgcatgaatcatttttcaagtgttagatgaacgctaacatttgtcaggaaaaacaggaacagaaaaagaaaagcaatcggggaagctcgattgctttttttatgccataaaaggggatctcctttaattttcttgtcaagccatctataagcggatataatatatttgtaggagttataagcatttgcgcggggtggaactttaggatgaaggagaataaaacgcaaaagaaaatccaaataagcattcgtgcaaaaatcttagttggaatggttgtatgtacgctgattgtagcaaatctcagcggctggtttcttatgaatcgggcaaaaacgatgctgcttgagcaatgcaagcagaacgcaggaagttctgccaaaatcgcagcacagagaatcgatggggatctgctggagcagctgcaggcaggtgacgagggatctgcggattatgaggaaatccttagtcagctgcaggagtttttgtgcggggatgagatcaagtatatctatacgatgcggatgaacggggatacgctggagtttattgtagatgccgataccgaggagggcgcggcgatcggagaagcatacgagatttatgacgaaatcgcggaagcattcgatggaaatgtcaccgtagacagcgagatgacttctgacgagtggggcgacttttatagcgcatttgctccggtgtacaacagcgctggtgatatcgttggcatcgtaggtgtagactgctccgtgacagagatacgacttcagcagagtgccctgatcaggaagtttatgttcattgaacttgccggactggcaattgcggtggtgctctcgcttgtcataagcggggtgctgtcaagaagcgtgagcgcaatcgcaggtaaaatgagtgagcttgcccagaaagagggcgatcttacccagaagataacggtaagatcttcggatgaggttggaaatatagcaggaagtctgaatgtatttctggagaatctgcgcgagatcattaagaagatcagcgaatgtgaatataagctggctggcaattccgagcatgtgaacaatatcgttaccgcgtccacggatgcggtatcaaaggtaaatgccaccatgagcgtgatggaagacaacgtccttgaaatgagcgagatggttcacaagatcgcggaggacgcaaagaacaacgacgaacggatgacctcagtcatcggggagacaaaagcccaggcagaatatattggcgagattggtgtaaaggcgaaaaatctggagaaagacgcaatacaggcgaaggaacgtatgcaggagacaatcgtgcgtattggcaggacgctggaagataagattgaagagtcaaaggaagttgagaaagttcaaaagctgaccggacagatcctgagtgttgcggatcagaccaatcttcttgctttaaatgccagcatagaggcagcaagggcgggagaaagtggaaagggctttgcagtagtagcaaacgagatatcaaatcttgcggaagagtcctccaggacagcggcggagatccagaagatcaacacttttattgtaaatatcgtggacagtcttacggaagcttcgtttgaacttctcaattttgtaaagacgaacgtcatttcagactatgacgttctggtgcatacaggaaaagagtatgcgagtgatgccgacagcttccgggaacagatgcttgcctttgaaggatacatgaatgaactgcagcagagcatggcgcggatcaattcttatgtaacagatattatgagcgattttgactcccaaaaagaagatgtagtaaaaaattctgagtatatgtcagaaatccacggcgagtttcacaaaatcgtggatgctgttatggacaacaaagagattgtcgatgaacttgaacggattattgggcaatttaagatctgactggtttttgtatttaaatattgcagactggctgcgagccgagtaacacaagttacaaatcgttgtaaatggcatgggtgattccatcataggacggaacaatgacggcacgctaaacgaggactacagcaagtggtgttatgccgacggaacgtatacctatcataacatggatgagttgctggatatctgtgtcaaaaatatggtaaatgaaaatttcacagaggaacaggctcgctcttatatgaaatagcaaacgggcagtgtgaattgaaaaagcataagaaaaagttattggctataaccatagttgctacagcctatttccttattttggaattgctgttctaaatgaaaaaatgtcaaattacacattgtttcatagagaaaaatgccacataatacataagaaagagatacatcacaaattttgcggaggaaagacatagatggagaatctgcttggagagatgatgctgggcggactggggatcgtcattgttattctgtcctttaccaggtggacgcgcgaccgggcagtcacacttggcatcgggggctggtttcttgcactcgccctagcgcttgtttttgaaaaagcactgttgtttaccatccttctaggggagccggtcggcgtggctgccattgtggcgggagcgctgcagattgcggcttttgcaaagggagagacgcgtggaattggcaggattttaaaaagtatcatgttgatattgttcggcatagcactgatgtatacgccggtcatggtatggagaggataggaaaatatgcggttattgatcaaacagagagtgttttcatggacagattcctatgacgtgtatgacgaggagggaaaaccaaagtattttgtgaaggcggaattcctgtcgttggggcatcagcttcatgtgtacgattgcaacaggcaggaaattggagtaatccatcagaagctgttgacgtttcttcctgcgtttgagatcgaggttggtggaatagtaaaaggcgagatccagaaacagttcacactgttttgtacgaaatacgagatcgattataacggatggcgcgtggagggagattttctgggctgggattatgatgtatacaatggctgcagttccatcatccacatttccaaacagctgctatcctggggagatacctacgccatcgacatcaatgatccggccgacgaacttgacgggctgatgcttgtgatcgctatcgatgcggcaaactgcacgcagggagcatcataagaggaacgaggtgccacagggcggtgcgcgtatgagcgcaaggaagagattgctaggaagaggtcagtgcggatgttataaggcggtcagtgcaggggattgacaggcagatagaaattgacgtatactaaactggattttgaggaaaagaaaggaggacgcaggatgaacggtctgggttatgcaccggtctgcagcagcagtgcattgtcaaaaacatgtatttttcgcgtgtacgggattactgcgcccttttttaagaaggtttagcgtttctgtacatagaaaaatgcggcagtaattccgaaacagtttgatctcacaatggtgtgggatcgggctgtttttttcagtttattgataaaaataaaatgaaaagaggaattacagatgaacgaaaaacagaatcttcgacttaagagaaatgttggactggactatgtccatacgtttctttccaatatgaacatgcaaagctcgatctgggtgttgtatctcgcatattgcgggctgcacctggcacagatcggactcttagagggaatataccatgcgacaagcatcgtgtgtgagattccttccggggcggcagccgatctgtggggcagaaaacgctgcatgattttgagcaacctctgcatcgcggtttcctgcgtgatcatgctgttctcaaaaagtttcgggtggtttgcggtaagctttgccgtacaggcacttggaaataatttaaactccggctcggaggaagcgcttgtatatgacagcatgaagtgcctggggcaggaagaacactacatgggtgtctatggaagactcaatgtgttgatcgaagtggcgcaggggcttgcaacggtcgcaggcggtgtgctggcagaattctcctacttctggtgctatgcggcatgtgttgtgattgcggtgctggcattgctgcctgtactgtggatggcggagccgccgcagtgcagcaaggcagctgatacggcaggcgggagcgcaaaagatgcgccggcggaaggaactccggcacagagaacgatctgggagaccgtgaagcatcattttgcagtcagtgcatgtatcctgcaaaaggatgccagaatcggaaaaatcatcgggttctattctgttgtttttgcggcgcacacgctgctgtttttctacagccagcaatattttgcggatttcggctacaataaagtgcagatcagcgtcattatgctgctcgtgggcggcgcttcctgccttggtgcgctcgccagtgcaaaaatgtaccggcggtttgggaaaaggtgcctgataccggagacggttatcattgcggcggcaattctctgctacggatcagagaaggcgggcgtggctgcagcggctcttatgtgtgccggatttgcgaacgcggcgttgtatccggtccagtctgactccctgaacgcattgattccgtcagaacagagggcaactttaatctcggtcgacagcatgtgtttttccattgccatgattgtgctgttcccgctcgcaggagcgtttgcggatcggtgggggttaaagacggtgttgctgctgctcggcgccattttactgctgtttcttttgacagtcttttgcattgaaaaagaaagcttttcaagcgatcattcctgatgtatgatgaaaaaagcgaggtaaacatatgttaaaattagagaagggacgtcctgccgactgcgcgggacgtctggaaaaagaagtccggacgtatgattttctggacaaactgaatatcgaatatgagcggattgatcatgaggcggcaatgacgatggaagagtgtgcggatgtcgacgaagcgctcggcgcaatgatctgcaagaatctgtttctgtgcaaccggcaggagacaacattttaccttctgatgataccgggagataagaagttcaagacaaaggatctgtcggcacagatccattcgtcacgcctgtcttttgcaaaagagacttatatggaggagcttttagacatcacgcccgggtcggtcagcgtgcttggtctgatgaacgacagggaacaccgtgtccagcttctggtggaccgggatgtgctggagggtgactatatcgggtgccatccgtgcatcaacacgtccagccttcgcataagacagaaagacatgtgggaaaaaattgttccggcgctggaacacgaaccggtctttgtgacattggaagaaccacaggagtgagcagatatgaaaaagaaaatgcagataaataagaagaaagaagaacggcggggaacgcaggaaaaaatgttggaaccggtaaagaacataaaggcggcaaacacggaaaagcagacaaaaccggcaaaagggacaaaagcgtcgaaaccggaaaaagcgataaaggcgacgagaccggcgaacgcggaaaaatcgataaagtcggcggagtgcgcagatgcggtctgtccttacgcgaagaaatgcggtggatgcgactatcagggcatgccatatgagaagcagctcaaagagaaacaggcatatgtgcagaagcaggtcggaaacttttgcaaagtgctgccgattctggggatggacgagccgtatcattaccggaacaaggtgcacgccgtgtttgatattgaaaaaaagcgtggcagccgtcccggagcccgtggaaacggtaaagctgcaaatggaaagcagggaaacggcaaaaacggaagattagcggcaaagccggcaccgggtgggatcatttcgggtgtatacaaagcgggaacgcatgaggtcatcaatatcgatgcctgtcagatcgaggatgaactatccagtgcgatcatccgcgacatccgggggcttttgcattcttttaaaataaagacatacgatgaggacaccggttacggtctgctgcgccatgtgctggtgcggcgtggattccacagtggtgaggtaatggttgttctggtgcttggctcgccggtgctgccgtcgaagaataactttgtaaaagcgcttcgcaagctgcacccggagatttccacggtgatcatcaatgtaaatgataagcgcacaagcatggtgcttggggataaggagagcgtcatctacggaaaaggctatattgaggacacactctgcggctgtacgttccgtatttcgccgaagtccttctatcaggtcaatccggtgcagacggagcttctctacggaaaagccattgcatatgcggcgttgaccggaaatgagacggttgtggatgcgtactgcggcaccggaacgatcggcattattgccgcaaagtctgcgaagaaagtgatcggtgtggagttaaaccgtgatgcggtgcgcgatgcggtaaaaaatgcgaagtgtaacaacgtcaaaaatatcgatttttacaacgcggatgcgggacagttcatggtggagatggcagaataccgtgcggatgcgaagaccggagagaagaacggggcagacgaggtggatgtcgtattcatggatccgccgcgcgccggaagtgacgaggcgtttctctcctctgtggtgacgctggcaccgaagcgtgtcgtctacgtttcctgtaatccggagacgctggcgcgggatcttttgtatctcacaaagcatggctatcgggcacaggagtgccagccggtcgatatgttcccatggacgaaacacgttgagtgcgtgataatgatgcagtattgtggaaaagagaagaaaaagtaaggtttgaccacaagatgttgtggttttagggcaaaaattagaccgaaaattggctagtttttgcccgatttttttgcccaattttatagatgcataggactggaaaaatggttttgggagtgatttggagaaaaacgaaaaggagggagtggtaagcaaagttaaaaatgaatatgggcagggatgaacgcaaggcggtacttattttagaaatagaataggtgccgccttatttttttggaggtggaaatgtcaaaattattttgtgtgagtccgggacttcgggtgctggaaaggcagatgcagcagccaccggggtacagaccgagaggatatggtatctgtgtgatggatgtggactggaggagcaggggaaattattctgaaatcgttgactgcgtgatcagcagaatgcagatggagcatctgaagaaaagggtggatgaaattttttgtgaagtggataaggaactgatattccgtaatccaaagcacagaaatgatttctattccttgctgatggggaagagggcaaagacattgcagtatgcaccgggatatgctgccgcagtctttttattgtctgctgatggaattttatgggagaagatccgcaaaaatgttctggataccgggatttactttgacagagtaaggcttggaggcgtgacactggagcactacattctgtttcatgcggccaaggatgtttatagcggaacaaagcatatccgcttgtcagaactgacagaccgggaactgatacccgatgagatactccgccttatcgtgaatgcttttgtcatcgagaagtgcggagtggaaattataaagcaggaggtgtggaatgcggattaaggtattaagcggaggaagaaaaaatatcgagttgtctttgtcagatgcggaattgaatttccaaatgaggcggattggcattgaggaaacggtacccatgtgcaggcttgtggaagtgtcagagaaggacaatcccctgcaccggtttgaaggtcagaccgtaaacatggatgaggtcaatttctttgccaagaggatggaaagcctgacagaatatgaaagaaaagttctgtcagcgtatgctgaggattatggtgtggctaccatgaaggatttaatcaatctgacattcagcatgaaaggtctttcactgcttacagatttttcagatgccagacaggttggggtacgcctttacatggatgagttcttaggaatgtcagaagaagaaaaagagcagaccaactttattgaatttgcggaaaagactttaaaggagagccgggtggaagtcctgccttatggagtctttgtagagcatggctttgaaatgctggaagtgtataacgggaaaacctttccggcatttgttgcatccgaggaaacggtggcggttgtcgaggtacagaataaaaccggggatacggagtatttgtatctgccgacagatatctgttccatgaacaaggtaaaggaaaggttgcaggtacaggattattgggagatggaagtcattgaaattgaaaacttacgtctgccggatatccttgtgccgacaacggaggatttacgagaggtggaacagctgacactgtttaatgaaatgtgtcatgccgtcaagcggtttgatgaggtaaaaatgaatcagcttgcaatggtggtggaatttaccggcttatgtgattttccggatgtggcttatattgcaacacaccttggggagtttgaaatcaatcccttagtacataacgatgaggagtatggaaagtttctggtaacggaatcgggattgtttgatgtggatgaactcttactccctcatatcaattatgcatcttttgccgctgataaaagagttggaactcttgtaacaagcggatatgtggaagagggcttcgtgggagccatcagaccgatagaggagtatggtcagtacaagggagagtttgcggaaccgctggagattgattatgactgctttgaaaaattctgtttatacagtccccttactgcaaatctgatggtagaggatgtggatgaaggaaatctataccccagtgatctcacgcagtatgcggaggcgattgctgaagccattgcaagggaagaatgtgtaggagaagaaaccagaggtcttatgcattactttgatgaaagcagggaagtggcagcaaaggttatgtcagcacatcccaaggtggcagaaataaatggggaactgtatggtgttctggaatgtaaaatcagtgagcctttgacagaggaagagattaaggtattgaaagaatactggaccggacagatgagtgacggatggggcgaaggctttgaacagcgtccgattaatgtagaggacggagaaatctatgtcagcttctggaacagtgcaaatttctggagcgttatgacggaggaggaactgatgggaggacaggtacagggaatggatatttgctgctaaaaatattgaatccagctaaagaaaaaatcaaagaaatcgaggaaggagaatcatgttaaaacgagaagaagtagaacgtataaaggaaaagtatccgaagggtactcccatccgtctttacagcatggaaggggaacatacagtaccgccgggaagcaggggagttgttgaccatgtggatgacatcggacaaattcatatgaagtgggagaacggaagctctcttgcattaaatgtggaggaggaccgctttgacattatcacacagcaggatgaaattagtgaaaagaaagagcaggagtttattgacaggataaatgaaatcttgggaaagacagacttcctgctcttaaatacgtcctgcaatacggagaacacatcctatgcagccgagacactccttgccatgcatcaggcattcgaggaagtgtacggagagggctatgtggacgaaagctatggcatggtcatgatgcctgcggtggtaaaaggaacggagtccggcataaaagcacttgccttggtaacattggacttggagtcagccggtgagcattggggtaccatattcctcgcaccgggaggaccattggagcaggggaatgcagagcttacagaggaacagaaacgtgccatcggggaatattatctcccgtatgattattggtacacaccccttgtggagcgtgaccatcatgtgaactttacggatatgccggaggaggttgtcggtatcagacgattagtggacgaatatctggtaacaggacaggcacagcagatggagggaccgaaataaaggagaggagagcataattgaatagcattatcagttgggtaggcggtaagaaggcactccgtgacctgatatacctgagaatgcccacacactatgaccgctacatagaagtatttggcggaggcggatgggttttgtttggaaagccgccggataaatgtatggaggtttacaatgatttcaattcgaatcttgcaaacctcttttattgtgtcaaggaaagaccgatggctctgcttcgggaactgtctttcctgccactgaattccagagatgagtttgtgacacttcgaaaattccttacgatggaagaattcaaaagtgagcatctggcagaggaactggagatagcaacgcattttctaaaagagccagaggctgcggaaatttgtgacattctaaaggaacgagcagtggtcggggatgtgaaaagggcggcggccttttataagattatccgctacagttatggaagtggctgtatttcatatgggtgtcagccatttgacataaggaagacctttactattctctgggaggcaaaccggaggttaaaagatactgtgattgaaaataaagattttgaggcactcatccgtcagtatgacagaccgaatgcctttttttattgcgatccgccgtattttgaaaccgaagggcattatgaagtggtgttccgaaaagaagatcatgtaaggcttagggatacactggcaggcatcgaggggaaattcatggtttcctacaatgactgcgagtacatcagggaattgtatcaggactttcagattgaagcggtgacacgaatcaacaatctggcacagcgctatgacaacggaagtgagtttccggaggtgctgattgctaactatgacatggaagaaagaagaaagagcctgccgatgcagatgaatctgtttgaaatgtttgacgagcagaaggcttctgtgtggcatggcagtagcaggaaggaggacgaagatggttcagttagtggagataacgggagtgctgaatgaaaaaggctgtattgaaattcccattgtactgcttgcacagacaggtatccgtaccggggaagaggtaaatctgatttatcttgccgcaggcgagaaggattaccggaatgaatcaagggaatttatgttaaagagagcagaggaagatccgttggaggagctgcagagtggggaaacggagttgaaactgccgccacagttgcttgcagatgcacacattcccttggatgcagacttggatattgtctgcttggatagaaagattgtgattctgcctacggaggatgtagagtcagaggatgtacccaaagaacttttggatatctgtgcagatcttggcatccccagagaaaaagtaaacattgttttgcgaatgaccgaggaggaaaacggaaagaaacaaattctttccgatgcaaaggaaggagcgaagttatcgaaatgaaaaaaccggtgtataaattgctggatgaaaagggcagggtactgatacctcttgaaatgcgacagaaagcggagatagagaaaggggatatcttaaaggtttccataaacactgggaagattgttatatccaaggtagacattttagaggtaggaaagcaggatgcagaagctgtggaggcttatgtccatgcagccgtaaagaccatgagccatgaaaagcaggtggctcttgccgcaaggattttgaaacttgcacagcaggaggaagaagcggattgctaaagagtaaatacaaagcctttgaaatacaggatgccttagtcagtgaaacggtggtggaaggaaacaggatagccattgcagattttattaaaaactgcaaggaagggagtattatcaccatccacacgttagatggtgagccatttttaatcggaatgtcaaaattattcctgtattgtgaagacaatgagtttttgaacaatcagttgataccgtatcttcgagggatgtgaatggagaagcagtatgaaaaacatattttttcgtgatggaatccttatctactatggaaatccggcaggttatctgtcagaggggaaagtagtgctggattccatttttgataaagaagaaatcatagctttcctgtctgagaaagaaaagctggcagtggaaataaggtcaggagtctatgaccgtctgtcagagggtggtgggatggaaatgacagtggaagcatccaaaggaaggaggataagaatctatcagcttaaacaggacagtccgtttatgatgcggtttatcagtctggcagaaagggaaaagagaggctttgaaaaaccacagcaaaaggagtatgcgcttgtttacgagggagaggtggataccttcagtctggaagatgtctgggagaagtttggcagaagggtgcaaagggattttgaaggacatgcattatccatatccgatgtagtggaattttcagaggaagaggtaagccgctatttttatgtggagccgaaaggctttgcagaaataacatttaaattggaatagccgtaaggcggaagggaagaacatggcaggaaaaggaacaaaaaacaatcagcagaatacccagggcgatgcacagactgaacaggcagtgcagacgaagtcgcttgattttgatgtacgcatccactccatcaaaccaaatgagtccataaagggtaccgcaagtgtaaacattaacggtgcctttgccatcaggggagtcaagattattgagggcagcaatggattatttgtatccatgcccagctacaaggtagggaacgagtacaaggatatctgtttccctatcacgcaggaatgcagaaagcaattgaatgatgcggttatcggtgcttatgaacaggcactcacacagagtcagagcagtatggcaaagcatcatgaaatgcagcaggcgccggaaggtcaggcaatggacatgaccggtatgtaaagaaaccaaaataaccagaaaaacaaaaatgaaatcacatggaggaaaaatcaatgagaaagatgatgaataaggtagcaggaaacatgaaggtaaccgcagcaaagacagcaatgctgttaaaggataagaagggagagaactatgtggataccgcagttaagattttgattgcggtggtaattggtgcccttttgcttgccggtttgtatgctctcttcggtgatgtggtaatgcctacccttaccagaagaattcaggaaatgtttaactacgccggttaatgccagagaaagaaggaggaagagagtatgcctagaaacgcagctacacaggaaaatacaaataacacagagaatatggaacagcaggtacccttcgaggtaaccatcacagagcataatccggagagaggtgtgcttgccaatgcagatgtaaatgtggcaggcattatgacgatccgcaatgtgaagattaagcaggatgactatggtcttaccgtgacaatgccccgaaccaagatgccccacacagagcagtataaggattccgtgtattttgcagataagtccatgaaacagcagtttgacatggcagtagaaactgcttatcaggagagtgttctcacaccggtgcttgatcagaatgagccggaagagggtatggagcaggaagagaccaccggcatgagcatgggaatgtagcaggtggaagggatgataaggcttgccctattttttctcgttctgtttttggcggcggtctttgacatccgaaagcgaatcattccggattggatgccgtttttaattgccggggtaagtctgattccatcggagcctgtttatctgacaggactatttgtggcattaccgctgctcattgcaggaatcactgtaggaggtatcggaggcggagatatcaagctgacaggtgcttgcggattggtgcttgggtttgaaagaacccttgcaggtttacttatggcacttatgtttctgcttctgtttcattgggcaggacagtgcataaggaaatgtaaaaaaataaattgtggagtagggaaggaacaggcatatccgcttgttcctttcttactgcttggaatgttaatgagcgtccggattggagcttaaatgtgaaaaagaaattagtagtagttggcatgctggcagccattgcaggagtggtggcagtgtttaagagccgtaagaaatatacaaaagtaagaaaaaattattaggaggaagtgcagaatgaaattatttaagaacagaaccgtgctggggattttttgtattgcagtgtccctgattatctgctttgccattacacctcttgtcaatgcaggtttatccaaaaaagtcaccattgtccgtttcaataaacaggtaaatgagggcgaagagattacaaggaatatgttggatgtggttgaggtaggaaaccataacctgccggagaacgtgataagaaatgttgcagatgtggaaggaaaatatctgaccactactgtgtatgccggggattatattcttacagataagatttccgatgaacctgccgctgagaataaatacctttacagtttaaatggggaaaaacaggccatgtccattaccatcaatacctttgcagaaggattgtccggcaagttaaaaagtggggatattgtgtccgtcattgcaccggactaccttggcagtggagaaactataatccctgtggaactcaaatatgtggaggttatcgctgtgacagcaaagtccggctatgatgccaacaccggagaacagatgtcagaggaagacgaaaaggaactgccgtctaccgtaaccattctggtaagaccggagcagagtaaactccttgccagactggaagccgagggagaaatccatttatccttagtgttccgtggagatgcagacaaagcttcggaatttatcaaggcacaggatcaggtactggatgaaatcaaagcagcagaagaggaagcattacaggaagaggatgcaactgaggaagatggtcagcctgttataaatgcagacggtcaggaaaccacagaggaagaagaaacaagtacggatggggaggaatagaacgtgaactttaaacagaactctctgtttaagagaaatacagaattagaggaagaacaggaagtgatgcagggcggtgtgcttgccgtatgggggagtccctcttccggcaaaaccactgtttccgtgaagctggcagattaccttgccagaaaaaagaaaaatgtgctgttgatttttgcagacatgacagcaccgcctctgccctgcatctgtgccgccggagatttggaaggagaaaagtcactagggagcattcttgctgccacccatgtaacggaaaatctgattaagaaaaactgtatgttctacagaaaaaatgattacttaagcatggtggggatgttaaaaggagagaacgtgttcacttatccgccttatgaccatacacaggcagtggaactgattgaacaggcaagggaggtggctccctttgtcattatcgactgtggcagcaccattgcttcggatgtgttgtcggcggtggcactgatggaggcggatacagtgcttcggcttgtaaactgcgacttaaaatccatcagttatctgtcttcacagttgccgctgcttcgtgacaacaaatgggatgcggacaagcaacttaaggtggcatctaatgtgaaacagcaggaggcaagcagccatatggaacaggtgcttggctctgtttcctttcagattccccacagcagggaagtagaaacacagtatctggagggagatatgctggcagaacttggactaaaagagagcagggcatttagaaaagagatagagaaaatcagcaaggaggtgttcggtgtatgatgggaaataaccagaacttatttttttcccaagaggaaaagggcagggcattctccgatgtgttaaaagaagtgcaggagtatatttccagtaaatattccacacttatggtggaaggcggaaacgatgaggtaaaacagcaggttaagagatacatctcaaagtacattgcagactaccgcatcaccgtaaagggaaagacaagggaagaactgattaatgacctttatacggagatggcggagttttcctttttaaccaagtacatcttcggaacaggcattgaggaaatcgacatcaactcatggaaggatattgaggtgcagtacagtgatgggagatgtgagaaaatggaggaacactttgaatcaccggagcatgccatcaacgtgattcgaagaatgctccatgtgtccggcatggtgcttgacaatgcatccccggcagtccttgggcatttgagtaaaaatatccgtattgcggtgttaaagacaccacttgtggatgaggatgtgggtattgcagcttccatccgaatcgtaaatccacagagcctcaaaaagagtgactttgtggatggaggaactgctaccgatgaaatgttagattttctggcagaatgtctgcgttatggaatcagtatctgtgtggcaggtgccaccagctccggcaaaacaactctggcagggtggctccttactaccattcccgataacaagcgtatctttaccattgagaacggaagcagggagctggctcttgttagggagaaggatggaaaggtaaccaacagtgtcatccataccctgaccagattcagcgaaaatgaaaagcagaacatcgatcaggatatgctccttgatatggccctgcgtttcaacccggagattatctgtgtgggagagatgagaagctcggaagcatacaccgcacaggagtctgcaagaaccgggcatacagtgcttaccaccattcacagtaacagttgtgaatctacctacagccgaatgagaaccctgtgtaagagaaaatacgatatggatgatgaggtgctgatggatttggtaacggaggcattccccatcgtggtatttaccaagcagcttgagaacaagaaaagaaggctcatggaaatcatggagtgtgaaatcacacccgatggaaagagacattttaattccctgttccgttatgagattacggaaaaccgggtggaaggagataaattcatcatcaatggaacccataaaaaggtgtgcggtatttcagagagcctgaaaaaaaggttccttgaaaacggaatgcctagggaagtgctaaataaaattacgggaggaggtgcaagcgtatgctgacaatgcaggtaatggcctgtatgggtatcatcataggcttatttttattgctgggcattaatcttacggattttaccggtaatatttttaagaggctgttggacggacccaagggtatccgagaggagattttagagcagacgcagagaaagaaaaagtccttcttacgaagagaagtggaagagatacagagtatcctaaaggctaccgacagggaaaataccttcccgtttttatgtacggtatcattggttttgtttgctgttggtgccgccggggcagctatgcttgggaatttctttctggtacccgtcgcagcggtagggtttatgttccttcccttctggtacattaagctgactgcgtcccatttcaaaaaggatgtgtcggcagaactggaaacagcactgtccatcattaccaccgcatatctaagaagtgaggatatcctgacttctgtggaagagaatctggaatatttaaatccgccggtaaagaacatctttcaggattttgtgtcaagaatccgtctgattaatcctgacttggaggcggccttggatgaactgcgtgcaaggatagcggatgatgtgtttaaggaatgggtggatgccttaaaagcctgcctgtatgacagatcgctaaaaacaacactgacaccgattgtggccaaactgtccgacatgcgtattgtgaatgcagaactggaatatatggttatggagccgaggaaagagtttatcacaatggtagtgctggttgtaggtaacattccacttttatatttcttaaataaggattggtaccatacgttgatgcacacggtagtggggcagataatgctcagcattgcaggcattattatttttgtatccacagcccatgtaatcagactgacaaaaccgatagaatacaggtcgtagaaaggagacagtatgaatctgatattattttgtgtgtttttgaccttttctataggtctctttctgctgcttgcaggactattacgtctgccgaccttaaagaccagcagggtaatgatggatacaggtaaggaaggaaaacagttatccaagaccttggatgccttttatatggatggagccgtgaagattgcgaagtacatccgtatgaatgattacaagaaaaaccggatggcaaatgtgcttcgagcctccgggcttggcatgacaccggaagtctatactgcatacgcatatttaaaagccggaagtgtctttttgctcattattccggcactgcatgtgtttccgctggctgctttatttgtaattctcttgggaatcatgatttattacaaggaaatccagaaggcagatgaaatgctgaaagaaaaaagggagcagatagaggaagagttataccgctttgtatctactatcacgcaggaactgaaaaacagcagggatgtgctttccatgctggagcattacaaggaaaatgccggggcagcattcagaaaagaactggatattgtgtgtgcggatatgcgctccagcagttatgaggcagctttaacccgttttgaggcaaggctcaattccccacagttatcggatgtggtcagaggtctcatcggtgtgttaagaggagatgacggagccgtgtacttccagatgttaacccatgattttaagcagacggagcttcagagactgaaagcgaaggcagccaagataccacccaaaataagagtgtattcttttgccatgctgatgtgttttctggcaacctacttcgccatcatcatctatgaaatcatcaggtctatgggaaccttgttctagcaggaggtataaatgagacagataagaaaaatagtgcgtgataagaggggagaggggtacattgatgtggcagtcatggtgctgtgtgtcatgttagtgattgcacttggcgtaaggttattccccatctttatcaccaaaatgcaggtagacaattttgcagatgaattggtaagagaggctgaaatcagcggaagggtaggaagcgagacttcgaacaggcagagagtcttggaggaaagaacaggaatccacccgactgtgcagtggtcaagaaccgggaatctgcaattaaatgaagaggtaacggttaccgttaccatacaaaaggacttaggattgtttggaaactttggttcgtttccgataaccatccgggcaagagcctccggaaagagtgaggtgtactggaaatgaggaagttaagaaaaaagactgccgccctattaaaagaccggaaaggaaatatgatgccacttgtggtggccgtaaccatctgcatgctgattattatccttggagttgcagaatacatgcgccttgtgattaccgctgcaggtatcaaggatgcaatggagtctgccgtcatatccacagttaatgacaattataacgaggtttaccatagtgtcagggaaggatatgccgcaggctatgagccggatggggaatcgttttctccctcggtggattatggggatatttacagcagaatgtgttttttactcggactggaagaggacggggcgggatatgttcgaatcaataacggaggagagatggagtaccgtttgagcaatctttctgtgtatatacacaataatgctctcggtgcaggaggcggcccctattatgcagatgcctccatcagactggaggtgccggtaagatttaccggaaagatcatcaccaatatgtcaataaatctaaaggttcgggcagcctatacagagaaattttagtaagatgttacagatatcgtgcaacctattacattttgatagacttctgcaaagttgtgtggtaggttggggattgacaaaaagaaatttaaaaactacatacaggagggattgctatgaaagatagtacaaagaaaagacttatcatcgcaggactcgcagcagtgagcgtattattgattttcggaatcagcagggtgctttacaaggaaccggtgcaggagttacctaaagagagtaaacctacagaagaggttgagcttatggtggatacggaagaaaccgggcaggtgcagaaagaaacggaaagcacagaggaaacaaaggagttaatcatcgaaacagaaacagagaatggcgtggagagcggaaagcaggaaatccagcaaacgcctgaaaaaacggaagatgaaaagccggaggagccgcctgccttaacagaggatgcggatactacaaagctggatacaccaccagagtatgaggagccggaagggacgaaaccgcttgtggatgatactccgaaaaccggagataccaaagatggtatgatttacattgaaggattcggatgggttgtagataacggtggcggtggaagcggtaccgtggcagacgatatgtatgagaatggaaataaggtaggtatcatggattagggataccaagaaagaggcacagcaaaaaacgctgtgctttttttatgcagaaatttgcttgcaacagcaggtgattttctgcatttagaagggaggcaacatgaaaagatttaagttattagtcttgacctttttgttaatcctatctacactctcacccatgacagtgcatgccgaaggcaatggaaacattgacaatggcggtggaggattaggagaaggtacggacacaaacttctggaataccggagatgaaggagtcagagtcacagtggttagtgccagtgacggaagtgcagtaagtgcgtccatagacctgacaaacaaacaaccgaacgatattagagtacagtttggaaaggtctgtaaaagtcagtaccggagtggaacagtattaacaccggatacaggaagttacagctatatcaatcctacccagtctctgcccaaaattattaccacatcctccggcagtgcaagtctagccgctatcaaaagttattttacagatgagcaggtcatacgaagtatcgcaggatatgtggggatggactatgatacgttgataggtgggaactataagttgttattggaacctattgcgtatgtgacgtttgaaggagtacgtactgcattcaccgctacagaagcagcaatgtataaccaggtcagaggtggtatgttaagaaagaagctgacgtctctgacgcataaaaacctgcccctcgccatgtttttggaaaccgcagacttgggatatccggcttggggtggcggtaagaaccagaaggtctcagatgatgagattatcggttcattaggacttggtattgtaagatttaatgaggtggtaacaccggaagtgattgtggcagattatgagtaccgggtagacacggatgtggtaacagccgtcaccataagtggagggcagagcaatcccgaccatccggtaagtgtaacgtttagtatccttggaaggaactacacggtaaataatgtgtattatccggaggacggacagcagcttgtgtgggtgaaatggcatacaccgtctacggaacagtatatcaccataaacgtgagtgtcagcggaggaggcagtgcaagtaagggaacgattactgccaacatcgtagaccttgataggaatccaccgcccaatccggtagcggatgacagaaatgattcctacaatgcaggcaatgccattattcctgcaaatccgcagaagacaagtgcgtcatggagtgtatggaggccttggtggaaagaaaaatgggtatggcatagtgattggaaatggaaaacaggttcccatacggaagagtgtgaggaagactgtgaaagcagtcatggatattgggaagatgagggagagtacgtggacgaaggctggtgggagtttagcttggacagatattcggcatccctatcagcaacaatggatcttactacggatgccaaatcccctactgcaacagctaccactatcaagagtggctatggtgtgaacatcagtgtaaatgccagtgcatccacaggccagtcctcggcaaccacaccaccgcagacagcagtcagttatttcccggagttttattataagacctattggagattgctagacagaacaagaagcgggtaccatgcagggtttgagtttcggaataaccattattccacctataaccgaagaacacatttcactcctgtgtggatgccgaatggtacctatacggtctacacatacttactggactgctggacgccggatggaatgctcagtgtgaatctgacagactccgtacagatatcgggagatttatgggatgactggcacatagcaccacaaagggcaaggtaacggtatggcgtatgaaagaatcgacggaccaaaaggactgctctatcactacacaaaaagggagaacatagagcctattttacaggatgggaggataagaaaatttaaggatagagaatgctggttctgcacttccttggaggataccttaagactgatggagttaacggtcatggaagaaggaaagctttactatgatgcaaacggacttccaaggagatatccaaagtttataccggaagaatatgtggtgttggagttatccccaagataccagaatggggattgggtgatatggaatcaggagttccctgacggagctccggaggacattcggaaacttggagaagaattcagccatctgaagataggattcagaggagatttaaggttctatgagaaccccaatatctatgaggtagcagagctttttcaggagcagacgcagacacctcagataacaatgtgactaaaaacaagtggaaaaggactgcttacgggcagtctttttctgtaccgaaaggaagagaaatgaagaaaaagaaatggttagtgatggtaatgctggtacttgtgtgttctcttatgtttggcactacggtatgtgcagccggaacaggagatgtggcaggagctattgaggggacatggaaggatgcctccgcgcagattaagacggtggtaaacaaggttgtattccctgcaattgatttgatccttgcagtattcttttttgcaaagctgggaaccgcatattttgattaccgaaagcacggacagtttgaatgggcagctccggcaattctgtttgcctgtctggtctttaccctgaccgcacctgcctatatctggacaattcttggaatgtaggaaagggaaaactgccaaaaaaagagggctatccatagacatttatcaagaagacgggtataattataatgagaggaggaatgcagaatggaagtaaaaacatatacgattgatgaaataaaaaatatcgtaacacctattgcggagaaatatcagattgcacaggtatatctgttcggttcctttgccagaggagatttcgatgaacagagtgacatagacatccgtattgagaaagggaacctgaaaggaatgtttgccttatgcggtttttatacggaagtgtcggatgcattaggacgaaaagtagatgtactgactacaggaagtctgtcagatgaatttctggagagtataaagagggatgaggtgatgctatatgcagggcagtagaaatatagatatcttaatgcatatcagagattattgcgcagaaatcaatcatacaatggatacgtttggaagggattatgatatcttcgtttccaactctatttaccagaatgcggtagcgctttgtgtgttgcagataggagaactgacaacacattttacggatgaatttaagagtgcatataacaaagtaccttggaatcagataaaagcattaagaaatgtggtggctcataactatggtaaaattgataaggaaacgctatgggaaaccctgttaaatgatatcccggacttaaacgattactgttgtcagattattacagagcatcaggctttggagcaggaatgcaatgaaagccagacaatgaacctttcctgatgctataaaacaaaataaaatacattattaaaaactatccgctttatcaggcagggtagtttttttatgtccaaaaggaggtaagcggaaatgaatttttttgaatcggaactgaaaaagattatgagaaacagtgccattttaaaagaccagaaatatgtaggtcgtatgtgctatggaaccattggcggagatttaagagccagagtggagtttgtaacccttggagtcagtgaccattacgcaggaattaaagcatctattatcaacagaaaagaaggagtggtggacagtgttctgcttaggtttaccgatatctggggaaagcagaaagtaagcaatcctaattttaaggagggaatgaatccacatatttggacaaacagcggaaaaagcgagtggtatgtgttccatccgggtcaggcagagtaccggaaggctgcagacaccgtggaaaactatctgtccatatttcagaatatggcgatgacgcaggagagtcaggactgtaccatgcagatggggacataggaagcggtaaacaggaaggaggcaagctatgtttatatttgattttgtggccgagactatcctggaccagatacttgactggatatatgggaaaatcataggttttttaaatgatttctttgtgatgatgaacaacatgggagtggaactgtttgcattaccttgggtggaagcagttaccactttttttagttacttcggatgggcactgtttggtgtcggacttgtggtaggagcctttgagtgtgccattgagtatcagggaggcaggggaagcataaaggataccgccatgaactatatcaaaggttttatggcggtaagtctgttcacagttgtgccggtaaacctgtactcgttgtgcgtatccctgcaaggaaccttcggttcggcgattacgggcattaccaatgcggaaagcattggtctgacagcacagcaggtgttaatgtctgcatcttttccgggaatcggaaatcctatattgatgactttttgtgtagttatgatggggtatgcagtcattaaagtgttctttgccaacttaaaaagaggtggaatcctcttgatccagatagcggttggaagcctttatatgttctctgttcccagaggatacatagatggatttatccagtggtgcaagcaggtcattggcatctgtatcactgcgtttttgcagtccactatcttaaccgcaggacttatggtatttaaagaccatccattgttaggtttaggactcatgttatccagcacagaggtgcctcgtattgcaggacagttcggattggataccagcaccaagaccaacatcatgagcagtgtgtatgcagcccagaccgccatcaatatgaccagaacggtcgtgaaggcagtggcagcataaggtggtgctatgacagagttgaaattaggaagtctgtttgatgggataggcggatttccgctggcagctaccatgaatgatatccgtcccgtgtgggcaagcgagatagaaccctttccgatggcggtgacagcataccgctttccgcagatgaagcatatgggggatattacgaaactgcatggggcaaatctgccggtggtagatgtgatagcaggaggctccccctgtcaggatttatccgtggcgggcaagagagaggggcttgcaggggagaggtccggcttattcatggaacaggtacggattgtaaaagaaatgagaaaacaggacagaaggaggatgagaaaccatagaagacggacagatgagtttattcgacctcggtatatgctctgggaaaacgtgccgggagccttctccagtggagaaacacacggagccgacttccacacagtcctcgaagaggtctgccgtatcaaagaggcagatgtatctatacctggaccgccgggaggggcatggactcctgccgggcttattatgggagaaggattctctgttgcttggagagtattggacgctcaattttggggtgtcccccagagaagaaatcgcatcttccttgtcgcagattttggaggacacagtgccggtgaaatactatttgagtccgacaacgtgtggaggaattatcagaagaagcgagaagagaggaaaggtgttgcctgctattttaaaacaggcactgctgatgcaggcagggcaagtcctagaaaagactatgtaatctgcctgttagatcagggcggagagcggatggatgtgcatgaaaacaaaagcggaaccctgcttgcacacggacgttccaatccgcccattatcatggcaaccagtcaggggaatgcagaaatcggaatcgggtactgcccgaccattaccgcagcggcaggcatggcaggaaataaccagccgatactgtttgacaatcatggcccggatacccggtataccggtccagtagaggttgcccagaccatcacatcggcacttggtacaggaggtaacaatacacctcttgccgtaaataaagaaccattctgcattgccggaaacattataaaccggaaggaaaagaatggtggaaacggatgtgggtaccagcagggcatcagttataccctgaccacagaagacaggcattgtgtgtttgctccgggaaatgagcgaaaaccataccaagaggtcataggaagtctgtgtgccggggatgagaagatgatcagtaaccaatatgtggaccaaggcaaatgcattgtagatatgagcagtctggtacgaagacttataccattggagtgcgaaaggctgatgggattcccggattactggacagacataccgggagcaagtgacagtgcaagatacagagcattgggaaacagtttggcggtgccatgtgtggattttattctatgcggcatcacttattttttacgaaaaatgggagaggaggaagaggatgtatatctatcccgataacttgaaagcaaaggcaaccatgtggctgtggaaattaaaagaccttgccattataggcattatcgttctgctttctgtgtttgcgtttgcatacgcggggctgtggtttccgctggtcattgccggagcctatgcgtttttaaccatacaggtggaggataccagcattatggattttatccgctatgcctgtgcgtactttttaatggaccagcagcattatgaatggaggtatacaccggatgagtaagaagaacatggaatccaccagagaactgatgggaaccagcgaagtgacggattacagtatccgaacatacaagaatgaggagctggtttactttttaatccagcccagcaacatttccgtgctgtcggaggagagtctgtcagccagaatttatggactgatgacggtgcttaagggcatcacggaaatcgaaatgatgtgcttaaattccagagagaattttgaggacaacaaaagatatttgaagaagcggatggaggaagaaaccaatactgtggtaagaaagctgctggaaaaggacgcaaattacttagaccgcatgcaggtacagatggcaacagcaagggagtttctgctgatcatcaggcttcgtgaaaagaaggaaaatgaaattttttcctacttaaaccgcattgaaaagatgctggcagagcagggatttacatccaagagggcagaggaagaggatatcaaaagaatccttgcagtgtattttgagcagaatgtgacaaccgaaaaattcgaggaatttgacggagaaaggtggattattttaaatgaataaaaacagaaagaaaaacagggaaacagaatccacagcagaggcaaagctgaaagggtttctggatatgattgccccatccgttatccagttttatacggatcactatatctgtggaaatacctaccggagtgtctgggcactccgtgaatacccgacagccacggatgaacaggcgattttaagacaccttggggaaaaggatggtgttaccttaagaatctacaccagacaggtgacaccggcagaggagaaaaagattatcagcaatgcagccaacaagaaccgcatgaagcagggaaacacggaaaacttgcaggaaacggttaccgcagcaagcaacttacaggacgtgactaccattattgccactatgcacagaaacagggaaccactgcttcatgcggctgtgtttatcgaattgtctgccccagacttggataagttaaagctgttgcagacagaggtgttaacagaattaatccgatccaagctgaatgtggacaggcttttgctccgccagaagcagggatttatgtgtgtccatccggtagggagaaatgtgcttggtgagcagtttgaacgtgcactcccggcatccagcgtggcaaatctgttcccttttaactattccggtaaaacggataagaatggattttacattggcagggataagtttggcagtaacgtgattgtggactttaaccagagagccgatgataagaccaatgccaatatcctgattcttggaaactccggacagggtaaatcctatctgttaaagctgatattaaccattttaagggagtccggcatgaaggttatctgccttgatccggagcatgaatacatcgacctgacaaacaatctgggtggatgttttgtagaccttatgagtggcgagtacatcattaacgtactggaacctaagacttgggatgaaaacggaagtcctgaagatatggatgcaccgatggctttccagtgttcttccaaactcagccagcacatctctttcttaaaggactttttccgtacctataagaatttcacggacagccagattgataccattgaaatcatgttagggaagctgtacgagaagtggaacatccgggatgataccgattttagtaagttatcacctacggattaccctatcctttccgacctttatgacctgatggaagaggaatataagaattacgatgctaagaagaaagaactttataccgcagaacttttgcaggaaatttgtttaggacttcactccatgtgtaaaggagcggagtccaaattttttaacggacacacaaacatcacggacagcagcttcttaactttcggagtaaaaggcttgttacaggcaagcagaaatgtgaaggatgccatgctgtttaacattctttcctacatgtccaatgaactgttgacaaacggacatactgccgccagcatcgatgagttttatctgttcttaaccaatctgactgcggtggaatacatccgtaatttcatgaaacgtgttcgtaaaaaggacagtgcagtcatccttgccagtcagaatctggaggacttcaacattgacggtatccgtgaatatacaaaaccgctgttctctatcccgacacatgcctttttattcaatgccggtaacatcgatgccaagttttacatcgataccttgcagcttgagaagagtgagtataatctcatccgctatccccaacggggagtgtgcctttataagtgtggcaatgagagatataacctgatggtacatgcaccggagtataaggagaagctgttcggtagtgcaggtggaagataactggaggttagcctatggatatgcgggagcagaaattcgggattgaaattgaactgaccggtctgaccagacagaaagcggcggaggttatagcaaaatatctgggaagcagttgtcaatatgatggtggatattacgaggaatacagtgtatatgacaatcaaggaagaaagtggaaggttatgtatgattccagtattgtggcaaggaaaaaggatggaacccatggcggggatgaatacaaagtggagtttgtatcccccatctgtgaatatgcagacatcccaaccattcaggagattgtaaggcagctccgtcatgcaggagccattgcaggggaaaagtgtggcattcatgttcatgtgaatgccgcaccccataatgcgaagtcactcaggaatattaccaacatcatgtatagcaaagaggatttaatctacaaggcattgcaggtggatgtaaaccgtgaacaccgttactgcaagaaagtggaagaagattttttgcagagtctgaaccggaaaaagcccaaaaccttggcggaggtcagcaacatctggtacaagggaaatgatggcagccacaggcattatcatgacagcagataccactgcctgaacctgcacagtgtgttccagaagggaactattgagtttcgtctgtttaattccaccacccatgcaggcaaagtgaagacctacatacagttttgcctggccatttctgggcaggcattaaatcagacctgtgccgcgaccagaaagactaccagcaccaatgaaaaatatacctttcgcacatggcttttacgacttggcatgataggagatgagtttaagacagccagaaagtttttgcttgagaaccttgagggtggtatcgcatggaaggacccggtacaggcagagaaacaaaaggagaggctgaaggcgaaaaaggaaaaggaggaatccttaagggcatcggaggaggcggtgcaggaagaaccaatagaagaggcagaggagtgtcaggagcagggcatgaatctgtcattataggacaaggaggtaaggaaaagtggaaagaagaaaaaagtacattgcctatggttccaatctaaatctcggacagatggcaagaagatgccccactgccagggtaatcggcaaaggggaaattaaggatcatgaactgttattcagaggaggcagtctgtctgcggtagccaccgtggagccgaaagccggttccaacgttccggtgttaatctgggagattgaaccggaggatgaaaggaatctggatatctatgaaggatatcccagactctatggcaaagtggatttggaggtgcagacagaagacggaagtgaatccattatggcgtataccatgaatgaagggcatgagattggaaagccatccatgcgctatctggaaaccattacaacaggatatctggaggcagggtttgatgtgaaccgattgcttcaaagtgtgtcttactgtaaggagatagtggagagacgatatgagaatggaggaatggaggagcaggcatggaaccaacaactgctgcaatgatagccaagatcgccattgcgatgggtgccaataaaaaggtctggacagggattgcatctgtaattgtggggatatgtatcccctttattcttgccattgtgtgtatcttgaatcttgcatccgcagcggcggatcataacagggcggcagtaagacttgcttttcatggagggtttgttcccttaagtatgcctgctgattacaaggaatatatctacaagatgcagcaaagcttcgaatggatagattcagctatggatgaaatcgatgcagtggcggagggggatgttcaggacaggtatctggtcaaggcggttttttactctctgtgtttcggcgaggactggctctggcttggagaatcggactaccagagatttgcagaatcctttgtaaagtttgaagaccgtacccggattgttacagacgaggagggagggcaaagtgtagaaaactatcaggcatccattgccattacagataaagtggaactgtttgaacggataaaggaccactatggggtggaagtaacctatgagcaacaggctaatgcaatgaacgtgtggcatatcgcaaaatataacaccaccgccatgcaggagggcgatgcgcttgatgatggctgggcaaactggaatggaggtggtgacgttacttattatgacctgcctgcaagtgaagtaggtggaaaggtggtggagcttgccatgtcccggctggggcatccttattcgcagacctacagaggaaaagataattatgtggattgtagttacctgacgctgtggtgctacaggcaggtagggattattctaccggggactgctgcagagcagggaaggtatctggtggagcataacctgaccattgcaaaagaggatttacagccgggggaccttgtgttctggagttataaaccaaacgggcggttcatgaacattacccatgtgggtatttatgccggggatggaaaggtagtggatgcatcctattccaagggaaaagtagtatatcgaaatttgtttgacgaagacaagcaggtgctttatggcagaccacagtagttttttgatgccgcaggcatctgttttgcattaggaaagggggaaatgtgagagcagtattttatagaaaagagccggagatagaggcaaatgaattctgtgttgaaaaggtcattgtacttccggcgggtgagtatgaatcctttaccaagcatctgatgcatgattatgactttataagggataacgtggatttgatgtgtgaaaaagatggtgtgtggcactgcctgttagtaaccggagagggcacggaagatggtgtgctggtggagagtgaaggctcatcctatgccagatactctgcctttgtgccatcggtaaaggagatcatggaacagcatcaggcaatgcaggaaacacagactgccggaatgaatatgggaatgtaggaggagagagaaatggcagagaaagaaattaagattggctttccggaaacaaaaatggaagccttggagtttttccttagagaaaatgataccactgtggagaaggtgttaaaggaacacttggataagacctatgaaaaaagtgttccacagcaggtcagaaaatttgtggagagtaagatgactgcttcggcagaagatgccggtcagagtgaggattccagccagagacagacaagaggacagggaagacgcggtaccagacagaatactgcaagggagagtgttcaggaacaggaagattctggtgtgcagccagaacaagaggctgtggaacaggaatccgggcaggagcaggatagtggtatggtcatgagtatgtaggaggtagcggataatggatttatatgcagatgatatcaaagagaggttatttgttgaggtatataatgccaagaagctggaaggaaaattaaaaaatgtggttcatgaatgccgggaggatctggtgttagtataccgcctcagtggttacgatgagcgtttgaaaagagactgcgactcggtaacggaggaacagatgacacgctggggtgtggatgtagaaacattaaagcgtgatgcatgggcaaatacaatggcaaagcgtccgccgattatgattgatatgatggatgcctgtcatcttgactttagcagaaaacatctggaaaatgataaccctgccccgggaggaatcagtcctttattggatatgtttatcattaccaacaggatgaacaataatggtgctatctatatgtttgatgatgaaaccatgcagagagtagctggaaagctgggcgataacctgattattttaccttcatctgtgcatgaaacgattgtctattctgaagaatgtggaccggatatccgcagggcaaaggatatggtgcaggctgtcaatcagacagaattaagggaagaggattttttgtccggagaaatctatcgttacgataaggacagccatacactgtcgaaggtgcaggtgccggagcatgaagaaatcttcatgccggataaagtaagcatggaggagatgcatgcttacggatatgtatgggatggcatgctgccgctgactaaggagagagcgttggaactgatggatacagacctcctgctctttaaactgtatgaggacggagcagagggaatgattgaaaccaaagaagaaatcctctcccatgacggtctgttcggagtggaaagagactcgtggatgaattatttaaatgcacagagccagaatgaaaccaatgggatgacgttggaaatgtgatacagcaggatgtttataagcggtgtttcctagaagaaaataaaaaaaattatttgaaagatggaggtagtagaacatgaaacaggcaatggtaacgattaaatatgaagaggaaaaactgaatgctatcaagcagtatatggggaagaaggatgctgattttgaagcagagatgaatgaggtgttgggaaagatgtatgagaaatatgttccccaggccgtgagagaatacatcgaaagcaggggagatgtgcctccggctatcaagaaaagcaataagagttcagtgaggaatattgctccatctgccggtttgggaaaacagaatgagtaagtgcagaggagaaaaagccaatggaaaatacaatccgagtgctgaaaattgagccggggaaagcaccttatgtgaaagagatagaaaaggattacagagccagccaaagagaagtcggtggactgattgactgctttggatttggagatgggtgcatagccgtgctgaatgatgaaagtaaaataaatggaatggagccgaaccgtaggtgtcgcaatgacattatctgcggtcctttttttatctgtggagatggaagggatggagattttatatcccttacggatgagcagatagagtattattccaagcagtttgcggaaattgagcagttttccgggcaggaaccagaactggaaccccgaatgacttttattgcattttaggtggcttatgggaaaaggggagaaattaccccgtgtgagcgttcgtgagccgatttgtgaccttgttcgggcaaagtggataatgtgaccgagaagcacttattctgccctgtttgagccaatttgaggaaatataatcggagtagccggaaatgatagtgtaaagagaagaaatccgggggtaaatgagggctgtaaaactagggtcgaaaatagtgcaggttaaaggggttatgccgcaaaagagcggcttaacccgtcagacacccaccggcagagccgttgggcagttctaagcatggcataacttttttggaagattcggaaaggttatgccatttttatttttgttacagcgcaatcggcagtaaaggccggcagaagttatgccttttgcggaaacagggaaaaaagtctatagacagagtaaaaagaaggaggaaatgagtagtcccatggggtgaggtgcgcaccactaccagaatgggacgatgaaagtattggaactatttgcaggaacaaggagcatcgggaaagcctttgaacaacggggacatgaagtattcagtgtggaatggtcgaaagagtttgagaacattgatctgtatgaggacatcagcagggtgacggcagaggatatcttaaaacttttcgggaaaccggatgtcatctgggcgagtcctgactgcgctacttttagtattgcagcgatcagccatcacagaaaaaagaatccagagacaggaagtcttgaaccggtcagtgcatatgcaaaattctgtgacagggtagacaaacatgtgctggaactcattgagcagctacagccaaagtattattttatagagaatccgagaggcggcatgcgcaagatggaatggatgaagaacctgccaagatatacagtgacctattgccagtatggagataacagaatgaaaccgactgatatctggacgaatcatccgaaccctgaatttctgccgatgtgtcataacggtgatccatgtcatgtaccggcaccgaggggaagcaagacaggaacgcagggactgaaaggttcgagggagcgcagtgtgataccgcagaaactgtgtgagcatatcgtagatatttgtgaggagggatgaaatgaatacaaaagcaatttataccgttcacgaaaacgggaaggaacactatttcttttcggaacatgcgggagggttcagttacccttttgcagtagctgattttctgcatagcttaaagggtgtgttgaatgatccgatgtcaccacaaaaaggattatgtgcagcaccaatgctggaacagatgaaaggcaattatttgttcccggaagaaatagagggaaaagaattatttactgcggttaaaaaagagcagatgtttcaacttgcagtgaaagaacaggcatcatttggaattaaaatcaatatggaacaggataaggtatcattccatttccgggagggagaggaagaactgcaggaattttgtgacataggatttccaaggcatggagaaaggggagagtatagtggtgaaaccttttattatgctgcggataatctgagagtcaaaaatatgatggacggaattgaaatgtcgatcagtgcggaaaacgaagaagcatacaggagcatgatattaaaggctgtgcagaaacaaactgaggagcagagtacaggaatgagccagcagatgtaaggagatggaggagaatggaaaaagttagaaaagcattttacgttgaagaagaactgctggggcaggtagatgccctgttaccacaggcagatgtgcgttcacgaaatgaatttgtcaatcaggcactgcggttttatatcggatatctcacttcggaaaaaatagaaaattatatgctgacaaccatctcctctgtcatgcatgcaacggtaaaggacagcgagaaccgcatggctcgtgcaatgtataaacttgcagtggaaacttccaagctgtcccatgtgatcgcatacagccatggtgtggatgagcaggcactcggaaagctgcaggcgaagtgtgcagaagaggtgaaacggatcaatggagcagtgaggtttgaggaggcatatcaatatcagcagggggatcgtttttaagaaataatttattgaaatgcggtaagacttacagtatgataaaagaaaaggaaggagtggtacatgatgacacagatgaaggaacgggcagttgaattgatagaacgtattccagatgaaaaaatgttttatgtgattaatattcttcagaatcttgaggaaatgtcatccaacagacctgcagataagaaacaggcaatggaagcactccagaatgtgctgaagttcagcggaagattaccagaagattttgacgcagacaaggaattacaggaggcaagggaggaaaagtatggtaatattggttgacacaaatattattatagatgcacttgccaatcgggaaccatatgctgatgatgcaaaaagaattatggaaaaatgtgcggcaagggaaataacaggaatacttgcggcacatagcataccaaacttgttttatattcttagaaaaaatttcagtcaggaagaaagaagatttcttctgaaaaatttatgtgagatatttcagatttctgacttgaatgaaaagaagatagtagctgcattggaaaacaatgcattttcagattttgaagatggtctgcaggaagaatgtgcagttgagtctatggcagattatattgttacacgaaatccggctgattttaagcattcaagagtaaaagtaattctcccagatgagttgttgagagagttagaaaaaaattaattatcaggagtcgatttgtcaaggggatatttcgcattgcaatacggctttgtaaaaacagaggggtgtcaacccctcttggctgcatagtgctacctgccgaagaaggcaaccgtcccccctcggagagcgcacgactgccgcaggcagtagcaccgcccacttttgagtggtgagtaagtgcgcccttagacggattaaattgactatccttttgaatattgatataatgtgagcgtaagctaaatcaaaaatttcttaacagacaaatttaagaaggagtgatttagatgaaaaagaaaactaagactgtaattggtgttatccttgcagtagctctggtagctgtcttggtagttgtaggatttatgacttacctgggaattacctggacaaacaatcatgaattcggagaatatgtcagcaaggaaggtccttggggaatgactgctacatgggtatctgaggatagcagcagttatctcatttgcaaaaaggagaatgatgaaccatttgccaaggttacagcctattttcagggggtggatggttggcaagcctatgaactgcatggcagagaccggattgcttatctgaatactgtggaaaacgatacaaccattgatagcaccagcggaaatatgaaatttgatggaactacatttaccattacagatttagataaagaaatcttcggcacaaatgaatttaattatgttatcactgataaggagttcagccccgattaaagtgccagaactattccgatacggtggaaacataaccgatggaaaagcggaaacagtgtatgctattacgttgagaacacccgaaagccgagaaaccaaataatcgttactctaccaatggtttatgtccatatcgaaaaggttgatgtgagaatagaataattctgttcgacttattccgattattctaacagatttgctcagcacaaggaaccctgcgtgggggcagatatatttgcaaaggattttacataaaaagctgctgaacaatccagaaaaggagagtttcagcagctttttcatactctgtactgtgtgcccatcaagaaaatactggattctattgattgaccaccgcctttcggctgcatacattcaccacaaatgagccgccagccgttatgtattcaggtggcagaaaccaccctttacagagtacatcacagaagggaatacaggaccattacttcggtagtggtcttttctgtactcttaaaagctgtgaatttatgaggaggaaacatagttgaaagattttgaagggttcattaagaactatgctaccagagattttatctatttttttgcagaaaaatctattgaaatatataaaaatcaagtagaaaaattagatgaacatttggtatgtaatattacatttcctttaaacattattcagcatggttttatacataagcaggcaaaagtcatgttatcggcatgggatattccaaacatggcatatctttctatcacgaattccaatgattacagaaatgatattatgacagaacaattagcaggaagagtggtcaacctgtatcgtgggtatgaaaataagcattcaggaagtgaatatattggaaataatggactgcctagtatattcaaatatttgatgggaatgtcatatgaacaatttaaatacgcaaatccggcatggatatatcagaactataaccgcaattaccatatgctgatcggttcgcctaatattaacagggaaaaaatagttgatatcaatgtgattacaaacgaattatttggacttacagcagaggaattgttagcagtagaatggattatctggtggctgtgttctattcatccagatccattaagcgcaccggaagagttatatagaaaaaaagaaaatagcatcctgacaaagaaaaatctggagcgggttataagttattattctgtgacctatgaacaggtgagaaactcatcattgcgaaaacagattttctacaacaaaccatttgtgattacgcaaaagacgaaagaaacgattgcagtcagtttctatttggtacagatgatgatagcagatggattgtactggctgattcgggattactatcacaacaatcattggggaaccaaatttataattgcttttggagagatgtttgaggattactttgaagaactggcaggtttatatctgcccaagaattcatggcataagattccagaggaaagaaaaaagagtgctgattattatgttgaagtggatgaagcggtatttttgtttgaattaaaatcaggattacttggactgggagcaaaacagcaggtgccggatgttgggcagattgatatattttataacaggaacataaaagaggcatatgagcagttgaaggcatcagagcaggaatataaaggagagaaacctgtaataaaggtttttcttttgtatgagagtatgaccaatacacagatgatagtcggctcattgccggaaatatttgagcaagatccaagatgttatattatgacaatagatgatctggagatgcttctggcaacctataaaaaggataaaagtagatttgatgatgttgtgaaagcacttgttgaaaacaaaagaggaggcaacgactataagagtgttctggagatattgaatatatatcaggcagttggcgatatgcattttattggagaaagagattatttcaataaaatagcagaaaagctgaaaaaggaattagggacagaccaataaggaggacaccatgcccaaacttatcctacgctgcaactacctcaaaaactccccgcccgcacaccttgccaattacatcaattacatcggcacccgtgaaggcgtggagaaggtagccagcacgacatcttcgctgccagccaccgaccggcagaaaagtctgattgcagatattctgtcgaagattcccgatgcgaaccggatgcatgagtatcacgattatatccaaagaccaaccagagaaaatgcatctgagtttatcacgcaggcgctggagaataaccttgacatcatagcgaaaaagaaaaattacatggattatctggcaaacagaccgggagtagaaatcataggtactcacggtctgttttcaaatgagggagaaccggtggtgctgtcctgtgtggcagaagaggtggcaaatcatcccggtgtgatctggacgaatgtcatcagcctgcggagggaggatgccgagcggctaggctatgacagtgccgcacagtggcaggcactgttgagaagcagggtgcagttgctgtgcgagaattataagatagacagccggaacctgaaatggtatgcagcattccacaatgaatcccatcatccccatgtgcatctggtggtctattcttctgatccgtccgagggatacttgacggcaaagggaattgatgccatgcgttctgcatacgcacatgatatcttccggcaggagtttctaagcatctatgagaaagcaaccgaacagagaaaccagttaaaagagcaggcagaaaaaagtctgctttttttgttgcagcaaatgcaggagggagtctgccatcatccccaaattgcacaacagatgcagcttttatccagacggttaaaaaataccggagggaaaaaggtgtatggatacttaaaggcagatgtgaaggccatcgtaaatgacattgtagatgaactggcaaaggaagagcgtgtggcagaatgctatcaggcatggctaaaaagcagggaggagatacagcattactataaagattcggaaatagagatgataccgctgtcacagcagaaggagctaaagagcgttaaaaatatggtcatccgtgaggcagtccgttttggagaagggtatctgtatctggaagaagcggaaacaggaatagaacggctggaagagatatccgaacagcagacagaaagccttgccgcattgcagggggaggacatgccggatatcatgcctggacaaacggagatggaggagcaggaaccagacaggcaggaagaagagcatggggaatccgtttcttattttgccagatggacggaccggtataaagaagcgagggaatatctctatggcacgatgggggaagaaccagatgaggaggcagcccatgagatcatgctggaagaggcagagcagggaaatgcgtatgccatgcacgacatgggaaagatttatgcacagggcattggatgtgaagcagacaaagaaaaggtagatgtgtggtacaaaaaagcattggcggcaatgcattatgtagagcagaagaaaagtaacacctatctggaataccgcattggaaaaatgtatcagtacggacttggtacagacgagaatatggaacaggcaggggagtggttttccaaggcggcagcaaaggaacataagtatgcgctctattcccttggcatgctctatctgcaggggaaaggagtggagcaggatgaggaaaccgcatatagtctgctgttccgttcttacagcaagggaaatccctatgcggcgtatgaacttggaaaactgtatgagacaggatgcggaacagagaaaaatcaggaaaagtcggaaaattgttatcgtgtagcctttctaggttttctgaatcttgagaaaagatcaaaggatgatacgctctggtatcgtatcggctgcatgtatctgcatgggatcgggacagaggcagacgaaacgaaagcggaacattatctgacaaaggcatctgattatggcaacacccatgcctcctatcagcttgccagactctatatcagacaggagagccaaaagttaagcggggagtctgggacagcaccggattacgcaaagattgcaaaagcggtaaagtggctggaagaatcagccgcacaggaaaatccgtttgcggattatgcaatcggacggttgtacagggaaggcacactggtagcagaggacatggaaaaagcagtgttccacctgaaacgtgccgcaaatgccagaaacagctatgcacagtatcagcttgggaaaatatatctggaagaggacactaaaaacattccggcagccatacagtatctgacactggctgcgaaacagaaaaatcaatttgcagcatacaggttagggaaactttatcttgccggagaagaactgccaaagaacacggaactggcactgcattatctgaagatggcggcagacaccgaaaaccagtatgcacaatatgcccttgggaaagtgtatctgatcggaaaggatgtccagcaggacaaggaactggcatacgattattttttaaaatccgcagagcagggaaatatttatgcagcgtattttttagaacactggaatgatatgccacaccccgatctgttcttaatggcaacaaggctcatgcggcatctggaacatatcatcgaagagaatgtggctggaagaaagagtggaggacgcaggcaggggattgacagaaaactcgcacgaaaaatccgtcagaagaagattgcacagggacatgccgtggatgaccatgaggacatggtacaaacacagtgatcacaggaggagtggtagaaatgatgagaggaggtacgattgggagattttatttattttacagaggaacagaaggagcgagccaatgcggtacatattgcggacatccttcgccgggagcatgaggaagtggagcgttccggaaatgaatggcgttggaaacggcacaggagtgtgactttccgggggagcagttggtaccgccacagcagacaggtcggaagtcatgccattgattttatgcaggagttcttcgggatgtcctacacggaggcggtgagctatctgctggacggagaacagggacagattattgaacggggaaaaaggcaggagacaaaaagaaaaccggcaaaagccgggaagggacggcaggctgtagacaaagaacagacagaggaaagaaaagaaccaaaagagccaaaggaactgaaaccgccggagaaaaatccgaccatgaagagagtctatgcatatcttctgcagaaacgtcatattgacagggaaatcctctcgtactttgcaaaggaaggaaccatatatgaatctgcggagcatcacaacattgtgtttgccggactggacagcgaggggaaaatccggcatatccatgtgaaggggagctattctgacggcaggagcttccggctgaatcaggaaggctcggaagctgcctacggatttggatacaggggaaacgggaacagactgtatgtgtttgaggcacccattgacctgatatcatttctgtccctgtatccagagaactggcaggggaacagttatatcaccttaaacggtgtggcagagcatgccatgctgcaggcattgaaagacaatcccagactggatacggttgtgctgtgccttgaccatgatccggcaggcatagaggcgtgcggcagactggcagagattctggtacgcaatggatatggtgcggtaaagaggttacagtcagcctgcaaagactggaatgaggatttaaaaggcagatatggtgaggaaacaattccggcacaggagcatccgagagtcatggaatgcagggcatggacagaggtgctgaaagaagtgacggaatccatcaacatcaagtatgccaacagaagttatatctgccgttattatcaggatatttataatgaactgaaaaagggcaggggcagggaacagcttatggatgcctttgacggaccggggatgcttttgaccggagtgcttgtgcggtgcatggaaaaagagggaatcgcacttggcagggaaactagtgcagaccagatactggaaaatctgtcaaagcgttatcagccgcataaagacaagggaaacttcaacacccgcatccggcagatgcaggcagcctttgaagaaacactggaggtgttcgatacaaaagacttagaacaaaaagaagatcaggaactgcttgccagaaaatgtatgagccttgcgatggaatgcatccgggctcatatttttgttgccatcgactgcggggaagagcagatgaagccggcaaaacagactgtgaaggaacagaaaatggaacatcaggagggaggaatgatgctatgcagccagtcgtgatgctggtgatcgcaggggtggcaatgttttccgtgattggaggcgtgtcacttctgtcacactattatacattaaacggaatcaagagcaggactgtcggggacggtcagcatggaacggcgagatttgccacgaaaaaggaaatcgcagaaacctatgtgcaggtgccctatgaaccggagctgtggcgcaggggtgagaacctgccggctgcacagggactggtactcggcagcatggagcgggcaggaaaactatacgcactggtggataccggggatgtgcattgcctgatgatcggtgcggcaggagtcggaaagaccgcacattttctgtatcccaacattgaatatgcctgtgcctgtggaatgagtttactgaccacggacacaaagggagatttataccgcaactatgcaggcattgcaaaaaaatactatggctaccatacggcagtcatcgatctccgtaatccgaccagaagcgatggtgacaatatgctccatctggtcaacaaatacatggatgagtatcttgcagaccatacgaacctgagtgccaaggcaaaagcggaaaaatatgcgaagattacggcaaagaccattatctcctccggtggtacggacagttccagctatggacagaatgcgtttttctatgatgcggcagaaggcgtgctgacggcagccatcctgctcattgcggaattctgcccggatggaaaaagacacatcatcagcgtgttcaagctgatacaggatttacttgcaccatctaaagtgaaagggaaaaaccagttccagctacttctggcaaaactcccggatacccacaaggcgaaatggtttgcaggggcagccttaaatacggcagagcagtccatgcagtcggttctctccacggcattatccagactgaatgcttttctggattccgagctggagcagatactctgttttgataccgccatcgatgcagagcttttctgcaaacaaaagacggcggtgtttctggtcatgccggaggaggacaataccaagtattttattatttctctgatcttacagcagctctaccgggaaatccttgtggtggcagacgagaacggagggaaactggacaatcgtgtggttttcttctgggatgaggtcggaacgattccgaagattgaaagtgcagagatgatgttctcagcgtcccgatccagaagggtgagtatcgtacccatgatccagtcctttgcccagcttaataagaattatgggaaagagggtgcagaaatcattatcgataactgtcaggataccatcttcggagggttcgctccgaactcggagtcagcggaagtgctgtcaaagagcctgggcaacaaaaccgtcatgtccggttccatcagccggggaaagaatgatccgagccagtccctccagatgatccaaagaccgctcatgacagcggatgaattaaagtcactgccaaaaggaaactttatcgtatcaaagaccgggactcaccctatgcggacaaaactgaaactgttcttaaaatggggcatcacatttgaagaaccctatgagattgaagaaaaatctgcaagaaaggtagcatacgcagacaagcaggaaattgaagaggagatcatacggagatatatgtgctgtatggaagaaccggaggatacacctgtggaaatggcaaggacaggaggcatgcagcagacaccgctgacggacaccatgaaaaagatgcggcagaccttacggacggaagattaggaggcagggtgactaggaaagaaatctatgaaacagagctgccacacagggctgtggcggtctatctgtatctggagactcgtgcggacagggagaggacatgctatccggcaatcggtaccattgccagagagctgcacctgtctgtaagtacggtcaagcgtgcaatccatgatttggagtgtgcaggatttatacaaaaaaagcagagatggcgtgagaacggaggaaagagcagcctgctctatgaaatcataaaataggcacaaagggattactgcgccggtcaggtggactatggtatggttcaccgtggcctgtgcagggaacttttcactttaaggggaagaacagagaaaagaaaatacagttggcgatatgaaacatcaatatattttttcggaaaaaaactaagaattgaagtattaccagatggattatgcggggactcataattttattttctaatcgtatttcgtgcggaaaaatcgtatttcgtgatttatatattgtgcaaaacagtaaaataaaaaataatgaatatgcaagtttagagtactcatagaaaagaggaaataaggtaacgaatggtggcatactgaagctgatagtgtttatttgaggagagtggtaatatggtagcaaaaaaatggaaagagtgcttttaataatgtggtttgttagtttagtttttgtgtgcattataggttatagggaaataatcaatgctgtaccatatggtttggaaatggcttcaaaaattgtaagtgaaaacaatgggatggatggaaccttatatcaaaaaatcctaacggaagcaattcattgttatcagatagtaggtgcattattggttatgttaggtggttttggaataattaaatcggtatgcgcaataaaagaaaaacatagataattgagaaaatgtgctgtcaatttgatggcacattttctgtgtgataatacaattgatattgatgttttggacacttcaatgaaagattttaattaaattaaaacaggtagaaaataaaaattagaaatgttcgatatataatgagaaagaaggtgagtgctatgctggaaattgttgtctgtgatgacgatatagcagatcttgagcgtgcagtgaatatgctgcataagatttttacaagtcaaaagattgcttatcatattgagcaatttgcgtctgcaaatcaaatgctcgaaaatatcagcaacattgatatcggaattttagatatttcgatggaagaactgaatggtattaaactggggagaaaattgaaggaaaaattcccggatgtgaaattagtgtatattacgagttatgaagaatattgtatgcgggtcattaacgaagtccacgcattttcatttttatgtaaaccattggaatatgataaattggaaatgcagatgtgggagctgctggatcaattgccggataccggagtagaaaaggatttttataaagtgacggacagcaatgggaaagagtatctgtcgatcagattgaagctcagggacattttatattttgaatacataaaaagatcaagaaaagtactgattgcgttggctgatatcacatatgagtatgactgcatttttgaaaaactggttgaagaactgcagccatatgattttgttgtgaattgcaggggaaatctggttaatttaaggcatattgaaaaaataaaaggctttaccatttatctggataatggaaaagaactccagattgcgcaaaagagaagcagcgattttagagaagaagtaaataaatttttgcagaaaaattcataggagaaacgatgaatacgattttactgatattatgtaatgctctttcctgttttatcataagtaacatactgttccagtttatgaatggaaagtataaaagaagcagtcaaaatagatatgtatatattgtgatcgagactgtcacagtgatttttacaacctgtatcaatatgctcaatcattccatattaaatttggtggtctggggcgtgttgacggggataatagcatatgctctgtattatgaggatatggataaaccattaagacgtatcattgaatgtgaggcattggtattttgcatgtctgtttgtgaatcattaggagtgattcttttacaatgtattttgcaggcagcagatataaaaaatgtgaatgaaacgatgctttactgccttgaggtaacattttcaaaagtaatacttatttttttgtattatacattcataaacaggtttgtgaaaaagagcgatattccttatgcaaagacacggtacatcatgtatggaatgatactcctgtacaatctgattaacatgggtgtaattgtagagaattttaaaaatggagaagaaaattacttatgtgcagtcaacatgggatgtattgttctggcagatctatacctcttatattttgttaaaatggcagatgaaaagaactattacgaaaagcagttgatcgcattagagcagcaggcaaaggtacaatacgaatactatttgacacagacaaaaaaatatgatcaaaccgtccacatattacatgatgtaaataagcatattaaagcaatcgaaggattatatggtgcagagcaggggaatacggcaggagaatatgcagcggaaattagagaactgttaaagccgctcattccggttcaatacacagaaaatccgatcttgaacattcttcttaccgataaagaatccgttatgagggaaaaaggtatttcagtaaccataaaggtggataatgtgaatctgaatttccttgcaccaatcgacattacaactatttttggaaatttattagataatgcgattgaggcagcagagaagctggaaggagagaaatatatttcgattaagattggctcataccataaaatgatagctgccagcatcgaaaataactgcggagaggtaaagtggaaaaatggttttccggtatcagcgaaaggaaaaggcggtggaataggactgctgaatgttcagagcagtgtaaaaaaatatgatggaaatttaatattgaaaagtgatggaaataaatttattgctgagttattcctcaattcataaaaagagcattcgtgctcttttttggtaaaaagtcttacttcgtgcaaaaaaatcgtacttggtgcagaaaaggtaaaatattagaagtgggttgtcgatagaaaaagaaaaataaagcggatgatagatataaaaaatttaatgatgggaggtttcgattatgtcaagaattacggactacggttttttatttcaaacgacatttggaacatcaaaaacaaatttagtcaacaatattcagttgtcccaaatgaacagcagttctgtacagaaacaattaaaagcagcagggattgacacaaacagtaaaaagtataaagcagccctgagtgagtagattccgaatgacagaggaatgaaaataattggaggaaacgaaaatgagtatagcaggaattaacggttataattattcaaattattatacaggaacaaaaagaaacactgcgaaagcgaacggtatgaattccggtttgttatcaaatgtaagcagtacatcttctaatattacattacatatgtcgggaacagaagatagtggaaatgcattaacagcagtaggatttccggatggcagtagtgcatctgtatataaatcagatgcatatgattcggcaaacccagaatacagggtaagatattgggacaaagaaggaaattacacagatacaaatgtacagataaatgatgttgatccaagaaatgcaagttatttggaaatgcttgcatatacaacatatagtgatgtagaaggctttacgaaaaatgcttttggagatttcatgaatgcggctggtggtgtgaatggcaacatcacttatgattctgacagcataaatgaaaagaaagactatatgagcatgattaaagaatttatgcagttacaatatgattcgaacaacttatcaggttatctgtcatataaggaattgtatgattacataaatgacagaacagagaggtgattcaattaaatggaaatatcaaataattatagcacagcaaaagtgtggaacacatcgaataaaaatgtttctaaatcttctaaaaaaaacaaatggaaattaacggattctttaaaagagaagattgttgatctggcaaaaaaagatgcacaggacaatgtatatatgggaaatgcatttatgaatttgagaaagacggaagtaagcaaagtagccccgaatagagctgctttaattggaaagtttagtcaatcaatgaattcaggtaatatgtcagcaatgaaagaagttgaggaagcagacaaaaaatggctctgtatgctgtttggaataccttatgaggcaaaatatcagggaacagggacaggctcggcaattcatgtatacaatgaagagggcgaagaagttttgacctatacagggggagtaggctggcaggaaaaagaaacaaaagcagagtcacaggttcattcagcattaaaaatgacatattatgaggcatttagtgaggcgagaaaagcattaaatagtgaagaaaagactggtagtgtaggtgaaaacataatattgcaagataattttgatatgaaggcatgaagtatgcaattaaaataaggtctataatttgaaggaaaatatctatatattccgttcaaggcttaccggtaggatcaaataatgttggctttgatgttattggagcgtcaccggaagaatgttacggttatgcaggtccagtaggaaagagtggatcagaaacaacgaatgacggagaatcttggtgggagaagcgccacgaaagaatggaagaacttatgaaagaacaggaagaggaagcagtaaaaagagcacaggcaagacgaaaagctgtacaaaacgaatatctaaatagccagttggcggcggcagcatatgagaaaagcagtattattttaccagataatcctgttatacagtaggctcatcttttgacaggaaagcataagaatgcaggtaagatatttttcgggaggaaggataagaaatggaaataaacagtaatcattctacatatggtgcggcatttcgccaaaaaccaatttttttcatgtcagggaaggaaacagtggcatattttgagggaaagcttaagaaaaatatgacacttcaagaggatacctgtacacttggcagcaatgacacttatcgcagacagcatactacttatgaggtttctgacaagaagggaagtacatttctggatctggattttctgatcaaggacgaaaccagcagtctgaaaggaagtctcagcgataaaaaggatgtggatttctacaacttttccatcccttttaaccggacgatacagaattacttcggtgtccaaatctatatggacatgccggaaggctgcgattatgacctcaccttatatgatgaatatggcaatcaggtcggaaaggcagaatgggatggggaaggacggaaaacactgaccatcccgaactgggatacaaataccaataaatattgtatcaaaatagaaaacaaaaatggggaagaagtttctccagatgattattataaaatcagtttcaaggttacggaaaataaagaacaggaaaagaccgatgccataagggaggcattcgggaaccttcacggtgcatacagccggaaagatgaaaattggagggaatgcctcgacaaatataatgaagtcctgatggatacagagaaaaattatacaaaagaaatggagaaactccaccagaagcagtttgaaagtctgccggaagaaaagaaatacaaaggcgggcgcacagtggatgaattgttgcaggacatggcagaaggaaagacactggatgatgtggaaatggagtatgtgaaaatttttgccaacctgaaagattttgagaaagcacagcagaaggcggaactgaaacatgatttttccgaggattttgtaaaggatctggaaagcaaaggtatctcacgtgatgagctggatggaatgcagataaagattgaaagcaatgggaatgtaacagtgagcggtatcgaagataaagaagtccgggaacaggttcagaaactggtagaagaaaagtacagtgaccggatgtatcagtattacacaggaattgctgacagtgtgggaaatctgtcgtctaatacctatcagtatgccacggatgtgcaggaagtcaggcgttacttaaaaggggttacgggagaagatatttctctggagaacctttatctgacaccggacggaaaaattggcgggttgccggaaaaagccgctaatctgatcaacaaaacaaaagacaatgccaagatagagcggataaaggatgcattgataaatattataggacataacaggacaagcggtgatctggggattcccgattttacttcggagtttcaattcagcaatggcgctttctctgtggcagacagcggttttacggtggatatggcggcattggatagaaggctgacgccccaaccccatgataacatgtattcggatatgtatgagtacagtttcagaaaagtattatgatacaacatcagaggaggtaaaggtaagatgaataaagcagaaaagattacaatcaaggtattgaaagtagtggagagaattgcccggaatgaagtggaaaaaacagttcttggcaggacggcagagtgttcagcgatttatcaccagccgaaaagaccgaagaaaaggggaaactaggtcagaataatgaaatattttgtggagtgttgcggttgtgattatcgtaatggcaaaacaaaaggagtaagataactccaaaagggttatcttactccaataaatcaattaaaggttactgcttgggcttcggatggagagagcaggtacggttctgactgacagaagaaccgtggaaaggagttaatatgggattaggcgttgaaaattcagttaatgcttataatcagaattataggtatcaacagaataagatgacagggcaagccaatcatttagatttcaataagattttatctgctaaagagggtgataatacagagaaagtacagaagccaaatgaaaatagtgtttcaaaagtagatacctacactgaatatttaaaggctaaatatgggaatataatgatccaaaatgttggaagtgatcaaaagagtatggattcattggggacggggacatatgggatgaataatattgtgattgcacccaatgttttggaaacaatggcaaatgatcccaaaaaagcagcttattacgaaaagatgatacaggatttttttgcttcgcagtcaactgtgaaggcgcagatggcagtcggggggtttgagattcaatcttatggtatggttattcacccggatggaactgcacactattatgtttgtggagatgtttcaccagaaaaaaaagcaaagatagaggcgcaaatgaaagctgaagatgaagagaaggctaaacggcgtagacaatatttagagcgcagtgaggaggcggcagaaaagcgcagacagatagaagagattaatatgcaaaagagtaaaaaagatgcggcttttgatgataatatatcggctgttaatgtattatcggaagtagatagggcggttgccatagctgcttatgaaaatattgccaatacttttaatgaaaacataataaaaagtacaattgataattgaggactttactgactatatcaacttataataatcgatatataatattatactagtacagcattaaataaataactagtcaaatatcatgtatggtgctatacttataatatcaacggaaatgaggtatcagtatggcacacgcacaatctattacacttacaaatgaagaagttttgtaccttcagtcactcactcgtcaacgtacaattcaagcgcaggtagttgaccgcgctaaaatgcttctttataaagcacagggagcatcgaatagcgatattgctgaacgtttagatgtaaatataaacaccgttaaactctgtctttccaagttcagggaaggcggtgtacagcgtgctctgttcgatgacaaacgcaaaggacgacctgttgaaatcacagatgacgctattgcatggatcatcagcattgcttgccagcgtcctgccgatcttggctacgcacaggaactttggactttaaaaaatcttcatcagtacatccaaaatcacgcagaagaggctggatattcaaggcttacaactatcacaaaaccaatggtacagaagatactgaaccaatccgaaattaagccattcaaaatcaagtattactgtgaaaaacgggatcctgattttgagactaagatgcatgatgtccttgttgtttacaaacaggttgaaatgcagtttgacgaaaacggagacatcatagtttcaactgatagtccaatgattcataccatttcctgcgatgaaaagccgggaatacaggctattgcaacaacaagtgatgacctccgtccgacggaaggaaacggctgtgtatatcgtgactatgaatataaacgccttggcacaatgtctttaattgccggaattgatcttctcacaggaatagctattcctgttgtaagtgaaactcacaaaagttccgatttcatctgtcttctgaagaaacttgatgaaatgtatccggaaggggatgttatcaggattatctgtgacaaccattctgcacacaaatcaaaggaagtgcagaattatctggctacaaagccagaaggacgttacgtatttgtgtttacaccaaagcatgcatcctggctcaacctgattgaatgtttcttcagcaaaatgacaaaacagatgttgaaaggaatacgagtcaaatcaaagcaggaactggcggacagaatctatcaatatttcgatgaaatcaataaagagcctgtggtatttcattggacatataaacttgatgaaatatccgaagaagaagctaaccccaatatggccagttaattattattcaatctactaggaggtaattaaatgcgtattggttcgggagtgcaaagtgcatcggaagtatttggaaagcagcaaaataatagcaaaacatatgttgccgaaaatgaggaattttctcagacatcggtaaaggtgtatttaaagacggatgatatgttgttttcaggtggaaatggaacaggtctttcgttttatattaaatacgcagaagagtcaacagaggataatcctgtagtgatagccaaaggagttgacgaaaatggaaaagaatttgaagaaaaaattaatattaacgatattgatttgagaaatgcttcttatgttgaaatgagtgctttggaggcatattatgatgttgataggggtaatggtctcagctcttttccagaagaaactggtcacatgggattaaatgaaagatgcgaccttatatccagctttgaaaaggttattcgggatatgaataaattaggaaggtatgatttgcagatgttttatatgcgaaatatgaatacttatctaaatgcaaacagtaagcataaatagtgcttagttatttgaatatagtagaaaatattgatataaaggaggttatagctatgcagattagtggatattccagtgccgcaatgttggcatatcgttcttctggtatgaagcaaaaagcaggcacagtgaaaatgcaggatttttctcagatggtacagaacacaagcgcacaggcaacaagccaaacagataagacagcggcgacaaaagaagtctccgaagttgatgagatggcagcgttcaagcaggaaatctatgaggaactggctgaaattgataaaatgaactcctcggctattttgtccaattctgtacatatcacagaagatggattcaaaagaatgaaggaagatcccgcctatcgcaaagaaattatggattggcttcgtgcagatgcaagagcttctcatggggttccatttggtgtccatgttacaacaacaattacaggagctggagcaacttgctacggggcaaatgtttaccatgatgatagtgcagcaaccaaagccgctaaaaaggatttggctgataagaaggcagaaggttcattttatcattcagatcgcacctatgctgaccgtagagccgcacagcgcaagagggacagagagtatgtggcaagtgaacgccaaaagcgggaacttatgcagaagatgatgctggaaaagagtattgaccaaaaggcacagcgacaattactcgatcagaaggctcttgcacagaatgtagttgaccagaagtatgttcaagattacttgctgggaatgcaagaaagtaaaagctggaacatttgagtataaataaattcatttatacttttatgtaatcattatggaaaggagataccgctacaggggggattggtagtaaaacgtgatccaaagacagggttaaattatttgtcgataaagggaaatgaggcacaaggagtttcggtaatcataacatccgataaagatatagagacgctgaataaattagctgatgaatttcaaaaatatccggtaagttcacagcggtttacggcaggattatatgctttacttgagatatcaggaaatctgaaacgcgaaaaagatggttttacatttttgactcctaatggagttacatatattccgtatgatggtgattccagcaaagcatgggaaattgatatgccgggttcctgttatgctactgccagaaaatgtttggcggcagaaaatgattgtgcagacataagtacatggacaaaaaatttgaaaggaataaagatatattatggtgataattatggcaccactcagacaaataatgtatataaagttgatgatttaggcagatattatatgtttgcataagatatatatacaagtatgaaactataaaaatatagtatgttttatgtggtaaaaatattgtatttatgagacttttggtatttcacaaatacctaagaaaaaataaagtagaggagagtgtatattatgaatattgattacagtcagttttacagaggaacaacgaatattccctcatatgggaatggtacatataagaaagacacccttgtaaagtatgaatttaacactacagatgaacatggcaataagattattgacaagatgtcaagggaagaaaccctgcaggcgatgaaggacatcggttcgcagtatggagatgcggttattgttgaattttcgggagatggaatggctgcacttgtggaaaacaagaaaggtatagtggatgccaatgtaacacaggagcagcgggaatcaatggaggcgagaaatgcagcgttccaaaaagaaattacgcaggatgataactcactagaacttccggcatattccggaatgtatggtgcagacaaggcggttgcatctgcggtagagaactgcagcaaagaggaacagggatttgtgtatgatatcatccgtcagaatttccttgtcggaaatactggctctatgacagaggaagaacggcaggcaaatatttcacttggtatgaaaaaagcggaatatgcggcagagaattttatctcggaagatagcagaaaatcatttttggaagcaatggagtctatcgcaaagcttgcgagcgcaggaaaagctgacaataacggaaatatggactatggagtagggaaaggtacatatcttggacatggtagcaatctagtaaagactacaaatgcgcttgatatgatgaggacgatggacggcagtgcatacacggaatatcagaagattagtaaagaaagcagcaatgaggacagacagcttaatgcattaaaataccttacaaattggtatgaaggggcagtgaaaaagaatccttcgatggttgataattacgaaaagcagtcggaggaatatgtggagaaaaatgtaaaagatcagaagctggatgcaactttttcagatataaagacagagaataaagcggctttttttgaaagtctgaaagtgttccagaataataatcctaattttctctcatctatcataaatcgggagctggcatctaaattttggagcatttgataaacgtagattggaaaagttataattgctcggaaaatggaagataacaacaataaagtgtagagtgtgcctttcacatagggacacttgttacaagcaatattgtaaatgatacaagtggagattaaggcacaaatatgataaaaaatatatatttcagaaatgttgacttctttaattgaggagtatcgttttaataaaaatactctttcaaaatatttagaaataactgaagaaacaatagatggagtagtaatgggcaatgtggaatgtttgccagatgatcctgcattgcgtcttaaaatacttagtaaagcaggatttctgtattttggagcgattgaagataaggataggcaattaagcggttttttggaagtgcttgtttactattatggcatatccaagctaacgatagcaaaaatggctggtgttgaggaaaatgatattgacaggcttttagccaatccaccagaaaagattgaaatcgaagtaaagtataaaattgctgtgacggttatggaactgcgattttggctaaaagattgtgaatcaccgatataatcgggatttgtgagtagagggcacttatgaaaaataaaagtatcaatcaagtttccataataaatggtgaagatggtcccacaagtgtttttatatttggagaagctcaaaagcaatctctaaagattagaatccgaaatgctatctatcaatccagacgaaaaaggatagaaaagagaatagcggccaacccgcatacccttgcggaagtggtgcaatacgcaaaggatcattatgatttagtggaaatcaatcctgccgcaacaaattggatagaacgacagaaaaatctaaaagctagtttgattatgcagcataaaccagaacttttgggccaaaggaaggatattccaaaaccagattttcataatgaagaatctgttaaaaattttttgaatgaaatggaaattagaaataaattgattgaccaaatgcctgataatgtaattcccatggattttcatttatatgaaataaaaattggtgaggatttaatggaaatagaggtagattatacctggaatatatttggaatatcttactctggaaataagtcggtcataaaaaggtttaagaaaatagccagagatttatattgttattatggtgtcagtgaggaggatataaagaaccggacaaaaagatattcttcactggtaacggaattgagttcataattcagaattttaaatagaagtaggatttctgtattttggagcgattgaagataaggataagcaactaagcggttttttggaagtgcttgtttcctatcatggcatatccaagctaacgatagcaaaaatggctgatgttgaggaacaggatattgacaggcttttagccaatccgccagaaaaagttgaaatcgaagtaaaatataaaattgctgtgactgttatggaactgcgattttggctaaaggattgtgagttaccaatataatcatgtggtgcttgggaaactggtggaataacaggaaatgtaattagaataaagaaagatagaaggcgagtagcggattggtgtctgctgctcacttttcgtttatggggatatgtcgcaatacgacttttgaagtgttgtattgcaatctgttttcgggtatttctcgttggtatcattaccataaaagcgaggtgaattccatgaaagcagagaagaaggaaatcaatatacagattggaaaaaggttgcaaaccgccagagaaaacagtggatatacgcaggaagtttttgcagagacgctggatgtaggggtagagcattatcgcaaaatcgaaagtggtgtctatggcttacagccagagaaaatgctgatcttgtatgaaaagtacaggattgagccgacttatctggttacgggggatacaaatcataaggttgatattgaactgttccttgcaaactgcagcagggaggaacgggatgcatttatagaccgtatgcttgcgtatatgagaaagctgatgacaggccgttaaagcagcacagtctccgggatgtatatttgataaatatattttgagaaggagacgatatatgagggtagcaatctgcgatgataatcagcaggacattgaaaggatcagacgctatacactgcgtatgatcgactatgcggtggagtatgtgttttataccagaccggaagaattattgagggaatgtgcagatgcggagcaaaagccggatatgtacattcttgatattgagatgcctggaatggacggacttgcggtggcaaaacagatccgtgagacagattccaaagcattgctggtgtttcttaccagctataccaaatacatgccaagtgtatttgaagttgtcacatttgattttattccaaaaccaatctcagaagaaaggctccgtgtgctgtttgagaaggcaggaacctatctgaatctgaccaatcagagtttttcatttagttaccgcagggtgcggtacagtctgaagtttgacgaaatcctgtatctggaaaagcgggggcgtcaggcgattatccacacaaagaaaatgaaatatcagtccaacatgaatttgaatgaaatatgggagaaactggatgagagcatgtttgccgccgttcatggctcttttatcgttaatttgaaacatgttcattccgtatccagcggcatggtcatgcttacagacggcacagagctgggagtgacaagagggtaccggaaggagctgacggaaaagcacatagcgtttgtgcagggaggaatgtgacatggcattatatggggtgaggcttgtcataaatctttttgacctctgcatttaccacaggtatttagaggagttcattggaaacagaaaaacttccatggagttttctgttcttctgctgatagtgtgcgagctgattggaagtgcggtgaaccagatggggataagctggctgaattttgtgacgatggtggcgattctctgtgtatatgtctgccagtatgaggcagggattttaagcaggctgattgcggttctgctgtatatggggattatgggagttgcagaaccgttaggatatttgtttaataaggcattcatggaaaaggtgttggacgataccacggtttcatattattttatcgtgttttttatggcacttttgaaagcaacaattgtggaggtgttttgcagactgaaatctggaaaaagcattcgactatcagcaatgccaaaagaaacgcaatatatgttgacaatgatacctttatgcagcctgatcagttgctttttactgatagaagttgcaaaagaattaatctcggcacagatggtggtgctgtgcatgtgtatcatctttgtcattatcatcacaaactatatcatctttctgatgattgaaaagtacacaacagtggaggaaaaacagtacgaagaggaaatgatccagagggaaatcttataccggaacgaatactatcaggacatggaacgttatcaggaacagatacaggacatccggcatgatatgaagaacaggctgacgggactgctcgcagcggcagaacagggaagtgcggaactgatcaaggacagactgcaggaagtattgggagatatccggctggcagaagaaatcatctattctgcaaatccggtggtgaatgccatactaaaagtaaaaagcataaaggcaaaagagaaagagataccgatgcaggttacaacgctgctcccccagagagtatccgtggatatcggggacatgggtgttctgtatgggaatcttctggataatgcgatagaggcggcgatggcagtggaacaggaaaaacggtatgttcatgtggaatcaaagtttcaggagggcagattgcttttatccattaagaacagcaagccatccgggacaagttcctgtcaacagacaagcaaaaaagataaaataaaacacggcaggggaatccgttcggtgcggaaagtggcagaaaaatatggcggggagcttctgttaaaagatcagggggaacattttgaggcagtccttctgctcaacggagttgcaaaactggagtgagactgcaacttattacagcaaacctgcaactttttacagatagattgatttctacacagaaactgttagagtgaaaacatcaaaaaaaggagggttttactaaaaatgaagaaaagaaactggatgtaccgactgagcagcaaatccatgagcgtgatggcagcactggcacttatggtgacaaccatggcaaccaaccgttcctgcatgtggtatttcggacaggacaagatgccggaagattcaaaaaaactcagaaggttttaatctatgacgaaatggctcagccaccgtatggttgagcggggaatcataaaagaggaggagcaggaattataccagtttggaatacgcaatggtatgatcctgcttctaaacgttgtgacggcactggtcatcggcctgctcacagagcagctggcggttgtggcagtgtttaccctgtcttttatggttcttcgcagctataccggtggatatcactcagacagcaggattttctgttatcttggttccaatctggtgctgctggttccggtttatacacaggctgtgttttacaagacatcgctggcatggctgctggcagtattgctggtgtccgcagggattatttttttactcagtcccatgcacagcaagaaccggaaactggataaagaggaacaaaagcattttggcagaaaagcaaggctgatcgcagctttggaactggctgtgcttggcattctgtggcatgcaggacagataccgtatgcttacgctggttatacgggcatctgcatcacggcactgttcatgctcgtaggaaaagcacagctatggatacagtcacataccgaaaatagatagtcccttccgaacatgcggaggggattttttttctgggaaacaggaggaatgacaatccaagacggtaacttattacaggtaccgtaagacttattacacttatattgaagcgcactttctttccaagtatagtaccgccaaaaggcttaggagaagaaaggcgtggcatgttttggggaattcatgccgcaccggattgcagggggcggcagaaagagaaaagttcataaggataacatccgggtgcagttttgcatgctttattttgcatgggaacagcacctttttttattgtctttttccagtgaagtaaaacccagaggccctccagatgtccttcatttcaaaaaaattacgaaatggaggacatttgaatgtcagaatggatcaggatcagagtaaaggatttttataaagatgcagtcggagaattggaatacacctatgtgaccagagaagtctacgaggcacttgctgatacgttccgcaaagaagcccacgcacaggaaatgcgggatatcagacatacgaccaaggacggatatacagaaggagaaacggaagatctggtggagctgaccggggaattggtagaggatacggtcatccggcagatggaaatagaaaccctgcagaaagcaatgcagtcactcaccccagtgcagagagagcggctgcatttttatttttttgagggcatgacataccggcagatcgcagcgaaagaaggggttggagagaagaacatccgggagagcataaacggtgcggtaaagaaaataaaaaaattttttgattaataccccctcaaaacgtgtttttctgtgagtaccttatgagaggaactttttctggacagatggtctcttccgggaatcctctcatgtctcgtgtgtggatacgacacaggcagacgaaacgcaccttgaaaaatgccggagaggaatgcaggactccgagcgcaggatggaatcacgccatatcctgccagccatatccagcagttcagatacgttagccgtttcatgagccgtaaccggggcgctgtgacactcctgcagcaatcgggcagatgttctttctgccagccatgctgtgaaaaagatcgcatctaaggagtcgagcgggaaagccggggtacagcctgtctgtggtggacaggcgcgaagaggggaatggcctataatgatacaccttgagattagccagcacgcagtggtggaggtgagatacctgtgatgtctgcctgtccgagtggcagggaccaaagacagtctggactgactgcccatgaaatgccggctttgggattttttcttctctgttttggcggcatttcgttccggggagtagtgacgaatagggacagacactttttatttatgaagtgaaggattatggcagtaagacttaattacagaaaccatgcggcggagggtgacttccgccgtattcttgtggagttaagaaaagctgaaaaatgcagaatggaggaaaacaggaaatgaagaaagaagatacggaaatgatgttaaaaatttttgaaacggagagggcaggatatgcctatctttatccgaacggtggaggagagcggaaagaggactatatctcgaccacggcagaaaatatcgcaaattatatcggcagccatatgtttgaagctgaaaaaatcgtcattacggatatgtgtgacaggctgatattagacacctgcggctattttatcaatagctgtccaaatcaggaattctgcaaggaaatccatccgttcttaatcccaatccagatgggagaaaaggacgcaggagaggtgctttcagtcagcagggatgtagcggaacagtatttccgggaagaggatgaggcagcaaccatggctgaaatcgggatgatgtaaaggtgtttcttctgggcggaagtgtttttcttgggagaatgaatttaacttacttaaatcgtaggaggaaaagaaaggggaaagctgatggaaggcggagcgaatgaggtgcggtataagattgctgaatttctcttaaaaaggatgcatgaagataagctgttaaccgaggaagaatgggaaaaaatccgggttttgaatgtcaagactttctccccggaattagcaaaagtatatctgtaataacactggatatataaaggactatgtggtagtgtatgttgctgacagggagtgcaaacccttgaaaatactgggaaaggagaaaaaagcatggcaaaaaaagtgactgtcataaaggcagcaaaagcgcagaaacatacacaggaagaacgcaggctgaaagtgtgcggatatgccagagtcagtaccggcagtcaggcacaggcaacttcctatactgcacaggtcgagtactatacggaaaaaatcgagagcaaccccctgtgggagtttgcaggggtgtatgcggatgaaggaatcagcggaacaaacgtaaagcacagggatgagttccagatgatgatttcagactgtgaggatgggaacatcgacctgatccttacgaaatccatcacaagatttgcaagaaatacggtggaatgcatccagaccatccgaaagctgaaggagattggcgttggaatctactttgaaaaagagaatatcaacacgctgtcagaaaaaagcgagctgttcattaccatcctggcatcggtggcgcagggggaatcagaaaacatctcaagcaacaaccgatgggcgatacagaaacgctttcaggatggaacctatatcatatcgacgccagcgtatggctatggaaaagacgaggatggaaatttagtcatcatagaatccgaggcagaaaccgtaaggtggatttatgagtcttacttaaacggcatgggagtgtatgtgatagcaaaggcactgaatcagaaaggcattccaacgatccggggtgcagaaaagtggcaggacggggtgatacaggacattctgaaaaatcccatttatgagggagatatgcttcagcagaggacatatacagaaacaaggttcccatttgtccgcagggtaaacaacggacagagaaaccagtatctcatcaaagacagccatctgccaatcgtcacacatgaggaggcagaagcggtacgcaacctgatggcataccgggtggatgtactgcacatgaacaagagtgactacaccaaaagatacctgttttccggcagaatcatctgcggagagtgcggaagaaccttccggcggcagaaaatctacatcgggaaaccatatgaaaaaatcatctggacgtgcagcggacatgtggaggataaagagagctgctgcatgaaagccatccgggaggatgtgctgcaccgggcttttacagacatgtggaacaagctgtacaccaatcagggaacgatattagagccgctgttaaaagggctgacggaacttgtggcagcaaggcaggacagtgaggaaatcagacaactggataaggaaatcaaagatataagcgggcagagccaaatcctaaatcaagtcatgaggaaaggatatatggactctgctctttttatggagagcagtagcaagcttggctggcagctgacggaatgcagaagaaaaaagacacttttgaccagaaagctgcggaggacaaaagaaattgtacggaccgaacagcttatccaactgattgcagaacaggacggattaagggaggagtttgacgagcaactgtttaaaatgacagcagagaagatcgtggtctccaaggaacacgacatcaccttctgcctgcacaacggactgaaactgacggagaggggaggcggacaggatgcagtggcacatgccaatcggctataaggttgtggatggaaaaattaccatctgtgaagagcagagaaaaattgtggaacagatatttacagactatgacagcggggtggcggcaggcaggatcgcccagaacctgaaagggagaaacatatgcaatgcaaaagggaaagtgtcctggacccacgcatccatcggcaggatactggaaaacccaagctaccttggcacagactactatccgcagctcataggagaggaactgtttgagagagtccagtgcagacgggaaaaggtgagggcagagcttggaagggcagaccacaggcccggcagggatgagagaatcctcttcggaggtgtcatctggtgtgcagaatgcggggcagtatgcagccatatccagccgagccacaaaaaagagcgtggcggcactgccaagtggaagtgcaagagttatgtgactggcagagcaaaaaactgcaggaacagttttattacagacgggcaggcaaagcaggtgtgtgtggaagccatcaatgcagtgatacgaaacaaaggcctgctccgggtacaaaggcaggaggaaaaggtcagcccgcagtaccgggttctggagcggaacctgcagcggatgaaagaagaacaggaacgcacagaaacagacctgatgaaattgctctatgaaagggcagaggaacgctaccggacactggaggtcagggatggggagttccggacagaggaggtcaaaaacatccttgcaggaaaaaaggaactggaaacatttgatgaaaatttatatagaaaaataattgcatgcatctggttgcatggcggaaacatggcagaagtggagtttatcaatgggagccgtgtcacagccggatacaaggattaggagggagagcagatggcagaaacagcaaaaaagatcagcatgatacctgccaaggtgcagtatgaccggaatgtgaaactgtcagagaagaaaatgaaggtcgctgcctactgccgtgtcagtacggaactggaagaacaggacagcagctatgaagcacaggtggagtattataccagcaagatatcggaaaacgaaaactggaaaaatgccggcatctatgcggatgacggaaagagtggaacaaacaccaaaaagagggcagactttaatgccatgatacaggatgcccttgcaggaaagatcgacatgatccttacgaagtcggtcagcaggtttgcgaggaacacggtagactcgctggtgaccatccgaaaactgaaggaaaagaacgtggcggtggtgttcgagaaagagggaatcaatacactggagggaaccggagaaatccttatcaccatcttgagcagtctggcgcaggaggagagccgcaacatcagcgagaacatccgctggggagtcgtgaggaaatttgaaaaaggcaaggtcatcgtgaactgcacaaagttcatgggatacaccaaaaacgaggatggggatctggtcatcgtacccgaagaggcagagattgtaaagctgatcttccgcctttatctggaaggctacagtaccgggaaaatcgcaaagcatctggaagagcagggaatcaagaccgccacagggcaggacaaatggcattccacggtaatagacaaaatgctccgcaatgaaaaatacatgggagatgcactcctgcagaaaacctacacggtggatttcatgacaaaaaagaaagtaaagaacaccggactcgtaccgcagtattatgtggaagatgaccatgaggcaatcatcccgaaagagctgttttacagggtacaggaagagatgatgcggagggcatccttatgcaaggcggctgtcacccggaagaagaaccagaaaagcaggtattcctccacctatgcactgaccggcatgctgatctgcggaaaatgcggacaggagtacaggagagtcacctgggcgagaaacgggaaaaagaaagtggtctggagatgcagcaatcggctgaccaacggagtgaagaaatgcggggaatccgagacactcgaagagaacgcattaaacagggcggtgatggaagccatccacaggatcacaagtgatgatatggaatttatggaacacttccggcagaacatcatccatgtcatcgggagctatggcaccgcaaaagagtccggggaatacgaggaaaagataaaagaaaaacaggaagagatggtggcactgattgcagagaatgcaaagaccggttcctacacaccggagtttgatgaacgctaccgaatcatagcagaagaaatcaatgccttaaaagaggcacagaaaacagccagaaacgagaaacggatggctgacagttatgaacagagaatccaagatatcgaccattacttaagcacaagcacctgccagataccggagttcgacaatgaccttgtgagacggctgatctccaccatcaaagtggaatccagcgagaagctgctgatacagttccagtcaggcatagtcatggaacaggagattcgatatgagtaaggctgcggcaggaatggcagcaagtaaataggaaacgttgttcctgccagtttatggtaagaataaaatgcccgatgatccgggcgttttattgttggcataaaaataggaaacaaatgcagaacaataggaacagaaaagtgtgcaatagggaaataaacggaagaacgattatagaaagaaacacaagattgtgtgacaggagaggaggagaaaagcgtatgaattatgagcaactgatagaagaactgagggaggaaatgttacagcttgtaaacaccaaatgtgatgcactgctccagatgtaccggagtggcgaggtgcatacaagtgtgaaagatacgatccgggaaagcagccttatcacagtgtccccggcagaactgaaagggaaaaaaccgctggcagtccagttcgcaccgggagaatggatagagacacctacatggagaaaggtggcacaaaggattttgcagacctgtaatgaacagccggatatccatgagcggtttatggaaatgtgtggaaaagtagccggacgctggaggacgatccttggcagttcaccggaagaaatggatgtaccgataaaggtggatgaggaactttattttgagggaaaatttgacaccgaagcgatgttaaacatgttagagaaaaaagtgctggaaccgacaggggttgattacagcagcattaaaatccggtatatggcaaaagggcaggagcaagcaaaaaacatagagcatgtaccagagcaggatgctttggagcatgaggagcaggaacaacatgcaacggtgcagacaatgtaaaaaatggatggaatcaagactccgagtctatgacaggtttggagtttttcttatgttccttttcaaatgtaaaaattgattgtataaaagaaatgggtaagttataatataggtgtggtcagatgcctttttggggatgactatatctgttacaaaaaggaggaaggccagtgaatacagaattaaaaaatgcagtgaaagcaacagacaaggatgcacagtatgatacgagtgcaaagcgtctgttagggcagaagagcatactggcacatatactggtaaaaacagttgatgagtttaagggcatgaatcccaaggatgtggtcaactgcatcgagggaacaccacatatcagtacggtaccggtagagcctggactcacaaatgcagccagcgaaaaaaatggtgaaagactggtcggtttcaacacagaaaatgaagagatcaatgaaggtctggtaagatttgatatcgttttttatgtgcgcatgaaagatggattgtcacagattatcatcaatgtagaagcacagaaagacgagccgacgggatatgaaatcttaaaccgggcaatcttttatgtgagcagactgatttcatcacaaaaagaacgtgattttgagaactccagctacgatgacattaagcgtgtatattccatctgggtatgtatgaacatggacgagagcagcatgagccatgtgcatctcacaaaggaagatttgattggttcctatgaatggaagggaaatcttgacctgctgaatatcatcatgcttggactggcaaagaatctgccggaacatgatgagacgtatgaactgcaccgtctgctgggagcattgttatccaaggaacttacaatagatgaaaaactaaacataattggaaatgaatacgatattcctattgaggagaacttcaggaaggatgtgagcgttatgtgtaacttgagtcagggaataaaagaagatggtattgcgattggagaggcaggactcattatgaaaatgtataagaatggttttacagcagagcagatagcctcagccacagataaggatatagaagaagtgaaagcgattattgcagggaaggaacctgcacttgcataagaaaatttttaatgaagatgagaagcctttgagtttaatgacttgaaggcttctgtttaatagtttggcaaagttaagaaaaaatattttatgtataggtgggaaatatatggatgataacttgcaagattttaaggaatcaatgaatgcgtggggatggtctgtaaatgcaagaaataattttaataaatttatggacgcaatagaaacagaacaaggtttaattgaacaaattcaaagaattcaatctattattgatgatatcgtacttaataaagagatatcgcagtttaaaaaatgtttagaggtggggacagaatattatcgagcaagaattattaatccagaggatgatgatgatttaaaaaaagggattggaaaaactcaagataataagttcatggggtatgatgatataaattcaagagaacctattttaggaataggaagcgaagggagaaataatattgcgggagcatcttatttatatattgcctctaatccagaaacagcttgtatggagataaaatcacagtttggcgatttgatttctcttgcaaagttcaaagtgctaaaaccattatatattattgattttgagtccgaaaagacttttcagcgaaaagatactgagttttacggaatgagcatgggtgtattcttttcgcagttaatgctccgttttacccagccggtgaggggcgaaaatgcttatcgggcgacacagataatagcggatcatttgcgaaaaacgggaatagatggaattaaatataaaagttttttaactcccggaggtgctaattatacaatttttaattgccatccgtctgcaatagaattttgtgaaagtaaggttttgttacataaacaagcgaatcattctttttgggattttaataatgaaacagaaattatgtctaataaagatggaaaaatgttgatttatgataaaacaatagctgatgagcataaaaagcatttgttgcaacggttcaaaagaataaagtaaaaaattattttgcaatggaataggatagtacaaatgtatgttatatgagagggattactatttagggttaacagaaacggaagaacagcaatatgaagaaataacaggacgaaaattttgggaaaagagggtaagtggattcggaagagtcaataattttatggcatatcctaaagctgcaagaatgtgcaaatcgctttttcccaataattatctagatgttgctgaattacgagatgtggaacgattagagtatgcaaatgaagaatttctttctttgttggataatacggaatgcacagaaagaagtatattaaatttcataagagaaaaagaatactacaatataataggatctatcatttggggattatctattaatattgggaatcatggagcatatttattcccagaattccaattgggaagttcgtacaaagctgattatcttctcttgggaaagagttctggaggctttgagtttatttttgttgaattagaaagcccatacgggaatattacattaaaagatggacaactaggagcagaatttagagatggaatatcacagttggaagattggaaaagatggcttccggcaaattatagttcttttggagagattatgcggaaatataaaaatagtgcgtttgatttgccggaagaattttatgttttagatatgtcacgttttcattatgtagtagttgctggaagaaggacggattttcgagataagacatatattataaaacgggaacgaaaaaaggctgatgatattgatataatacattatgataatttgtttgatttttctaataatttaataggaaagcaaacatattagaaagaggtatgttgctgaaatgcaaaaagatataatggaaagagaaatagcagaaataattaaaggttttagacaggattccattgaaattgaaatgaaccaagaacatgttcataagtggatttctcagtttagtccagatactcagaatataattctggaagaaactttacatatactgaaagaatggtatttcccaaaggataagatcaatttatttttagacaagatgatggattatttgaaatcggaaaatgaaaatgcaacagatgaagaacccatgaaagatatatatttttggaatattcaagaaagtgggaaaagtcagtcgcaattggttgagatgttaaacgatagagtgaatcaaaaatatgggtgtggcataagaaccggaaagctgataagtgaaaaatattatgtatatttagatgatggattatacactggaagtagattgagaaaagatattaaacgttgcatagaaatgattccagaagggtctcgtatagatgttatttatatgattgcgtgtcagagtgggttggatttttcaaaaagaatattagaagagttgtgtaaaactaagaacattaaaattaatattcttagatggcgtgagatatgtaataataaaaaaattaaaaggcatgataatggagtttcatatgagccaattcaggattgcttatggccctcatcaaagttatctaagttaccagaaattagtgcatatgtggaaaagttagaggaaatcaaagggaaaaaagtatattattgttttcggaatgctggatacaaatatacagcgggcatattctcaaatttagtaaacagggatatagtagaggaagaatttctgaaaaaaggtattgcgattacacaaaatatacaggagcataaggggctatatccattaggttataatctcacaccttcgcttggttttggttcgttttgtgctacagacttaaacatatctaacacatgcccgatagtattatggtggggaaatgtgattgaaaaaggaaacgagttggattgttggtatcctttattaccaagaaggattagtgccaaggatattaatccatttgatgcggattggactctacaagaggcagaagatgatggatatgatgatgtctttgacacctgcccagattgtgggtgtggtataagtttaagaaatgatggtggaaatggtttttgcatagattgtgcttggaatcattagaaaagtaaccggttatatataataaaatggttggaatcaagcctccaagtccaaaacagatttggaggttttcttctgcccatttttatcgggaagtaatttcccaaataaacaatctatggtacaatatcttagaacttatcatcaagggatgagtagtggaccatagagaaagagcagagtcaatcgtaagctggtctggcttacatctaaaatacaatgcaatctttttctatgcagggacataagagagtgcatcatgtcaattttttgcagcctcatcagagaggatggaagcatttttcacttccagagtacagtgaaaattctggaaagtgcatctcaattaccctatcgacacatatagagtgcgtggttgcactacatcgggtcgatatgtaagaatcattgatttgcgcgaaggcaacgaggagagttccgaagaaacaactggctgtaaagctagtgtttatgcggaattcgacgactgcccgcgagtcgggaagtttgtaaaacttctcgacttccggcactttgagaggcatatgatgttctcgcagagtgatagaaaaacctacaaaaaggcgatttcagacggagtaaatgtctcggtcgttttggatgtggggtgtgggaacacataaaagtacaattaacattttgaagttatttaacagaatacgaagcgtgaaagaccgttcattttcaagtaattggagatgagcggtctttttctatttgcagataacattggcataattgagtagaagttattctaccggaagaacggaggttgtaatggaagagataaagagtatcagaataagcgagttaaaggactttaagaaccatccttttcatgtgcagcaggacatggagctgtgtgcccttatgaaaagtattgaagatgagggtgtgattgtacctttgcttgtaagaccgaatcctgacggagaaggttatgaagtgattgcaggacacagacgaaaggcagctgccggctgggctggtcaatgatgaaaacaatttctcaggtatttgtcacaggtgttaaagagattacaacaactccggcacttttcggtgatgtacttgagtatgaaggaaaattctataaggttggcactgtgaggcaggaggttaaagatacaaaggttgaagatgacagcttttatctacttactcttgcagcagttgctggtaaacggaggcggactgaccagtgagctgccgagccacctgatgaaccatgaagtgaaaaaaggcgttaccaatgtttatcatgcacataccacgaatgtgatcgcactgacatttgtactgacgttggaggataaagtatttactagagaactctgggagatggcgaccgagtgcccggttgtatttccttccggaatcggtgtagtaggatggatggtgccgggcggccgtgagatcgcagtggcgacaagtgccctgatgaaagaatatgatgtggcaatctgggcgcatcacggcatgttctgctcaggggaagactttgatcttacattcggattaatgcacaccgtagagaaatccgcggaaatccttgtaaagatgctgtccatgagaccggataaaagacagacaatctcacctcagaatttcagagatttggcgaaagattttaaagtaactttaccggaaaagtttctatatgacaaataatgtacatatcacatatttggcgtatcagaagcatgaagcatgtttcgatattccataggcgtacatccgtatttcttgcggaacagctgaaagaaaaagctggtattctgatatccgacggcaaggctgatatcatttgtggaaagtgcggtgctccttaacaattttgccgcctgagagagccgctgtgtctggaccagctctttgtaagtggttccggtatgctggcgtatgtaggcagagagatagtttgggtgcatattaaaaaactcagctgtagaagaaagggtacagtccgcaaagtttgtttcgatatatcggagtatggtataaatctgatccacagaggcgtgatccagaaccataccgtgctggaacagattgatcatctcgcaggtaatcagcgtaaaaagactgtctaaaaaaggtccggatgttacggacggagaataaaattcacagagaaaatggttggcaagatctgccagccggttttgtttttgttccggggaaaagacaatatacctgctttcctgcatcgtggtgttcagagcctcaatgaaaaagtgtgtaaggtaattatcctgagacaggcgttcaaaaaaagtaccgttcagatattcgcgcgtcagcagaaaattgatgataatatcattttctgaacatcttttgacagaatgaggtgcattctggctgatcagaaccatctgcccggcttttagcctgaatgtagtcttatttatcgtcattgtgcaggaaccagaataaatataactcaactccagccactcatggatatgcagaggtacgttttcaaaacgatcctgttttacaacagcgaagttgtaataactcggaagaactttctttgaaagaaataaagaacgcagatcttcaaggttcgtatcaaaacggtaacagggtgtatcaaacttacctttggcaacaggaaattgtgaataatctttctttacaccgttcagacgctgggtttcttcgggagtgtgttgcttcagaaattgattcaatgcagataatgtcatcatatataatctctccttttcgagatatgaatgaactgtgattatagtcatcagcagtttatttaacctgtctaaaatataccatattgggggcaaaggtgtacagagtaatctcggatatttattaagtttggtcggtaaatcacttatgtttcgttgatgtaattttagtctgtataatgtaagatatcagtaagaaaaggaggtataggttaggatgaagatattttttgcagtagtggtgattgttttattatttgtaatcggtgcgacattatatgtctacaaaaaaagtgccatgtttttaccggcacttcttggcatctgcggatttccaaaaataaaggaaagcagctattacgatgaaaacggacatttccgtccgggaacgggggaggacaaagttggatttttcatgcagcatccggtattcggcggttttaaacatatgtttttcaatgtggaggacaacgtgctgaaagccattgcgcctataaagtataaggatttctttaaggcgcagggccgtgaggaacaattggatgcagccttggaatctttcaattatctaaccggacttgttgagaaaggtcaggcaaggctggtgtcggatctgtatcctgcggaagcagtgaagggtcatccgtacaggtcacatctgacgggaatgttttatcagggacaacagggaaaaccacttgccattgtagttccgggaggcggatttatcagtaatgtaactgattgcgaggggtatcctgtggcgatgaagctgcataaaatgggatattctgttttcgtcgtaagctatccggtcggcagacagttgggtgagacagaacaggtaaagcagggacaggctgccgcgagggaactgacacaagtgatccgatatctgacggagcatcaaaaacagttttctgtaaacatggatgattatgccatctttggtttttcagcaggaggacttatgaccacggcgtattcatttgccaattatgaggactgctgccacaagaatcatctgccaagaccgaaggtgatcttccctatgtatggtctggactgggatatcaaagctttgccggaggacaagggactggcggtattttctatcgtagggcgggatgatgagttcggttttgcaaatgtggaagataaactgccggaattagagaaggtactgggcaaagaaaatgtgtcggtcagaatcgttgacggactgggacatggatttggaataggaaatgaaacaaaagtgaaaaactggcttcaggaagcagtcatcttctgggaagcccacagataggaacagataagaatttatttaaggaggatttcataatgagcagaaacttgaaagaattgatcagacagatgacactggaggaaaaagcaggactttgttcgggagcggatttctggaacacgatgggaatcgaaaggttagggattccttccgttatgatgacagacggcccgcacggcttgcgcaaacaggaaggcgcggcagatcatctcggcctgaataaaagtgtgaatgcagtctgctttccggcagcctgcgccacggcatccagctttgacgtggaactgatggaacgtatgggacagatccttggggacgagtgtcaggctgagaacgtgagcatactcctcggccctgcagttaatatcaaacgcagtcccctctgcggaaggaattttgaatatatgtccgaagatccatatctgacaggaaagatggcgtcagcatatatccggggcgtacagtcgaaaggcatcggaaccagtatgaaacacttcgccgcgaataatcaggaaacagaccgtatgcagatatcgtcggaagtatcggaacgggctttccgggaaatttatctgccggcttttgaggaggcggtgaagaaagcgtatccaaagactgtgatgtgcagctacaataagatcaacggagtattttcttcagagaataagaaacttctgacagatatcctgcgggatgagtggggatttgaaggatatgtggtcagtgactggggagctgtaaatgaccgggtgaaaggactgaaagccggtcttgacttggagatgccgggatcaggaggatataatacaagaaagattattcaggcagtggagaatggagaactggaggaagaaattcttgacagaacggtggaacgcatactgaaagtagtcttctcctacacagataacaggaaagcggagactgtatttgacagggaaaaggatcacaaagcagcggcagatatcgaaacagagtgcgccgtacttctggaaaacaggggagtgctgccgctgaaaaaagaacagaaagtagtctatatcggggaatttgcaaagaaaccgcgataccagggcgggggatcgagtcacatcaatacggacagcgtagtgtcggctctggaaactgcggtgagaaaaggcagggcagtggagtacgtgaaaggcttctcgtcagagcgtgacgagatgacagaagaggagctgaaacaggcatgtgaagcggcagcgggcgcagatgtagttgtaatctttgccggactgccggacagctttgagtcggaaggatatgacagaacatccatggaactgccaaagtgtcagaatcgccttatagaggctgtggctgagatacagaaaaatgtggtagtggttctacataacggaagtcccgtagaaactccatgggcggagtctgtaaatgccattctggagatgtatctgggaggagaaggcattggggaggccagcgaccggctgttatttggggaggcaaatccgggaggacgtctggcggagacgttcccatatcgtctggaagacaacccgagttacctgaatttccctggagacggcaggactgttctctatggagaagatatctttgtcggataccgttactatgatgagaagaaagtaccggtacgctgggcattcggccatggactgtcatatacggaattcagctacagcaatatgaaactctcttctgcggaaatgaaagatggagatattctgaaggtgagcattgatgtggagaatacagggaagagggcaggaagtgaagtggttcaactctatgtcagcgacaaggacagcacggtgccaagagcagtgaaagaactaaaagggtttgcgaaagtatttctgaatccgggtgagaagaagatggttacaatggaactttgcgcgagagattttgcttactacgagacaaagattcacgactggtacactccgtcaggtacatatgagatccagatcgggcatgccagcgatgagatcagagaggctgcagaacttacatttaccactgatgtgctgctgccgttcactgtggatatgaccactacaatgggggaattgatgaaccacccgaagacagcagggaaaatgatggagtatcttgaggggatatcacagggagaagaacctaagaaagaagatggggaggtacagcttgtgactccggaaattattgcgcagatgccactgaaaacatttttaagcgttattccgggcgaagcgatcgagcagatgatcgtggagttaaatgctctgtgtgcagaagagggaaagtgagaataaaatatgaatcaagataagataaaaatgagagaaaagctgtcatttgcaatggcaaactttggaaacattccggttatgacactgatcaacggatatttactaattttttataccaatatatgcggcttgagtcctgctgcatgtgcgacactgttcctgatcgcacgctttctagatgccattaacgatccgttagttggatttatgatcgaccatcttccgaccagaaagatgggacatttccgaccgacattgattctgggaacaattctgtgtagcgccaatttccttctactttggtttggacctatgttatcaacatcggggaaactggcaatcgcatatgtatcgtatattctgcttggtgtgttgttcccagtcatggatatttcgctgaacagtcttctgccggttatgacagaagatatgaaagaaaggaacagcttaagttcaatcaaagggcttgcatacgtgatcggggcgcttgtaatcggtgtggcagctccacttattcttggagatacttctaacaaacagggatatattaatcttgttctgatcatgacagcagtgatttttttcttctctattataggaaccatgggagtaaaagaacgtgtaaaaccacagatggagaacagctattctgtaaaagaattattcaagattctcagtcagaagccggtgtacattacattccttgctgtactgttatattcgattggaagcaatatcgtgaatgcagcaaatacatacttttatacatatatttttgaagatctgacgttggcgtctattattacgcttattacatgtgttactgtttttccggctacaatggtcattggtaatctgattggaaggtttggaaagaagaaaatgtatgcgattggacttgcacttgcaggactggcaccaatcatccgtctgttggatgtgaggaacattccccttcttattgtctctgtattgattgcaggaataggagctggctttgcagcacctcttaattatggaatacaggcagataatacagattatatcgaagtgtctatgggaattagggcagaaggtgctgtcgcatctctttccagctttgtctccaagtgtgcaatgggaatcggtggtgcgattccggggtatctgctgcagttagcaggatttgacagtaaggcggcagtacagaatgacgatgtgattaatgtgatcgtcctctgtgtgctaatattgccggcaatcgtaaatgtggtggccattgtgatcttctcaaaaggttatcctattaccaaggaaaaattgaatgagcagatatgtctgatgagggagaaacggtcaaaagcgggtataagtgaataagaatgatagagaaggagtatcagcatgggaaagatttatgcagcaaaaacaaatcatatcacaaaccctttagggttttatctgaaaccgttggtattttcatggaaagtgaaaggatgcagaggacaggaacagaaatatgcaaggattgtaatcagcaagaacaaaacctttacagatatctgttacgatacaggtgaaacagagttggacagcctctctacaagagtagaatttgaaatacagccgtatacaagatattactggaaagtcattgtgacaacagatgtagatgaagtaatcgaatcagatgtacagttttttgagaccgccaaaatggatgaaccatggactggaagatggattacttgtgacagcagtcaggaacggcatccgattttctcaaagagaattcgtccggcaaaagaagtgaaaagcgcaagactgtacatttgcggcctgggattgtatgaggcatattttcttggggaaaataaagaaaatcataagaaaatcggtgatgagtatctgactccgtactgcaataattatgaccagtggatccagtatcagacgtatgacatcacagaacaggcagaacgaggaggtgtgctgtctgttcttctcggaaatggttggtataaaggcaggttcggtttcaatgatccggagcgggaagcatattacggtgacgagtggaagctgattgcggaggttcacatagagtacaaagacggaacgaaagatgtaatcagttctgatgaaacctggtcagttacaagaagcaatttgtggttttccaatatctatgatggtgagagaagagatgatacgctgccgccggttgaggagtctcctgcgcggatcgcaaaggctccgaaaggccggcttatggaacggttatctcttccggttaaggtacaggaggagatgaagccggcagaactgatccatacgcctgctggagaagatgtatttgatctggggcaggagatcgcagggatcttccggctgcgtgtacatgagccggcggggacaactatcaggattcagacgggagaggtgcttcaggacggatgtttctataacgagaatttaagaactgcactttcggagtacatttatgtttctgatggtacagaaaaggtgatcactccccattttacatattatggttatcgatatgtgaaagtgaccggggttagggacctttcgtgtgaggattttacggcgcttgttctttacagtgattatgagagcatcgggacaattgagacagggaatgatcttgtgaacaaattaatctccaatatcgaatggggaatgaaagggaactttctggatgtgcctacagactgtccccaaagagatgagaggatgggctggacaggagatacacaggtattttccgcgactgcaagctatctggctgatacctatgcgttttaccgaaaatatttatacgacctgtatcaggaacagcttctggcgggcggaatggttccagagattgtccccacattcggaccgacaaaatgttcctgcgcatggggagacgccgcatgtatcatcccctggaacgtatatttgttcagcggggacaaaacaatcctggaaagccagattgagagcatgaaggcatgggttgattatattcgcaggattgacggagaccatcatggatggagacaggttttccattatggggactggcttgctcttgaccgtacaggcgccgccgcgaacagtgtgtatggagcgactgatgaagcatacattgcagacatctactacgcggcaagtgcacagattgttgcaaaagcagcagaggtgcttggactggaagaaacgagacaggaatatcagaaaatcgcagaccgtcagtggcaggtcgtgaaagaagaatattttactgctacaggcagatgtgcggtgaagacgcagacagggcttattcttgcactgaaatatcatctgtctgaaaatgaagagctgacaagggagatgctgaaaaaacttcttcgggataataaaaataaattaaataccgggtttgtaggaacaccgcttttgtgcaatgtcctgactgatcatggaatgacagacgcggcataccggctgcttctgaataaggaatacccgggctggctccatgaagtgaagctgggagcaacgacggtgtgggaacgttggaattcactggatgagagcggacatgtctccagcacggggatgaacagtctgaatcattattcgtacggagctatattggagtggatcttccgccatgcagctggaattgatgtgatggaacagagcccgggaggcaaggtgatgcgaatcagtccaaaagtaaatagcgaactgaaatatgtaaaagctgtttatgattcggcaaccggatgctatcagtgcggctgggagatattagaggggaataaaatcaccatcactgttacagttccgtttggaggcaaggcagaagtggttctcccttatgcaccagaatgcatatatgaggatatagaaaatccattatttgaagctgtggaaaacggaatttgccatgtgaaagccggagaatatgaagttgtatatgaagcatcagaaccattaaaaaagagatatagcatagactcgacaatggaagaactgctgaaccatccggatatccgcgcgtttctttctcaaatggtggaagtagatatgatccccgatattgcatatgggctttcgcttagagatgtcgcgaaaacattcgcaggagaaatcaaaccagacgaggcacaaatgttggataaagcactggcaaaattctaatcaggagggttgctatggagcttataaggcttaaagtaaacagtcaatacagaccatgcgtggacgaagcaccttatttttcatgggtgatcaccagtagcaaaaagaatgtgatgcagacatcttatcatattacagtgacaggtccgggagaagtagtgtgggattccggggtggtagaaagtgataaaagtacttttgtagagtacaacggaaaaccattaaaaagtctcagtgactacaactggacagtggaagtgacagttaataacggagaaaaggcggcggcatcctcatcctttgagacaggatttatgaagaaagaatggacggccgagtgggtgaaatctccgtttccgatgaaaaaggtaaaacccggaaccggcgggcagaacccggcagaatattttcgcaaagaatttgatgcacgagacggtgtaaaacgggcacgcgtctatgccacatgccacggagcatatcagctcagcgtgaacggaatacgtccggacgacagagagtttgctccggaatttaccgtctattctaaatatctgtgctaccagacttatgatgtgactccgtttttgagagagggaggaaatgtcataggaatgctggtgggggacggctggtatgacagcgcgaactttaaaccgagaagcaggaagtttaaagccgaacattctgtgttatttcagataaagattgattatgaagacggaacgagtgaaatggttgtgtccgatgatgcggtgaaagtttcggaaagtccggtccggtcttccgatctgtttgcaggtgaactctatgacgcacggatggaacaggaaaactggaactgttgcggattcgatgacagcagctggaaagcaggtatcccatgcaaaaaatcttacgccaacctggtagctcagtacggggaaccggtgcgcccggtaaaagaagtgccggcagtaggaatgacagtcagcccgaaaggcgagacgatcattgactttggacagaacttggcaggtgttctgcgggtaaaaagcaaactgccggccggaacaaaaatggtattagatcattttgaaactcttgatcaatatggaaactatttcaacaatattttcatgtcagagaaaacagggcacaagcaaagtgatatttatatctcaaacgggaaattcacagaatacataccgcattttacatatcatggattccgctatgtgagagtgacatgcgatcagccggtgagcccggaggatttcacagcgattgtcctgtcttctgacaatgaggatctgggaacttttgagacatccaacgaagatataaaccggctttacgaaaatacaagatggtctcagcggtcgaatctgttttcaatccccacggactgcccgcagagagaaaaaggcggatggaccggagatatccagatttatgcaagaacagccatgctcaacgaaaatgtaaccccgtttctgacaagatggctgcgtaatatgacctgcagtcagcagaaaaatggggcgatccccaatgtgatcccccttaccggaatctatgaattactggagaaactgaatcggatcgtatatcgcaattttgaaccggtgggagaagcaggatggggagatgccgcctgtatcgtaccgtggagcatgtatcagcttacaggaaatatcaggatactgagagaacagtatgacacaatgaaaaagtggtgcgactatatcatcaacactgcaaagaagcgtagaggcaagatgaaacatccaaaagaaattgaccagtatctgtggaatacaggacatcagtacggggagtggctcataccgagccagacagtaaacggagcagaccaaagcgctgcaaaacctgtcaatacttctgcatactgcgcgccaatctttggatggaattcctgccgaatcatggcagatacggcagcactcctcgggcatacatcagacgaattatactatgatgacattgcgtccagaatgaaatctgccattcaaaaaggactgatcgatgatgatgggaagatgcctcttgattttatgggcagttatgtgctggcaatcgcatttgatcttgctcctgaaaggaagaaaaaaagtatcgccggacatttgatccgcaagatagaagaaaacggggattgtctggatacagggttcctgacgacgccgtatctgctggatgcactctgtaagatcggcaggatggacaaggcatataaaatcctgctccagacaaagtgcccgtcatggctttatgaggtgaagcagggagcgacaacaatctgggaaaattacatttcttacaaggaggacgggtctccggttatgacaagcctgaaccactatgcctttggatgcgtggacgactggatgttccggaagataagcggcattgatatggctgctcccggatttaaggagattgtaatcgcaccggagccggacaatgcgtttaccagtgtaaaacgtacttatataagtgagtatggggaaatcgcagtcaggtggagtatggacgaagggaaatttaagctgaaagtaaaaatcccctgcaacacgactgccgttgtaaagatgccggatggcagattatacaaggtaggaagcggaatgtatcagtttgaataaagaatcaaagaaaacaaaatgacagtatttgcgagaactgaccgataaatacagacggtcagttctcttaatatgaaagttgaaaataataaggagttaaggattatgaaaaagaaaatattgaagatcaccttaagtatcgttttaattctgattctggctgtgggaatcggcctgacatatttagtaggagcagtaggcggtggaggaccgtttgattttgtctggaagaataagctgaaaaaaatgccgggaaacgcagaaaaatacagtctggaaaatatagaaccgttagaaaacagccctcttggagggaagcgcatctgctaccttggatcatctgtaacattaggtctgtactcaatggatgtttcttttgcagattatatctcttacagaaatggctgtgagtatgtaaaagaagctgtcagcggtactactttagtagataacggaaagacgtcttatatccaaaggatgaaaaataatatcggtacagatgagaaattcgatgcgtttgtctgccagctttccacgaatgacgcgtcgaaggaaatgccgatgggagaacttagcagttcagaaaatctggaggattttgatacacagacgataacaggagcaatggaatatatcattgtatatgcaaagcagacatggaattgtcccgtgatcttttataccggaacaaaatatgacagtaaacagtatcagcagatggtagatgtattgtttgagcttcaggataaatatggaataggcgtgatcgacctttggaatgacgaggagatgaatgacgtttctgaaaaagaatatgaagtttatatggcagatccggttcatccgacgcaggcaggatatctggaatggtggacgcctaagatggaagaatacttatatcagtttttagaaagatgatgattatattaagtttcgtcggtaaactacttatatatcgttggtgatttgccctttggaattatttataattgagtcaaacaatgaaaggacggataacgaaatggaaaattcagttacaaaaagagaaaaaatcagttatggtttgtattttatgggacagaatgtattctatggactggtaggatatatgactacatattttacagatatcggcataacggcagcattggttgcgatcgtggcgcttatcacgaaagtgtgggatgccatcaacgatccgatcttcggtatgatcatggataaggtgaattttaagaaagggaaattcctaccgtggcttcgaatatctgtcatagcgattccggtggcaactattcttctttttataatacctaccgggatttccatgatggctaaaatcatatgggcaacacttgcttatatgttatgggatacagcctataccctttgcgatgtaccgatttttggtattgttaccacgatgacaatagaccagaaggaacgtgtttcactaaacagcataggaagaatgtttgctatttttgcaggtattgttacaggaattgtcctgccgttggtacggcagcggttaggcggctggtcaacaacagtaattgtgttatctcttttgtcatgtgttatgatgattccgatttgtctgttcgcaagggagagagtaattgaaaaagaaagagtcctgaatgacggggcagaagaaagttatacattgcgagatatggtagaatgtctgcggaagaacaaatatttattgcttttctttgcggctccgctcatcagcagcctgcttaatgttggtgcaaattggggcttatacgttgcccggtactgccttggcggtgaagaagctgcttcatatgtttcaatggcagtgattattccgaccttaatcggtgcgtttatggcagtagaattatgcaagaaatatgataaatttaaagtcttctatatttcatatgttttcgctttacttttgggaatcgtaagattcattgctgggtatgagaatatgatggtgtatgtgattttaaatgccttaggaggaattccgctgggaatagcagttatactgcagtatcagtttacgccggactgctacgagtatggacagtacaagacaggattaaaaatgcgtggtgtaacgtttgcggcgcagacattttttacaaaattaaatggagcgatcacaacagcagtcagtgtgtttgcgttaactttaatcggcttccgagagggagaaggcgttgttcaggcggcaggatttgccgataaattatggacattcagctgtcttggcagcattatcgggggtatttgcactctgcttatacttcgtctttacaagcttaatgaccatgatgtccagctgatggcaaaatgcaacaatggtgagatcagccgtgaagaggcagaggcacagatgatcaatcagtattaagaaaagaatggagaacttttgcgatggacagaataaaggaactgatttcaaaaatgacgctggaagagaaggcaagtctctgctcgggcgctgataactggcatacgaaagaaatcaaacgactgaacattccgtcagttatgatggtggacggccctcacggactgagaaagcaggaaggggaaacggatcatctgggattgaatgaaagtgtgaaggccgtttgtttcccggcagcctgtgcaacagcctccagctttgatgttgacctgatggaacggatgggagagacgctgggagcggagtgtcaggccgagaatgtaagcatactgcttggcccggcggtgaatattaaaaggagcccgttatgcgggcggaactttgagtatctgtcggaggatccatatctggcaggtaggatggcatcggcatatatccgcggagtacagagtcagggcgtggggacaagcattaagcactttgcactgaataaccaggaaacactccgtatgacgatatcttccgaagtgtcagaacgtgcgctcagggaaatctacctgcctgcgtttgaggaagcggtgaaagaatcagctccaagaaccgtcatgtgtagctacaacaaaataaatggagaatatgcttcggaaaacagatatcttctgacagatatcctgagaaaagaatggggatacaaaggctgcgtcgttagtgactggggcgctgtaaataaccgtgtgaaaggactgcaggccggactggatctggagatgccttattccggaggatacaatgacagacagattgtgaaagcagtacaggagggaagactggacgaagctgtgctggatgaagcggtggagcgggtattgaatgttgtatttgccggtgaagagcagcatcgtccggaagttatatctgataaggaaacagatcataaaaaagcagctgatattgagacggaatgtgcggtcctgctggaaaataacggtatacttccgctgaatacagacagaaaggttgcctatataggggaatttgccgaaaagccgcggtatcagggcggcggctccagccatatcaatccgttcagggttgtttcggcattggatgctgccagagaaaaagggcgtagcgtgacttatgcaaaaggattttctatggaaaatgacgcgatgacggaacaagagctggaaaaagcgcttcggactgctgcagaagcagacgtcgcggtaatctttgccgggctgcctgagatatttgagtcggaagggtatgacagaacatccatgaagctgcccaaatgccaggaccggctgatcgaagaagtgttgaaagtacagcctaatgttgtagtagtactccacaatggaagtccggtagaactgccatgggcagaccgggtaagcgcgatccttgaaatgtatctaggaggtcagggcgttggcgaagcctgcgactggctgttattcggggaagcgaatccgtccggcaggctggcagagacattcccgtaccggctggaagataatccgagcttccttcatttcccgggaaatgaaaagcgggtgttatatggcgaggatatctttgtcggatatcgttattatgatacaaagaaagttccggtgcggtatgcattcggacatgggctgtcttacacggaatttacttatggggatctgactttgtcatcggctcaaatgacggatgaggatatactgacagtttctctcaaggtgaaaaattcaggaaagacagaaggaaaagaagtcgtacagttgtatgtagctgacctgtgcggcacaccggagagaccggtcaaggaattgaaaggatttgccaaagttcatctcctgccgggagaggagaaaacggtatcgatggaaatttcggcgaggaatctttcctattatgaagaacgtctcggggactggtatgcgccatccggaacatatcggatcctgatcggccatgcttctgatgacatccgattacatgcggatattgtgtttaaaacaaagaaaaaactgcctcttcgcgtagatttcacaacaacgttcggagaattattggatcatacgaaaaccgctcccgttattacggaactgctggcgcctttggcagcagcggccgcatcagcagaagggatgagtgacgaatacaagaagctgggagagcaagttatccgggaaatgccgctgaaatttctgctggggcagatgccgggagagcaggtggaacagctgatcgggcagctgaattgtttacttgcacaataggataattgaggacgaggtagacattatgtgttccgaggacggagacgacacatgtggagacggttgtcttactttccaagggcgctaaaggtccggtggacctttgctcagcgcggaccgaagtggaacggagactggtcgacagcagaaaagtgaaggtggacttctctctggagaatatggatttatctgaatttaagggaaaagcaacttatgagcagataaaggcatatgtacttgaaaagacaggactgaaggtttcttcgttgtatattgcgcagattaagaagaaatgtggattggatgtgggagagaattttaatctgcctaagtcagagaatgcgagacagccacaatgtacaccggagaaggaagaagcgattatgcaggcgtttaagcattttggaattgtatagattgtggataagtagcatcatgtgttaaaaatatagtgaagtatggaaaaaaggacattccggaactgtagattttacaggtaaggggatgtcctttttactgatatggaagtgttcaagggacaaggtaatgatactgaagtattaaggctgactgcttttggagaagtttagcctgtaaaagatatcagcggtatttcgattgtatgaaagctattgtaaaaaataacacaacatgacataatcggattgactaaagtaacacaaatatttataatatagacaaaacgaaaatgacatgaacggaggacaggataatggagaaaactgtaacactcgaagaggcattaaaaagaattgaggagttggaaaaagagaatgcagaacttcgggaggaattggagtattacagaaatcgtaagttaagcggtcgtcagaaacataacgccaaatggatggcaatttataatgattttgttgttgggtatgagagcggcatgacaattgtagaaattgcgaagaggaacaatgtcagtgagcggacgatttataggtataaagcgtattatgacaaaatgaagaaaaaagaagaatagaccattttaccgacgtcagtaaaatggttcaatgtgggaggagaaagtttagtatggaaaagaaaatgattaactgaaataatagaacaataataacaaatcggacatattgctgatgtcggcactatgttcatatgagaattgcggtcacagtttgtgaccgcaaaacaaggaagaaaatatatggcagaagataaaaagaaagaaattgcagtaattgaaattacagaagaatacatgaaggatcggctttatgaattcagagggaaaaaagttatgcttgattcagacttggcagaaatttatgggtatgaaaccaaaaattttaaaaggcaggttaagaataacattgccaatttgaaggcgatgattttatgtttgaattgaatgatgaagaagtggaaaatctttcaaggtgcaaaaatttcaccttgaatatgggaagaggttcaaatataaaatacaaaccttattcaggttgatggctatagccttgatgcacagaaggacaagcttaggaaatatgcagaatttcaggagatggagattgtaggagaatattccgatgaagggcatttcggtaagaatataaaaggtcgtcaggaatttatgcagatgttgaatgctattgaagatggcaaggacggagttgatttcgtccttgtatttaaattatcccgatttggcagaaatgcggcggatgtacttagctctttacagcttatgcaggattatggtgtgaacctaatctgcgtggaagagggaattgacagctcaaaagaagccggtaaactgcttatatctatcattgcggcagtagcagagctggagcgggaaaatatcagagtgcagacaatggctgggcgtgagcagaaagccagagaagcccggaagaaaggataagatggaaacgcagcgatggtttccgtcttattttttgaattcaaagcgctgaaagactggattttaaatggagaaaataaaaagtgacagaaaactttttcgtaaattgcgaaaattacgaaaaatttcgttgcgcacatgggaggatagtactataatggaagtattgacgggcaccagagaaggagaatggttatgggaaaaaacgcagcggaaggtaacaggaaaaagggaaaaattgcggaggagatccgcaaaagaatcggcagaagcgtgttgatcgcgtatattgtcgtggaagttatcattgtgattatcatgggacagacggtttattacaataaacaagcgcagctcaccctggagtcggaatcagcgtccaacagtctggcgggattttttgaaaaatacgagagagtgacacagacgttggcgttaaatccgcagattcagtcggttttatcggagacaaaggcgggagataatattttaagcgcaaaagcgatgggagatgtggaaaaatatctcgtcgatgctgcaggagcggacagcgagaatgtgatggcggtgtggattgcggatctggatgcgagcgtcattacgcagtcggacggatacacttccccggacggctgggacattacagggcgtgcatggtattcctgcattgagaccgggaaaacagtcctgaccgaaccgtacatagattccagcaccggagagattattctgagtgcggcaacgccggtatacgatgaaggcggcaatgtgcttggcgctgcgggaatggatatttcgctggatcatgtgacagaggtattgagcggttatacaatcggaagcaacggatacgtctggctggtgtcctcggacggaatgctcatctatcatccgaatgcggaactggtgcagcagaacattgcagacgtgaatgtttctgccaatgtggtcaatgcgatcatgaatcagacgacggagtttttgaaatacaaagcggacggtaccacaaaatacggttccgtacagctggtaggagaaacaggatatcttgtggtcagcaatatgccgttcttagaatactatcagatgctgtttgcaacaatcggtgtgcttctcgtaatttttgcactggggattattctggtaatgcgcagtatcgacaagagcgcatatgctttatcaaaaccaatagcagaattaaatgagacggcaagcaggctggcagagggagatctggatgttgaactgaacgtcacggcagagaacgagatcggagaactggcagaatcgatcggggcaacggtcgcacgcctgaaagaatatatcgcttacttaaaggaagcatccggcgcactggatcagattgcagatggaaagctggagattcatctcgaacaggaatatgttggagaatttcgtcaattaaaggaagcacttctgcacatctcaagttcgatgaatgatgtcatgaaaaatatcagtgcaagttcccagaccgttacttccagtgccggcgatctggcaaatgcggctcagcagctggcagagggaagcagcacgcaggcggcagcagtggaggagctggtcgcaacggcaacatccgtggcggagcaggtggaagagagcaagaaagacgccctgcaatccgcggaagagacccaaaaagtaacggctatgatggaacagagccaggataagatgcaggagatgatggaagcggtacagaagatccacgagacctccaagcaggtggttggaattattgcgaccattgaggaaattgcagaccagaccaacctgctgtctttaaatgcatccatagaggcggcgcgtgcgggcgaggctggaaaaggctttgcggttgtggcggatgagatcggaaagcttgcgcaggaaagctcaaaagcggcaaatatgacacgggaactgattggtgtctcgatggaagagatcaataaaggcaatcagattgcagatcatgtgatggattcgttaaagacggcagtggatgcagtggacaacgttaatggaatgatccagaaaacggcgggaaatgcggcggatcaggcacagagcatggagcagatccgcgtgggaatcgaggagatctcgcagggagtacaggacaattcggcgattgccgaggagagctccgcaacctccgaagaacttgcatcccaggcgacactgcttaatgaactggtgcagcattttgaactgcagccataaaaacaccgaatcccttttgctgacattattttcctaaagtggtaaaataacacaaaagcagcaaaggaagtgtgacagatgaagatcaagtttgcacagacaatcagaaattatgaccggaagaatcttggaaaagatctggttgccggactcatcatcatggcggtctcgattccgatctccatgggatacgcgcagattgcgggacttccgacagtatacggactgtacggctcggtgttcccgattcttctgttcgcgctgttctcgacatcaccgcagtttatttttggcgtggacgccgcgcctgccgcgctgatcggagcggcgcttttagatctgcatatcgagagcggatcgaaggaggcgctggcggcagtgccggtgctgaccgcgtttgtggcgttgtggcttttcgcgttttacgtgatgcgggcgggaaagctggtcaactatatctcggcgccggtgatgggcggctttattaccggcatctgcacgaccatcgtcctgatgcaggtgccgaagcttctggggggtaccgcggggacgggagaattctttgagcttgcggagcatatcgcggagacggtgggagagatcaatctgccgtccctggcacttggcgtggctgcgcttgtgatactgctgattgcaaaaaaggtcatcccgaaattcccgatggcggtgcttttgatggcagcgggtgctctgatgacaaagtatctgcccctgcgcgcctggggcatcaagacgctggatgccatggagccgggacttccggtctggagcctgccggattttacggcggtgccggtaagggaggcggttacgatcagcctgtcggtggcggtcgtcatcatggcggagacgctgctcgcagaaaataattttgcgcagaaaaacggataccggatcaacgataatcaggagatcctggcatttgcgatgggcaatcttgccgcggcgctgaccggatgctgcccgatcaacggctcggtctcccggacggcgatgggagagcagtatcaggcaaagacacagctgaccgggattgtggcgggactttcaatgatcgtgctcctgcttggcggtaccgggtttatcggctatcttccggtgccggtgctgacggcaatcgtgatctccgctctgcttggcgcgacggagtttgagctggcggtccggctgtggaaagtcagccgcacggaatgtctgatctttgccggcgcattcttcggagtgctgatgctcgggacgatcaacggcgtactgatcggcatcatcctctcgttttccgagatgattatccgcacggcaaagccggcacgctgttttctgggaattcagccgggacaccggcatttccgtgatctgaaagagggcagccagatccatgcggttgagggagtgttaatctaccggttcagcagcaatctgttttttgccaacatacaggtattaaaacaggatattgaagatcacgtgaccgatcagacgagagcggtcattctggatgcgagcggcattggcagtatggacatcacggcggcggacggactgggaatactgtatcagtcgctgaaagaaaaaggcatccgcttttacatgacagaacacatcgccgatttaaacgaacagctccggaaactggggcttggctacatgatcgaagaaggaagcgtgcgcagaacgatccacattgcgttaaaagatatgggaatcaagcgcccgtatccgctggagggcggtgtggacaatgacgaccgcagtgcttcgagaaagcgcgcggacaaccgcgtgcaggaatttgtctgggcgtttggcgcggagacggaggaacagattgaaaaacagattcttttgcagattgaacagctgaaggagggcggcgatgtggaaaacctgctgcacggcagatggtcgcacatggaagcgatggatgaggacgagtggctggaacatctggaagaacatttaaaggagatcgtgaacatctccggaaaggatgagaagacactcgcaagacgtctggaggaacaccgcagggaggtgcatgaccgcattgcaacagagcatccggagcttgcggagcgcttcaaggagcgcagacatgtgctggatgagcacttaaagcagagaagaccggaggtctatgagcttgtggtgagcctgcgcgaaaaggaagagacagatttaaaataaagaaataacaccattgcttaacagggtgccggagagcgcaatcagcctctcaagcggcactctttttttgtctgccacccactgccggtaaatattgacggaggtgacgcataaaaacgtgttgatgatattctgctcctccctggaaaatgcggcgtagggattatgtctcgtgcgattgtgaatcatggtgtttaagaataatttatcggcgaattcgcggtagcccggtgcgcataaaaggcgctcggcgtacggctcctgtctggcggtaaactcgaaaaagacgcggtttacttccgtaaaaggcgcatcgatcgggagctggtcgatggcatggtaatactcttcggtgatctgcccaaggagatcttcaaacagagcctcgatgcaggtatagtgcagatagaacgttttccggtggatcagaaatacaacgagtgccatgctcagaaaatggatgaagaatactggcaagtgccgcggcagttgtgctatactgggagacagaacgacacaacagaagaaagactaactattaaaagtcaagtctgaaaatgaaatattttgaatgaattgcagaaatgcatttcagatatatttgtaccttgaaaactgcatgacaaaaagagtgtcattagcggcactcag

SEQ ID NO: 10 - DNA, 206823 bp, Roseburia hominis
cccatccgcccaaaacagatactcgtgtctatgattttataattaaaaaagagaatgaaggaaaaagtaagaaacaagccaaaatagccggtttaaataagtttttgcaaatctattatgcaagagtaatggaaatatataagaatatagtatagttgcataagaaaaaagcctgaataatcaggcctatttcttatgcaaaaaaatcaaaaattgtgttgacatctcttaacaggtctaaaaagtccgcccattgtctccggtgtgtcggacatgcacccgtcggattgtccaaacgtggaatagacacgaaatccgatgcagacattcaaccggaagaaatgctcacatttttctccaacgaatttccctctgcattttcatctgaaatcccacggtgtgatcttctaataatattactaattacccaaaagaattctatgcttattatgacaattccttctgttttctaatcgtgccgttcctcatcacacgcataggtctcacaaaatcttcccgaaaatgcaggagactcgccacccgcatacaaatgcgaggtatctccgaacccgcagacacggaaagatgccacgccgggacggcgctcctcggtatacaccgtggtgacggacgtcggcgccgcgcaggtgtgatgccacagaatcatcggtgacacattcatcaggtgcgacagcagcacacactccagtccgaagtggcagaagaacacaagcgtatcgcggttcgcctgtgcgacacggtagatgtcgccctcgcgcacatagccgtgctccgccagcagggcatcaaagtttgataccacccaggcatactctgcacctacgccaccgtccggtttcttttgcacacggacgccgtttccctcatgcgcgccgggagccagtcccccacgcatagcctgctgtgtcgcccacaggtcacgccggaagaactcctcttctctcgtccagtcctccggcagccagtcccaggcaatcgactttcgatccgagcaatccggtcggtcgatcttcgtgtcgaactccctgagccacagacattcgtttgcctcgcggttcatcttctgtaacgtcagggacgccgtatccttcgcccgcccgagcggcgacacatagaactccttaacaggaagctttgacaggcgttctgacaaaagctctgcctcgcgccagcccttttctgtcagggtatcatgctcataatccggatccccgtgccgtacaatcaataatctcatactgccgcaaatgcctccgcaagatcttcaataatatcgtccacattctctgttccaatcgacagacggatggtgttcggcttgatgccctgctctaacagttcctccgtcgtaagctgggaatgtgtcgtggatgccggatgaatcacgagcgacttcacatccgccacattggcaagcagagagaacagctccagatgatcgatgaagtcttttgctgtctgctcgtctcccttgatctcgaacgtaaagatcgaaccgccgccgttcgggaaatattttttgtagagtgcctgctgcaccggatcctccgataccgacggatgatgcaccttctccaccttcgggttgttgttcagatattctacgacctttaatgcattctccacatggcgctccacacgcagcgacaatgtctcaagtccctgtaaaaacaggaaagagtggaacggagagatggttgcaccggtgtcgcgcagtaaaatggcgcggatctttgtgacgaacgctgccggtcctgccgcctttgtaaaactgatgccgtggtagctcggattcggctccgtcaaggacgggaacttgccgcttgtctcccagtcaaactttccgccgtccacgatcacgccgccgatggctgttccgtgtccgccgataaacttggttgccgagtgaacgacaatatctgctccgtactcaagcgggcggaccagatacggcgttgcaaaagtgttgtccacaaccagcggaatctgatgcgcatgcgcgatcgctgcgatcttctcaatatccacaacgtccgagttcgggttgccgagcgtctcaatgtggatcgctctggtgttctcctggattgcctgctccacctcgtcgtaattgaatggatcgacgaaagttgtcgtgataccatactccgggaatgtatgtgccaatagattgtaggtgccgccgtagatgttgtttgcagccacgatgtgctcgccagcatgcgccagattctgaagtgtataggcgatcgccgccgcaccggaagccacggcaagcgctgccacaccgccctccaaagctgcgattctctgctcgaagacatcctcggtcgggtttgttaatctgccatagatatttcccgcatcggtcagtccgaaacgcgccgccgcatgctcactgttgttaaatacataagaagatgtctggtagatcggcactgctctcgctccggtcaccggatctgcctcctcctgtcctacgtgaagctgtaatgtctcaaattttaactttctgtcctttaatgcttttcccatgttatgtttctccttttattttcattttggaagttctgtctgttgataatctgatgataacatgagaaaaccaacctgtctaatatgaaaaaaaaagcaccagttataggttattcctatagctggtgttttctaatctaatcctcttttttaaagattgcattgcgcacttttgcgagtgcattcaaaagaatcgttccaagcacacagcagcagatgatctctcccgctccgacggtcagcatgtaaaacggaatcgaccagtctcttccgccatattccatggtaagtccatatccgtagcggagtaccagcggaatgatgatgatatttgataccaccggcgcgagcgtgcataaaaacttgtgcttgcggagcagatacgttccgactgcgccgagcagcgtcgccagactgccgaagatcacatcatagatggctgctcccgtcagaaggttggcaagcaggcatcccacaaacagtcccggaattgccgccggtgtaaagtacggcagaatggtcagcgcctcggaaatccggacctgaatggctcccgatgccaggttgaacgcactgataaaataggtcagcacgacatagattgctgcaatcatcgcagcgtgcacaatgaattgtaccttagagtttctcatattctgttctcctttagttttgttttacgagtggaaggtctcgaacactcgattcatttaacgccggaaatcggcggcaagcccgcttagaccttgtttttatgggctacgcaacgtctgacattttatcacagtctgcaaaaaaaggcaacggcaaaatttctcccgtaaaatttttcacgcaaaaaactgctccgcgagcgtaatgctcccaatataaaccaccggtcctgtcatgtcaattctgccgtcccgggcaaattccaccagaagctccccgccgtgcatatgcaccgtcacacggtcgccgacaaatcccatcttgtgcgatgcggcagccgctgcacaggctcctgttcccgacgcgtatgtataacccgcgccgcgctcatagatctcgatctgaatattttcccggtcgagcacctgacagagctgcatgttgatacggttcggaaaatatctggaattttccacatacgggccaagctgcatcgcttttttctggctgacctcctcgagcatcagcacacaatttggatttcccagggagacgcaggtcgcgttatagaaattatcgccaaaaaagatcgcctcgttgacaatctccccctcaaacccgaccaccgggatttcctttgccacaaactccgggtatcccatgtccacgcgcatgagatcgccctgctcgtttaaaaacgtcaccctggtctcacccgcttttgtgtgcagcacatagctctcctctgtcacataccccatatcttttaaatatttggaaaaaatgcggataccgtttccgctcttctccgcctcactcccgtccgggttgaaaatgcgcacccgcattttgtccccatcaaaaaaagggccatagagaatgccgtctgctccgactcccaaattgcgccggcaaagtgcttccacctgcctttcctgcaattcacatgcattgcgattcggatcgtagatcaaataatcattccccagcccatggtatttacgcagtgttatctctgccataaatgtctccggtatctgttcttattctattatatgctgtattggcgcggatgccatctcttcagggatatcctgctcctcttccgtctgcttgttctgctcgatcaggctgcggatcgcctccgtcttctcatgaagaatcttgtcgatctgcccttttgtcacctcatcggtcacttcctcattgccgtaattcgccgagctgactgtcagctccggctccacaggaagctgctgcccggtaaccgcatcctctttctccccggtctgttcttcctttggctccgcatacggtgtcggtatataattcacattccagtattttacaatactgcggtgcatccgttcctgcttgtctctctcatcgattctatccaacatatactgtcgacctgccccacttattttctaatttatttatactacaaattctgccgtacttccataacattttgcatttcctgctgaaaattttctgtataaaaacgccccgaatgaagcatgctttttaacagaaaatcaaaccggaggaaacgcatcatgtcttcatacaaagttgaaatctgcggtgtcaacaccgcgaagctgcctgttttaaaagaagaggaaaaggacgcgctcttcgcccgcatcaaacagggagatgccgctgcccgcgaaacttacatcaagggaaacctccgcctcgtcttaagtgtaatcaagcgcttttccgggaaccacgagaacgtagatgatctctttcagatcggatgcatcggtctgatcaaatccatcgacaacttcaatcctgcactgggcgtaaagttctccacctatgcggttccgatgatcatcggtgagatccgccggtatctgcgtgacaacaactcgatccgcgtcagccgttccctgcgcgacaccgcctacaaagccatccacacccgcgagattcttgccaaaacctcctgcaaggaaccgacattagaagagattgcaaaagtctccggtctcacccaggaggagatcgtcttcgccctggatgccatccagagccctgtcagcctctacgatccggtctataccgacggaggagacaccctctacgtcatggaccagatcagtgacaaaaaaaaccgcgaggacaactggatcgaagaactctctctaaacgacgccatgaatcatctgaacgagcgcgagaacttcatcctgcgcctccgcttttacgaggggaagacacagatggaagtcgccgaggagattcacatctcccaggcacaggtcagccgtcttgaaaaatccgccttaaaatccatccgcacctatctctccatgtaatgcctaccgctcccacttgttgcagagttcattgatctgatccgcaaatttgccaagctcgcggttcggcataccttcgcacttgcggatcaccgtcatcagccgctcgccggctgccacaagtcttgcaaagatattgttgactgcgcgggtactcttcttctccaccgcctctctggagccctgtgccacacaggcgcctgtcagcagatcaaacgcatcaccgctgaagggcgcgtaagcctccagccccagctcctcgtgaatatgcgccgcaaactgctccgtcaccttgtcttcgccatgtacgataaaaacgcgcttcggcttcgggtcaaacatgctcacccatttagtcagctggttcacgtccgcgtggccgctgattcccggaaggttctcgatcttcgcctgcacctcgatcgtctcgccgaagagcttcacttccttcgccccgtttaacagcgcattgccgagcgtacccggaacctgatatccgacaaacaggatcgtggaatcctttctccatagattgtgcttcagatgatgccggatccgccccgcctcgcacatgccggacgcagagagaatgactttcggcttgtcgttaaaattgatcatcttcgactcgtcgctggtgatcgccatccgaagccctggaaaaccgatcgggttgatgccctgctgcacaagtgcgagcgcggtgtcatcaaaacagtcctgcacatttttgccgaaaatcgtggtggcttccaccgcgagcggactgtccacatacacctcaaaattctggaattccggaagcagattctccatcttgatccgacggataaaatacagcatctcctgcgtacgtcccaccgagaacgccggtatgaccagattgccgcctctcgtaaacgtatcgcggatcacgcgggcaagctccacggcataatccggcggtgtctcatgcgtgcggtcaccgtacgtcgactccatgaccacgtaatccgccgatgtaagatactccggatccttgatgagcgggcggttccccggtccgatgtctccggaaaatacgatcttgcgctcctccacaccctcagcagtgttctcagagatccacatctcaatactggaagatccaagcagatgccccgcatccacaaaccggacttttaagccctcacagacgttgatcacgctgtggtagtcgcaggatacaaaatgtcccagaacccccaccgcatcattcatatcgtagagcggtacgacctccggcctgccggcacgcttcgccttgcggttcttccactccgcctcaaacatctggatatgcgcgctgtccttgagcataatctcgcacagctgatgtgtcgccgtcgtcgtaaaaatctgcccgcggaagccatgattatataacatcggaagcagaccggagtgatcgatgtgcgcatgcgtcacaaacacatagtcgatcgtcgacgcgttcaccggtatctcctgattgacatacagatccggtccctgttccataccgcagtccaccagtacatgcttatccgcaaactccagataatgacagcttcctgtcacctcgtgtgcagcccccaaaaattcaagcttcatatgcattccccccagcatttttttgataagaccattatacacgtaatgtcctgcggttacaattcttttcccttgtctcttttttcacaatcccgggcagcgctactcaaagcgcacaatttctttcttcaggcgtcccatgatttttttttcaagacgcgagatgtaggactgggaaatccccagcatatccgccacctctttctgcgttttctcctcccctcccgccgtgttcaacccgaagcgcaattctatgatcatgcgctctctgccggtcagtccggcaatcgctgtcatgagcagcgagcgctccacatccgtctcaatatcccggtagatcacatcctcatccgttcctaaaatatccgacagcagcaattcgtttccatcccagtccacgtttaacggctcgtcgatggacacctccagcctggtcttgctgttcctgcgcagatacatcagaatctcattttcgatacagcgcgacgcatatgttgccagcttgatgtttttatccggattgaacgtattgattgctttgatgagacctatggtaccgatcgagatcagatcctccacgccgactcccgtattgtcgaacttttttgcaatatataccaccaaccgcaggttgtgttcaatcagttttctccgcgcctcctccgccgcatctgtggcaagcatccggatgcacacgctctcctcccctgcatccagcggcggcggcagcacctccgcgccgccgatatagtgcacctcatcattctccccgaacaaaaagcgtccgattccgttcaaaattccccgcatcccgtaatccgggaccatccattttatgtacatgtaagctcctttcttcactgtcatcccagggatgcatgcagaatcaggtcatattctttgtcctcaagcaaccccttctgtgcgattccaaccgccatatgttcataccgccgcatctgcctgccatcctgcagtatcatctcatccacatccatcaccgcaagaagtccgtcctctgctccaagagcacggtacggcacaaaccggattctgtcttttgtctgatccacaaatttttccgccaggctatagctcaaaatacagatcggctgcccggtatagggatctcttaactggttcccgctgtcccagtaggcgcttaacgccatccggcgcgcatcttttccaagccatgcccggcgcacatggctgccaaaggctcttcttctcccaagataccgaagaagaccgcacgttaccgtcactgcagccgcaatcgccactcctctgctttttgataaaataccgctctcctgcagccactcaaacgccccgccgagcagaagaaccaccagatacaccgccacccagttctcaaagaactgcctcctgtcacacctcccgaaacagatgactgtcatcagtgtgttgatgagaaaatgcgtgagcaggcagtacagcagataattgcggcaaagcaggatgcagcacagcccgagcactgcggaaacagccgccccaagcagcagccaccgcattttcctgcatctcttcaaaaaaagatttgcccctgcaacggcaaggaaatccatgagaaaattctggatcaaaaatacgtctgcataaaatacatatatttcctttcacctcggtttttctctgacatgccacctattatacgatgccgccgtctccttttttgtcaaaagtccgctctataatgcggcgagtcatctgcccggttcgacataatcttcctgcaacacaaaaactgccatgtgcaagtcctgtaatcggacagacacatggcagttcatattatgtcattgtaattctatttgcgtgaattcttcaggaaatccggaatcttgatgtccatctgctgcaccgtgctctccggctgacgcggtctctggatacccggcagaggcggtgttactgtaccatgtcctccctgcggctgataggtcggagcagcggttcctgtggttcttccgagtgtggaaccggataccggtctggtcggtgtctgcgttgcataattcaacttcggcatgatcttgctcgttgcgcccggattctcaagtcctgtcgcaatgacggtgatcgtagcctcatcggtcatggactcatcgtacttcgcaccgaagatgatgttggcattgtcgcctgcgagatcctgtacatagcttgccgcatcattcgcatccataagagaaatatcaccggaaatattgatgatgacgtgggtagcaccgttgatggttgtctcaagcagcgggctggcaactgcaagcttgactgcctcaatcgccttgtcgtctcccttggcattaccgataccgatgtgagccatacccttgtccttcatgacggtagacacatctgcgaaatcgaggttgatgagtgccggcaggttgattaagtctgtaataccctgtactgcctgctgcaatacctcgtccgccttcttcaatgcatccggcatcgtggtacgtctgtccacgatctcaagaagcttgtcattcggtatcacaattaaagtatcaacgctctctttcaagcggtcgataccggaaagcgcattgaccatacgctgttttgcctcgaacttaaacggctttgtcacaactccgaccgtcagaatcccctgctcttttgcgatcttcgctacaaccggcgctgcgcctgtaccggtaccgccgcccataccacaggtaacgaataccatgtcggcgcccttcactgccgaggagagctcttccatactctcttccgctgccttctcgccgatctccggctgtgctccggctccaagtcccttcgtcagcttctcgccaatctggattaaggtcggtgccttgcaaagtgtaagtgcctgcttatccgtgttgatcccgataaactccactccaccgatattttcatcaatcattctatttacagcattgttaccagctcctccaactccgatgactataatcttcgcactggtatctgcttctgtcgtcataatctctagcaaggtagttcctccttcattctctcccataattcatgtcctgtggtaaacggatgtaaacacaccatctatcagagaatcatccggtgctcctcttcctacaccgtctgttctgtatatcgtctttcaatgcagtgcagaatccatactgcccgcttataaactcatatacaatataatatattctttctttcaatttatcaactaattttttcacttttttgaacaaattaaggattttctaatctctgtcaaacacaatatctgtggtgtccggtgtccatgtgtccagatgaagtgttccgtacattcccgcaagctgtggaaggatcgccgacaggcgcacaatcttctgtgacagatagtcgtccgaaccgatcgaaacctgtatgccgtagtaggtcagcgtcggtttcaaactgctgtcgtagtgaatctcctgcggcagaaggtcatattttttcaaaatctgcgtcaggctcagaaggttgtttaacacatccggctgatccagcggcagtttctcgtaaagcacgacctcatcgcatgtcactccggtgatctttggtacatcctcaatctcgtccgaagaagtctccacgacgaatccatccttgtcaaaataggcgtactgcccgatggcgtcaatataaaagcagcccaggattcctttttcgtataccaggacatgcactgtatgcggatcatccagcgtcacttccatcgtgtcaacaaaaggcaccttgccggtatccttgatgcggtatttcagaagaacatacagagaattccacgaatactcatcatttaacaccagctgctcgatctgctcggaagaatagagctcattcccctccaccacgacgttttccaccgtgaatactttccagacgatcagaaatgcaatcgccaaaagcatcagaaggatcagtacagccgtcagtccgattttccgtcttcttttcttttttctctgttctctaatcatactttaggtaacctcaaactttattccccttgacacggacagcgcaagccccatttccgagagcagaaacagaatggaggttccaccgtaactgacaaacggaagggaaatcccggtattcggaatggtgttggtcacaacggcaatattcaaaaccacctggatggaaatatgcgccatgatgccgaccacaagcagcgccccgtagagatctgctgcattgttcgctatcaccataaatctccagattatcagcaggtataaaaggatcaggcagatcgcgccgaaaagtcccagttcctcacagatgacggagaagatcatatcgttctgcgcctccgggataaaaccgagcttctgcatgctctccccgagtcccttgccgaacagcccgccggaaccgatcgcatagagtccctgcagcgtctgataacctttttcatactcttccgggtgcagccagatctggatacgctcggcgcggtaggatgcaagcgcgataaaaatgacgccgactgcgagtaccacgcctcccacaatcaggaaatgcgaatatttcgggctcgccacaaacagcatgcacaccgcgatgccaaggataataatcgctgtacttaagttattgtatgcgaccaccccgacgacgggaagcacgatcgccatgaccttgaccagcgtcttaaaatcccccacctgcttcgacgtcttatagatgatcgtcgccaggaaaatgatgaccgcaagcttcgcaaactcggatggctggaacgaaagcggtccgatgtagatccaacgcgcctgtcctttggcttccgtaccgataaagataaccgccgtacacagtccgaacgccatcagatacgccagaccgctcactctcatccagaaccggtacgggattctcgagacgatgatcatcgctatgattccaagacttgtcgcaaacagctgctttttcagataatacgccgtatccccgaaacgcgtggaaccatagtaagagctcgtgctgtagagcatcaccagaccgaaacaaagcagaaagataatcaaaaacagcaggctgtaatcaaaatatcgaattggtttttgttttttttctttttcctgccttcgcgccattctccactcctagtcttcttttaaggcacgcacatattccttgaaaatgcgtccgcgctcctcatagtttttaaacattccccagcttgcacatgcaggggataagagtaccgcatcaccggataccgcgttccggtagcaggtgtcgatcgcctcctcaaacgtatcacagagcacaatattctcaaatccatgtgcccgcgcacaggctgcaatcttctcccgcgtctgtccgatcagcacgagcagcttgacttttccgccaaagctttcaatccactcgtcatactccgactgcttatcatagccgccgccaatcagaagggtcggacggttcatggcacaaatgcccttgatcgcggcatccgggttggtgcccttagagtcgttataaaacttcacgccgcgcttctccgtcacatactcgatgcggtgctcgactgcctgaaaacgcttcagcacttcgacaatcttatccattggaacaccgaggcttaacgctatgccggtcgcagccatcacattctcgtaattgtgcgttcccaaaatattgagttcattcacgttgatgaccttcgtggtgttctctccgtctgcatagtaaatatcctcgccgtccagatacagtccgcggtctaacttctgtctgctggaaaaatacagcacgttcgtgtgaagcgtctcaccgaatgcgcgcaggacttcatcctcgtaattgagcacgcagacctcgtcttccgtctgattctccgcgatccgctccttcgtcttaatatagcactccatcgtgtgatgacggttcagatgatccggcgtgatatttaaaatagcggaaactgccgggtgaaatgtgtgaatggtctccagctgaaagctgctgatctccgccaccgtcactgtctcgtccgtggtgtccgcagccacggaggtatatggaattccgatattgccgaccactttcacatcccggtaatagtttgccatgatctcgccgcagagcgccgtggtcgtcgtcttgccgttggtcccggtgatcgccacgatccgtcccttcgcaaaatggtaagcaagctcgatctcgccccagatcggaatcccgtcttttttcagatcctcaaccatcggaagatccgtcggcactcccgggcttaacacgacaagatccagtccgcttctatcttccgctgtcagttctccgaggatgatcttcacatccgcaaagaccgggtgcttctcacgaagcgccgtaagatccagctccttatttccgtcaaacaataccacattcacattcttctttttcagaagttccgtcgcggcaacaccgctgattccggaaccaaccacaagcactgtcttacctgtcagatccatgttcttcctcctataatcctaacagggcgatcatgcataagatcgccgttgtaatcgaaaatactgcaaccactctcgtctcggaccatccgcccagctcaaaatgatgatggatcggcgccatacggaaaatccgctttccgccggtctttttaaagtaggtcacctggatgatgacggagagtacctcgaccagatagatcagtccgacaatcacgataaacaaaggcatctgcatcatataggctgccgagaccacaaatccgccgagcgccagtgatccggtatctcccatgaaaacacttgccggatagacattaaacagcaaaaatccaagcagcgcacccacaaccgcacaggtgatcggcgcaatgcctgcattcgttccgatcgccaccgcggagaagaacgttgccaccatgatggtgacgctcgacgcgaggccgtccagaccatcggtaaagttcgtaccgttgacggttccgatgaccgccagatacagtaccgggaacgctccccagccgaggtctaaatattttcctccggagaacggaatcagcatggtgagcgggacatccgagtagcatcccatataaactgcgaacacggtcgtcaccacaatctgacagagcattttctgccatgcaagcagtccgtccgatctgcgcagcacaaccttcagataatcatccagaaagccgatcacaccaaatccgacggtcataaacagaatcggaacaatcttcggataatcttttacataaaacaccgatgtgatgataatacttgccaatatcataagtccgcccatcgtaggcgttccgtttttcttcagatgggattccagttccttccgctccgtctgtccgactttgagtcttcgcaggaaaggaattacaatcggtcccaacaatgcactgattgcaaaagatacgattaccgggattacaatttcatacgtcataataaacacctcatgtattttatctttgccgaaagcaacatgtgctttttaacccaactagtatacgttatttttcatgatttatcaaggtaaggcaatatgttttccataatttcttttacgaccggcgccgcaatcagacctccgtaatacgtgcccttcgggttattgataatcgcaatcacaagcactttgggatcgtccgcaggagcaaatccgaggaacgaggaaatatagcggtgctcgcttctcggcagcgtctgggaagtcgcggtcttgccgccgatcgcatacccctcgatcttcgcattctttccgcctccctccgacaccactttttccagcagatactgcatggtctccgaggtctccccgctgcagatctcctctctcttatcataagaaaatgtctcgaccaacgttccgtccgtctcacggacctccactccgaagtgcggtgtgatgcgcgttcccccatttataatagaagaaacggtcgtcacgagctggatcggtgtgatctggaacgactgtccgaacgagatcgtcgcaagttccaccgggccgacgttttcctgcttatgcatgatcgtcgccgcctctcccggcagatcgattcccgtcttctgtgtcagaccgaactgtttgaaatatttgtaatagttttccacgcccagccgctcgcccagttcaatgaagacgggattgcagctgttcataatgcctgtctcgaacgtctccgccccgtgtccgcttgtcttcgcgcaccggattctgcgatcctccaccagcttatagccgggacagtagaactgatctgtcagcgacaccacgccctcctcgagcgctgccgccgccgtgataatcttaaatgtggaacccggctcataggtgtcgctgatacacgggtttctccacatgcggttcagcagttcctgctttttgtccgcagactccgtcccatccgctcccatctcctcaattaaggtaaacggttcgttcagattgaattccggataatttaccatcgccatgatctccccgttctgcgggttcatgacaatcacggacacctcatccgcctgcttttttatgtatgccttttccgccgcctgctcacagtattgctggatattgctgtccatggaaatatataaatcatagccgttcaccggctcaagccgcgtctctcccgcattttcaatctcaatcccgcgcgcatccgtgagggtgaggatcttgccgctcgttccctgcaaataggaatcgtatttgacttcaagccccagaattccctggttatccgcacccgtaaagccgagcaccgtggacgccatggtatccaaagggtaataccgcttgtaatcctcgtcgaccttgattccggaaaggccgtaggcacggatgcggtctccggtctccttgtcaacattcgtcttgacccgctcaatggagctgaccttctccactcgctttctcacttcctcctccgtgagccccagttctttttgcagtgccgcaatcaccttctccggctcatcgatctgactgtgaatcacggaaatggtacagaccgatttgttcgtcgcaaggatttttcccgtggcatcgatgattcttccccgcgctgccttgatatcacgctctctctcatgaagatcctccgccttctgcccgtagtattccgagcagaagaccatcagatagacgagccgtccgcccagaaacatcatcacgaaaaacacggcgaggaacatcagccatatttttctgcggttgaatgtcttgctccggtaaaatgcatgttcctgtgacatatagaaaaaacctcacgaaagttctccatgaaattttattcatcctttcgtgaggttatgtctgttattgctgtccgttatcctgtgggatgtctccactatcctgtgggatatctccgttatcctgcggggtgtctccgctatcctgcggttcatccccgttatcctgcggcgtgtctccgctatcctgcggcgtgtctgtgccttccgcctcctcttcatttcccggcagggtatccgttgtgtccggcacatccagtccttcttccaccggagtctcctcgtttacaacgtccgtcatcgctgtcgctccggtatctgttcccgtaatgtcccaccctgcatgaattccggtggtctgctcatcgcggtagatgttcatgtaaggaagcacttcctctaagatctcacgcacaatattctgtgcaaaagagctgtggtactgctccactgcattcggctcgtcgaccacgcagtaaatcacaagctgcggatcgtcgaccggtgcaaatccaataaacgataccagatagttgacgccgtcacgtcccgctttctgtgccgttcccgtcttgccgcccattgagtagccgtccactttcgctgtcgctccggtacctgaggtaacggtggaatacatatactgacgcagcgtctcggacgtactctccgagatggtttcccgaagaagtgtcggctggatctcctgcacaacgttgccgttctcatccgtaatccgttttaccacatgcggctgatagaactttccgccgtttacaatcgagcagaagcctgtggcaagctggatcatcgtcgtgttgaagttctgaccgaatgcatttgtcgcaagatccaccaccgtcatgttgtcgccggtatagatcagagaatcggttctcgtctctcccggcagatcaatgttggtcttctgaccaaatccgaaaatctgctggtaattttcaaagttatctcttcctattttataggacatctgcatcagcgcatcgttgcaggaattcatcagcgtctgctccaatgtctccattccgtgtccgtctctcttgacacagtgaatgtcatgaccggagatcgtctcatacccgtcgcagtaataggtgtctgccgtggtcaccgtcccggtctcaagtcctgccgacacggtaaaaggcttcgccgtcgatcccggttcataggtatacgacacgcagaagttctgccacagctggtttagtgcatccatctttgcgtcatcatccatggcagcgagttcttcctcggtgtaatacgcggagagatctctcgggttgctcagatcaaaattcggataattcgccatggcgagcacatccccgttattcggatccataatcaggactccgatatgggaagctcccgcatccccttcgcggtaggcgcctgtgtacgcctcgttgaattcccggatcttgtcctccaccacggactggatattcgcatcaatcgttgtcacgatgttgttgccgtttgtcgcctgcttgatcgttttctcaaaattattatccgtattcagatagccgaactcacgcccgttgatgccgtttaacgtgctgttgtaataattctccagaccgttcactccgacatttccggatgccgtaaatccgatcaccgcgctggcgagcgatccgtacggatactctctttgatattccttctcaaaccatacgcccttgatgtcggggttcacctttctgcccttttcatccgtcgcatcctgcagttccacgaacggctgcatctcgtcgtacgatattttcttcttcagcacaatataacggttctgcggatcattccggacatatccgtaaagctcatcgctgctcaagtccggaaaacactgcacaagcgcctgaatcgtcggcgcaacgtaatcctcatcgctcgttaaaacagaacaatccagtatcacattgtacactgcaatactggttgccatcactgtcccctttgcatcgacaatatcgcctctctggtaaggaatcactttgctgtcgtattcctgctgggacaacacaattttctcatatttttcaccgctggtatattcaatatacatcaggcgcccgatcagaccgatcagcatgcctgccacaatggtaaacatgacaatcagctttttttgcatgcgcctgggaaatttcaacagcggtcttctttttttctttgccatgcgcctctcctgtcatcctactcacgcggaatctcactgtactggttcatgtaatcgtcatcgttcactgtatagtacacaatctgcgattccttcgcataggacattccatattttgtcatcgccgtattccggatgctgtcaagatccacgctcgtattgatccgcttgtatgcctcgtcgttgtcggctttcagatctgcgatctggctctcaaggcttgatatctgattcatgcgcgccgtcatctccgactggatgtggatgtatgcaccggtaaagatgccgaacaccatcacagccatcgtgagaaatgccacatagctcttgctcatgcgcagagcacgctcctgatttcttctggctgcacgctttctgtttcttaattcaatctcgcgttcccgctcccgtctctcgcgctcccgtctctctcttgtgacatgctccgggcggctctctctgatcctgcgatccggtctcgtcactgcaggcgctgcttccatcctgcggacagtattcccgtcaatataatattttctctctgccgcttcatttctcataactgccacttccctcactacactctaagttctttcaaatacgcggagctttgcactcttcgatctcgagttctctgcaagctctctctcccccggcaatactggcttccttgtaatcactcttcccttggactttttcccgcatacacataccgggaaatcactcgggcaggtacatggattctcgttgcgcttaaaattcgtcttgacgatccggtcctctaatgagtgaaaggtaataatacagatccttcctcccggattaagcagatcgatcatcgtatccagattgtcctgcaacacttccagttcgtgattcaattcaattctgattgcctgaaacgtacgctttgccggatttcctccggtcttctgcactttcatcgggatggactcccgaataatttccgacagttctcccgccgtcgtaatcggcttcttctgtctctcgttcactatatgttttgcaatattttttgcaaatttatcttcaccgtaatcgcggatgatccgatagagatccatctcgctgtagtcattgacaatattccttgccgtgagactctgtctgtcatccatgcgcatatcaagcggcgcatcggtgtcccggtaggtaaatccccgctccggtgtgtcaagctggaacgatgacacgcccagatccagcacgatgccgtccacatgctctataccgatcgcatgaagttcctctttcatgttggcgtaattgctccggatgatcgtaaccttatcgccgaacggcttcaagcgctctcccgctgcccggatcgcatccgcatcctgatcgatgccgatgagacgtcccttttccgataaccgttttgccacttcactggcatgtccggcaccgccaagcgttccgtccacatagattccgtccggtctgatgttcagatgttcaattgtctcttccagtagaacggaataatgtttaaactccaacctgcgcctcctgcttagatactgaatccaagatccgccatgtgctctgcgatctcgtccatctcatcctcatcgtaggtattctcctgccatctgtccttatcccagatctccacgcggcttaagactcccacgagcaccacatctttttgtaaattggcatattcgcgcaaaaccggcggaagcagaattctgccctgcttgtccagctccactgcggctgccccagcaaagaaaaaacgggaaaactttctggcatccttcgatgtcatggaaatattgcggaacttctcctcaatattgtgccactcttcggcagggtacacaaataagcatccatccagtcccttggtaaccacaaattcactgcctaactgctctctgaatttggatggaacgatcagtctgccctttgggtccactgtgtgattgtattctcccatgaacataacacaaacacctgccttcagtggttttccacaaagttatgaacttatccaccactttgtaccattctccaccactttcctccacttgtatgataatattaccccaccttgtaccaaattgcaatagaaaaaagcccaaaacttgcgtttgggcataaaaaaaggacctcgcatacatgcctcgcatatatgttccgtcctgtttactgtgtttattcaattgtcagaccctgacaccctcctgactctcaagatattcttctatcagcttgtccagtctggtgcttttctcgtaatagtactcaaacctgttctcctgcaacaatgcttcatccaactcgtgtctcgccgtctcgatcttcttttgtaactcatagattctgttcatatgaatcctccttaaaacgctaagattcctatgtctgacgttaacatagcactaaaggtgggcattcccacataaatctgctcttcactgcctgccttacattcattatattactatgtccgaacacgaaaatcaacgaaaacaacccgtcatttttcgacattatgagtgccggattctccactcggcgcgtttattcgccaataacttcatcattgcatccagcgctttgtgattcacctcgacaatatgttctatatcatcctccacgccatgcttgtgcgccagatactcgtcatgcgacttctggataaaagcacagatcgtctccgcgtcgatgagcggctctgcctttttcttattctgcagcttctcatgttcttccttaagctgcagcagccggtgatgtctggtagcctcaccgctctttaggtacgatcttaagtcccgctttaacttctcctcgtaagaacaatgatccttcaggctgcccgggtaaatggtgttgtgcggaaatgtaaaataatccgccagataatggctgatctgtcccagatcccggtaatacttgcacccctttttcttccggatcagcgcatctccctccgacagacgcctgatatgtctgctgacataaggaaacgttccgtccatctcgtgtctcttatagagaaacgaaggcttgatgtccggcagaatacttcccagataaaaagaaaatttgtgacgttttaattcttcatcctttaaattctccaccatatagcgcgccagcgaaatatgtgacttttttctcattcatcggttcccccttctgcactgcatgacttttttcctaattttgctttcattgtacttccatcagacgcactttacaagaggaaaattccaccggaatgcaaaacggggaaccgttttgcattgcctccggctccccgtcttttctcctatttgcagcagaaacttgcgcactctgtctcgccgcaggaacaggcgttgccccctgcgatgccgatatggtccgcgctacatttcttattctcgttaaacgtgcagttgcaggcctcacatgccacatcgattgtctttgactcatgctcttttacattgcatccgcagtttttctccccgcgctccacaaagcttccgcagcaggtctcattctgatgcaccgcctcgcttccctcaaccttgatgttgcccttgcagcagcagcgatcctcgttgtaagcacatccggttaccgcacaatccagtaatgtcatatctcttttctcctttcgatccttgttctctggaatgatacattcccattcttaagtatctccggagcaatttcttttataaccggttttctttttccacagcaggaagaattttcctgttacacaaaaaaggaagtaccacataccggtacttcccttgcgctctgcttcctgtgcttactttccacagcaaaatttgtatttcttgccggaaccgcacggacacggatcgttgcgtccaactttctttccgacgataaccgttccggacttcttctgctccagatacagtctcttcttcgtctccgggtcaaaaatgtcattccacatcggaagctcatagagccagtctgccttcgcgtcgaccatgttcttgtacaacttctccttgtcgaatacgaggctgaccttcgtatcttcctccatggtgtcgatcgggttcggctctaccaggctctcgttgataccgtccaagaaacctgtcatatccatgatgctcagtccgtatttatctgcaagctctttgaccgttccctctaccttctcatccgggttcgtcagaagcttctcatagacacctttttccagaagaaaatatctctgccagaatctctgcagttctcctctgtctgccttctcattataagcaactttctgccactgctctaataatgccatatctgattcctcgatttcatgattatttgcatctatctgccggattgcttgtccgacatctgctatgtcaaagatgcactatagtattataacaaattttccggcatatttcaaagacttttttacagaacccaccaaaagcaacgggacgtcgacggaagcagatcgttcatttggacgtggcaggcaatagggtgagaagatcatgcccttcgatttcagagggaatgtatctggaaattcggatcaaaaaatgttccatctgcatttccatctgaaatcggtgggatgtgtcgcttaccctattgcctgccactaaaaaactattcgttcaacagattgtagtcctcgatggacgcgttgatcgtgtccgccatcttctgtacggcttcctccggtgtctccttgtcatttaacgtgttctcgatctcggtctgtaccgtctggcgtgcttccggaaatacagagagaagcgctcccgcgtactcgcccttggtgtcgttcaactggtcgatcgcggtctggaactgtgggtactgctcgatgttctgcttgaatacatcctcattgtacgcatcgttggtaaccgggaaatatcctgtctgggttgcccagtatgcctgagactctgccgataccagatattccacgaacttccaggttgcctgtgcctttacatcatcctgattctggattgcccagagggatgctccgccgatggacacaccgccctgatctgtatccttgatgcccggaaaatatgcggttcccacctcaaaggagccgttgacgtcgtttaagatctgctttaaggaagcggtggagccaagcgtaatcgccgcttttcctgcggagaagtctgtcagacctgcatcgccgccaactcccacattcggtgcatatcccttgtcgtagagatccttccaggcggatacgatcgagagagctgcaccgttgctatcaaaatccaccgctgtcgccgccgcgcttcttccgttacagacgcccgctcatagatcaactcatcaatattggcaagtcccgccgaaaaatacagataattgatcccgctgttcaaccacgccgtcagaagtgccacgcacaccagcgcatagcgctcgtcatgcagccagttgatgtccgaccgcaggaatttgtcgagaatgccgatcgtcggatctaacataatctcgaaaatcagtgcagcggcgcttgaggcgatcgccatcggcagtgcgtacgccgtggaaaagacccggattcccggaaaatttttattcaccagcagcgccgtcacaagaccgagcagcatgctgaccattaccacgatcaccacaaaaatcagggttacaagcaggctgttataaaaagattctgacgtaaacagatcgatatagtttccgaagccgacaaacagctttgcctgtcccagcttgtcggttttatacaggcttaaatagatcgtttttgcaaacggataaaataagaacagtccgaatacgataagacacggcaccaaaaacaggtacgggctgatcttttgtcttagctttacaaatgcattcatgttgtctcctttcagatgcgcatttcactgtcgcagtcaaacagatggatcgctgtcacatcgaagtacagccggcgcacctcacctgcccgggcgtcatattccgccggaatctttgccacatactttttcccgtataaaaggaaaaacaaaagcttctcggctccgagcagctccacctcaagaatcatcgtctccacgtaatccgccccggcgcttacacattccggtgcctcccacaggatgttttccgggcgtatgccaaggatcacgctgtcgcttccgtgcctgcttatccgcgctgcatcctccctgcacggcatcatgcggtactccccgaccagaagtgccggagcctcctcccaggaaaccacttgtgcctcgaaaaaattcatggacggcgttccgatgaatcctgcgacaaaccggttgaccggctttgcatagaggttcgccggtgtatccacctgctgcatttttccatcccgcatcaccacaatccgtgtgccaagcgtcatggcctccgtctgatcgtgcgtgacatagatcgtcgttgttcccaccgcatgctgcaatgccgccagttccacacgcatctgcgtccgcagtttcgcatccagattggacagcggctcgtccatcaaaagcgcccttggattgcggataatcgcatttccgatcgccacacgctgtttctgcccgccggagagttctcccggtcttctgtccagcagatgctcaatgccaagcatctttgccgtatcgtatactttcttttttatctccttcttatcgaccttcctcacgctcagggaaaatgcgatattgtcgtacacgctcatattgggatacagcgcataattctgaaataccatggcgagattccgctcccgcggctccttgtaattctcgatctctccgtccacccacagctcgcccgacgagatgtcctccagacctgcgatcatgcgcagcagcgtcgatttcccgcagccggacggtccaaccagaatcaaaaattctccttcttttatctcaagcgaaaagtcatgaattgcttcataaccgttccggtatacttttcccacatgttctaacgccaattcagccaaaataaaacctcccagtgctctcttacattgcaaactcaacagtccttattgtaagagttccaccgggaggcagctatcaaattcctgtaatattttttgtgttttcagtaaactttatatggtttttataaagtttgtacaattcgtgtaaattttttctgcttgacggaaccgccttttccatctaccataaaggtacagccgtaaaccagaaggctgtttagaaatgaggttaccatgaaaaaagtgaaacgtattcttgccgcagccggcgccattcttctgcttttgctgtatgcatccacgctcgtctgcgctttaagttccagcgagaattttatgaatctgctgatggtctccatctacgcgaccgtcatcattccggttctgctgtgggcgtacacgctcatctataagctcgtgcacaagtcgtccgaagaggacgccgagcaaaaggagccgccgcaggggcagggaaaatagatacaaatttcaggataagagaaaaaccgacagaatgttccagaatacaaacggatgcggggattctttgaaacaaaatgagagaatttcttccctgcccgccgggacatcgaattccgtgtctttgtcacgcttggacaatccacagggtgtgtccggcaaccgcagacaatgagcggactttctagtgtccctaatgggcaccgcttcacagtcaatataaaaccgtgcgaaccgaactcgccggcatctgctattgaacacagggcaaatgccgactcagacagcggcttcgcgcggttatgttttgttcagcggtgtccaaagggacacacgaaagtcctaaaattgtctgccggcttgcggacacaccctgtagagtgctccaagcttggaaagacatggatcatcagggatgtttcggcgggcagggttagaaattccgcattttgtgtttagaatgtccgcatcctttgtatctggaacatctatcgtttttctcttattacggagtccatctccctgcccgtgcagtggctcttttgatccgtcctctactcttccgtactgtcctcggacgcggcgctctcggtcacgtctacgcccacagccgcctctacgccctcagtcacgtccacactctcaggctcatccgtctcttcctcctttaacaattcctgcggtgtcttggagaaagtgccggagagatcccgcgacacgagatagatcttatcgctctctgccaccttcaggtaatactgcccggtcactgcatttttatctccgagctgtagcgtcgtcgtgccgtctgccgtggtgagggtaatgatccccgacggattttccagaccatactgcgccagatcctcgccgtctgtaatctcactctccgccgtaaggcccgtgaccgcatccagcatggcgtcgatctgtgacgtgtcgagggtgagtgaaatatccccgtcccaggtccactctccgtccgttttcgtgtaggcataaacctgaccgcccagcacgtacgagaatgccgtcacatcatcggttttaaaatcgacgactgtaagcttctctgcttcctcctcgctcgcctctttttcctcctgtttctgattgtatacatgaattcctccataggctgctgcaagcactgcgaggacaagcagcatgccaaggaactgttttttctgtttctccattatttctttctccttaccgcccagatcacaacaccggtcacaatcagcagaatcggcaggataaccgttgccgcaagtccgccgatcagcgttccgagtgacgtaaccgtaatcgttccaagcgtatactccttgaccggaatgacacccgtcgactctccgtcgtcaccggcaagctgtcctaacgcatctgagaacatggacacatttcttcccgatacaatcgagtccgcattgtcggtcagcatttccgtggagccaaacaccaccagtttcatcgtgttgtcgtcatccacatcctgttctgccgtcagcgcaatcgtaaacggtcctgcaatgtccccgtcttccagctcagacgtctccgcatttgccacatccgtcttggacaccgcctgatcacttgtgacaagcagcggtgtgtaggtaatatcttccgattcctccggatagctcagtccctcgctgtacggtgcgaaaatgtacccgcccgtcacagatgaagtataggctgtcgactcaatttccggcaacagataatacggtgtactccggtagcatgctgatgcactgttttccatcacaatgccagctacccgttcaatgccgtacgcctccagaaccgaagcaaaattcggcagatcctgatactcgaagttgcaggtgatgagcgctcttccgccgccctgcaaatattctttcacctttgcggcatcatcctccgagaagtctgatgtcggtccgttgatgataattgccgccgcatcatccggaaccgcatcttccgtcagcaatgtcagctgcgacaccgtcatattggctttctcaaccgcctccgaaaaaccgccggaaagggtattttctccatgaccggtaatctcgtagatgaccggaagttcactgtctgccttcgtcacatactgcagggcgctggtcagctgtccctccgcatcataaccgtccacagagcttgaatatgtagaatagtcataagaatattcatagatgtcgctgtaatccaccacgcgcgatctcgcgtccgacaccacgatcatactgttctggctcggcgcactgtccgtatactgctgataaaaattcggactcttcgccggatctttgtaaaccacatttaaatgtttggagagatcttcataccgctgcaatgtctccgccaacgtactgtccgccgacttctcggacgaaagcacatagatcgtgacgtcctgcgacagatttttcacataatcctttgtggtatccgtcagactgtacagctttgtggaagttgcatctaccgccgtccaggaggatggcatctcctttaccaccatgttgactgcaaccgcaaccgcaaatcccaccacaatcatcgccacggaaaacattactgtggtcagttttttcgtcgtcatgctccagcgtctcttctgcacacactggcaggtcaaaaacagacacaatgccgtcacactgacaaaatacacaacgcccgtcagatccagacagccgctcataaaactctgaagcggtgtgtacagatcatatgcgcccagtaccttcgtgatcagatggtcgccgatcaatcccgtgatgctgttcatcatatatcccagaaaaaggaatgcaaacgccacgaccgctgcaattacctgactctccgtcagcgccgacgccagcataccgactgcgatgcaggtacatccgtacagccagaagcccaaaaccgccacatagttttctcccatcggcaccgtgccaaaggcagccaggacaagtggcgttaccgcaatcaccgccacggcaacggtaaaaacgcccaccatggctaaaaattttccaaaaatcatctttccaagcgaaaccggcgctgtgagtaccagctggtcagttctgctgtgccgctcttccgccatggaacgcatggtgagaatcggaacggcaatcaacatgataaacgagatcgccgaaagtgtgtacgacacatacggatatcccgcccgcagattatacgctaaaaagtacagaccgtacagtgccagaacggcagcgataaacagccatcctgtgatattctgaaaataacttttccactctctttttaaaattgcaatcatgcctgttctcctttcccgtctgctcctgtaagttcaaggaaaacatcctccagcgattttgtctccgtgtgcatttccagaaccggaatctcttcttttgcgcaggcatgaaacaatgcctcacggatatcttcgccccgctccgccgtcacatgaaacaggacttcctccgctgcttctcccggctctctgctcacttccgccacacccggaagttcctttaagagttcctccatgcgctgctctttctcttttaccagaagcgcgatttcctgtgctcccgacatccgctccagcagatgttccgtcgaatcgctcgccacaagttttcccttcgacaggataaacacatgatcgcagaccgccgaaatctctgtcagaatatgggaactcaaaatcacggtgtgctttttcccgagctccttaatcagttcacgcacttcgatgatctgcttcgggtccagtcccaccgtgggttcatccagtataatgacatccggataccccatgatcgcctgtgcaaagccgacgcgctgccgatatcctttggagagattgcggatcagcctctcactcacttccttcgtgtgtgtcagctccataatctcttctgtctgtgtttttcttacctttttatccagacctttcagctctgccacgaaatccagatactcccgcactgtcatctccgtatagagcggcggtatctccggcagataccccacgcatttttttgcctcctgcggatcggcaaaaatatcgtgaccgttgatcttcacctcgccgctcgttgcgccaaggtatcctgtaatcatattcattgtcgtggattttccggcaccattcggtccgagaaaaccatagattttcccgggttccaccgtaagcgtcagatcatccaccgccacatgttccccatattttttgaccagatgattgatttcaatcaaaaccatttcctcctttttcctgtttccgtatctagcctacgaaagaaatgtgttcaaaagggaatcattctgtgataattctgtgaaaacaaacccaaaggaattgtcgcaataagcatagaccactttgggtgataagtaatattataagaactagatacttaaaagttccagataaacatgcggcggcaaattctgaccgcaaaatccggtatttctaaccatgccgcagctgacatccgtgatgatccgtgtctttccaagtttggagcactccacggactatgtccgcaagccagcagacaattttaggacttttgtgtgtgtcccttatggacacctctgaacaaaacataaccgcgcgaagccgatgtctgagtcggcatctgccttattttcaatagcagatgccggcgagtttcggttcgcgcggttttatattgtctgtgaagaggtgccattagggacaccagaaagtccgctcattgtctgcggtttgtcggacacactccgggagtgttcaaacgtggaagagacacggaatccgatgccagctgcggcatggaagaaatacatgaattttgcttcaaagactttgccgccgtctgtttattctggaacttttttgttctctggtattcctgtaatattacttatcaccgcaaagcacgatatgcttcttgcgacagttcctttttctagcactctacaccgtattcttttaatttctgtctggcgtcctcgtagccggtaaaacgaatggcagagatgccgcaggcgatggcaccgtccacattgttctgtctgtcgtcgaggaacacgcactcctccgcgcgcagatgaaagcgctcaagcagggagtgataaatctccggctccggcttaatctgcttcacctcgaaggaaaacaatgctccatccacgtccttaaggaagccaagcgactgatccttcgtcttcgcgtatgtccaggcaccgtaattggaaaggatatacaggcgataccccttgtcttttaacgtccgcatccattccccgacatacggaaacggataaatcgcccggtccacatgctcccagaaattccggatctgtgcttcgtatgccggagcttttctgataaagcctgtgagaagttcctcatcggacagggctccccggtccgcttcgtcccagtcactggtgtgcaccgtggcatctgcgactgcgcgcaccgtctcttcatccattccaagcgcgcgcatcgcctccaccggttcccatgccaccagaacctgtcccacatcaaaaatgacattcttaatcatatgcgtcatcctacttgctgcggtagataatatcctctctgcccggtccgtttgataccatcgtgattggatatccgatctgctcctccacaaactctacatactttctgcagttctccggcagatcttcgtatttcttgatgccgcggatatcgcacttccagcccggaagcttcttaagtaccggctttgccttctcaagctttgctgttaccgggaaatctgttgtcacttcaccgtcgatctcatagcctacgcataccggaatctcatctaagtatcccaatacatcgagcacggtaaatgcaacgtcggttgttccctgcatacggcagccgtacttgcttgccacgcagtcgaaccagcccatacgtctcggacggcctgtcgttgcgccgaattctccgccgtcgccgccgcgtcttctgagctcatctgcctcatccccgaaaatctcgctgacaaatgcgcctgctccgactgcggaagaataagccttgcacaccgttacgatcttcttgatctcatacggcgggatgcctgctccgatcgcaccgtaagctgccagcgtggaggaggatgttaccatcggatagattccgtgatccggatcctttaaagttccaagctgtccctccagcagaatacgcttgccgtctttgattgcctgattgaggaataaggagacatccccgacatacggagcaaccatatccctgtactcatgcaaggttgcaagaagttcctcttcctttaataacggcttatgatacatatgctccagcatgatgttcttcgtctcgcaggtgcgctttaccttttcttttaagagctcctcatcgaacagctcgctgacctggaaaccgatctttgcatacttgtccgaatagaacggtgcgattcctgactttgtggaaccgaaagaattcttgccgagacgctcctcctcgtactggtcgaacaggacatgatacggcataaccatctgtgctctgtccgagatcatcagcttcggtgccggtacgttgcggtctgtgatcgacttgagctcgccgattaccttcgggatgtcgagtgcgacaccgtttccgataatatttgtgatatggctgtggaatacgccggacggcaatgtgtgcagtgcaaacttgccataattgttcacaatggtgtgtcctgcatttgctccgccctgaaaacggatgacgatgtcagcctcatccgcgagcatatctgtgatcttgccttttccctcatcgccccagttagcgcctactactgctgtaaccatatgtttttcctcctgatatgatacacttttttgccggaagtccgcattttcctgattccaggctgcatccatgcggccggtctgtccgaaagcagcatccactctgtaaatctgcctcatgacataaaaagtgacggttgtaaaaaaccgtcactcacttccgcctttttacttattgattatacacgaaccttttgcataagtaaaatcaatattcattatatgtggcataagtatttattatgcctgtttctaaaagaaaatccctgcttactgtgatgtcccctgtaccagaacattcatcagcgtagccgctgcggctgacagcggaatccgttcatttgcaacaatgcagaacgtacgcgccggtatctcctccaagaaccgcagttcaaacagatctccctccgtcaggtgctcctcggcaaaatttctgaccacacttgcaattccaaggttgcgcaccgcaaactggatcagcatatcgctggtggcaagttcaaactccggccgaatcgtcacctgcttcgacgcaaggaattgctccacatacgtcctggtcgaggtatttccctccagacacatgaccggcagcttcatcagttcctcgtaccccagcatgcgctcctttaaatattcaaacttcctgcctgccacaaacacatcccggatctccttcaccggaacgcatttgagcgaagctctcttctcgaccggcgtgctcacgatgccaaaatcaatgcggccgtcgcagagatggcggatcgtctccggggtcggcgcattcgtcaccgtcacgcggattcccgggtagcgctcatgaaattcttccagatacggaagcaggaaatactttaacgtcatgtcgctggccccgatacagatttcgccctgttccagattcagcatctcagagagcttcctctcgcctgagaggatcgtctcatagccgcgctgcacataggaatagagcatctccccctccttcgtcagccgcacgcccttggtcgtccgcacaaacaatgggcacgaaagcgcctgttctaaatgcttcaccgcctggctgactgcaggctgtgagatggcgagctgctccgctgccagtgtgatgctctgggagcctgccacataataaaaaattttataatattccagattgatgtccatggatctctcctgggaaaaaagtctcatttttttacaaaaacggattgtattttccactgtcatgaagtatactatgccttacgcaaagtaccagtatctctactataacagactatgaagggagacgcaatccaatgaccaaagatatgaccaccggcagcccgcttcggattatcctgctattttctattccggttctgctcggcaatctgttccagcagttctataatatggtagatacgattattgtcggacgctatctcggcgaggaggctctcgccgccgtcggctcaaccggctgcctgatgtttcttgtgctcggttttgccaacggcatcgcccagggcttcggcgtcatggtttcacacgctttcggagccaaagattttaagctgctccgtcactacgtggcgctatccctgattcttacactgattatatcgcttctgctgaccatcccaacggtgacagcttcccgcctccttctggcatggatgcacacaccggaaaatattattgccatggcagacgcttatattaaggtaatttttgcgggcattctgctgacaatggcgtacaacgtgttatccggcatcctgcgcggcatcggcgacagccgcactcctctctacttcctgattctctcgtccgtgctcaacatcatcttagatgtcgtactgatcgtgtacacagggcttggaactgccggagccgcctacgcgacaatcatcgcacagggagtctccgccgtgctctgcttcttttatatgtaccggaaatacgatatcctgcgcaccagacatgaggattattatctggattccgccggcgtaaaaaacatgctcgccatcggtgtgccgatggcgctcaactactcaattaccgccattggcaccatgattatgcagagtgcggtcaacgtgtttggctcgagtgtggtcgccgccttcaccgcggcctccaaggtcagcaatatcgcgacccagtccatgccgacactcggcaccgcaatggcaacctactgcggacagaacctcggtgccggcaaatacgaccgcatctacgccggcatgcggcagggacttttcctctgcttcggtgcggcagccacagccgccgcgatctgcatctttggcggacgttttattgtgagctggttcgtgagcaatccttccgaggagatcttctcttccgccatgcagtacctgacgatcgcaagctggttctttctcccgctcgccatgatctttttataccgcaatgccttacagggcctagatcagggactgatccccatgctctctggtgtcgtcgagctcgcctgccgcttcggcgtcatcgctctcattccggcaagcaccggcttcttcggtgtctgcttcgctgatccggctgcctgggccggtgccggcatcccgctgtttatcacctatcttctctgggagcaccggatgaagcagtgttccatggcggtgtaaacatttttccctcacacggaaatgcatcctattgcatcaaaaagaccgtactccgtcatcccggaatacggtcttttatattgtcctgttttattttatctatgcttccagctccggaatcttcttcgagcaggcaacagcaagtgcccccggtccaatatgacatgatacgctcagtgacagcggatccatatgaatctccagtcccggaaatgcttcctgcacctcctgcctgaacgcttccgcagcatccagatcgtacgtgtacgccatctccagatgcatactctttccttccggatcatggaaccgctccgcaaaatcgtgcttcatcgcctcgatcatcaggttcttcgcctgcttgacagttctcgccttggcaaatgcatccagcttctctccctggatctgtagtaccggttttagctttaacaacgttccaagcgctgccgccgccggcgtaatgcgtccgcctttcttcagataatacagggtatccaccataatataaatggaagactcaaatttatctctctccagaatctccttaatctccgctgcactgtgtccttgctctgccagtgccatcgcgtccagcacagactgccgctgcgtcacagagattctctggttattcacaacctgcacctttccttcgtaatcctgcgccagcatcaacgctgtctcacaggaaccgctgagtccggacgacattggaatatgcacaatctcatcatactccttcagcaatgcatcccatgtatcggtcacattcccgacaagcggcatcgatgtggaaatattggcattctcggacagcatctgataaaactctttctgcgacagatcaatatcctcatataatgtcttgtctcccacaaaaaaaggcatcggcagaatggtgattccaagttcttccgcctgcaattgcgtaattccgctgttgctgtcagatacgattgctactttgctcataacttctactctcccttacaatgtctctgatcgttccttgatgttcttcttaaaattgatgatctcatgctcatactcagtattcatataagtggaatgaatcataaaatctgccgacgcccggttgttggcgatcgggatgtcatacacctgcgcgatacgcaaaagcgctttcacatccgggtcatgcggctgtgctgtcagcgggtcagagaagaaaatcacaaaatccactcttccctccacaatctttgcgccaatctgctggtctccgccgagagggccactgttatagcctcttaccgggagtcctgtctgatccgtaatcatacgtgctgtcgtacctgtgccacatagaaaatgctgctttaaaatctccttgttctgctcacaccagtcaatcagatctgcttttttattgtcatgcgcaatcagtgcaatattcttttgttttcctattgtcattgtaataaaatcttcactcataatctctggataccccccttatcatttttctaatgcattgtaccatattttgtcccggaccgccaccaaaaaataatagaaagcgcaccgtagcacgctttctattattaaaaacgctaaaatgactcttctattcattctgcatgtatacttttgtataccgcatcacgcctgttcctgtgctacaacctcacgcattctctccgaaatcttgtaaatttcgccaagcagatcattcagattctccatattctgcatactatcctcactcatagacatgctgttttctgaggatgccgcaacctcttcactcgttgcagataaattggtaatactgtcattgatctgcgtatttgctgaaaggatactctccacctcaccagacaaattctgcatagaattctggaacaaattcatcttatcctcgataacagtaaacttctctctcgttgtctcgatcatctcgttctgcttatctgcagactccgctgacttctgcatatttacagaggcttcctccacatttaccgtcaatttttcgataatctccgtgatctttcccgtcgactccttcgtctcctctgaaagcttgcggatctcgtctgccacaaccgcaaagccttttccagcctcccctgctctggctgcctcaatggacgcattgagtgcaagcagattggtctgatcggaaatgcttaaaatcgttccgataatgacctccacttcctttatgcggttgtccagttcttccgtcgtggttcttgtggcgcggttgatctccgccgtctgggttgcctgctccttcagctcggcgatcaggtcagcgccctcacggagcgcgtcctgtgtcgcatctgacgccgtctgcatctctttcgtctctttttcggcgttttcaatattcgtctggatgccgttcgtctgcatcgtctgctgctcaatcgcttccgccgtcagcttgacgctcgatgcaatctccttgacggagttgttgctgctgaccatgctctccgtcagcacatccgctttctctctcgcactgtcgaacttctcggacagcgctcccgacatctgaatgatctcatccgccacacgcgccgccgcatccatctgtgacttaatggcatctgtatcctcaacatggtgtctcgcctgcagatctaccgcaatacacatcacaacaccgaaagaaatggcaaacactatctgtacaactgactcgctccgtgtcccaggatatttcacaaaatgaagtatgcccgaaattacattcagcactcccatcgcaatagcgctggtgcgtgccagccttatatcacgatacaacataaccgtaagcataattaaatacataaatgcataaaagaccacgttcttgtttgataagatcatcactgcataggtaagaaacatacacgaaagtgaaatcataacaaatttcctatccccgcgataccggacatgtccaacaaaaaatatcacgagaagaatgacattgactaccatgcgcgccaacacaacagatttatccgctgttgcatccacaaatccaagcagcgtcagtgcattcaaaagcccaaggatgataagtccaaggatgaatgtaatcttgttgcgttccaatctttgtttttgctttaatttcataactatcccttcctttgtaaacaatctcacccgggcagacggatctttccatccatcagcatcttcacgaatgccgtatcccggataatccaggaatctttctcaatcagaatattcctgtgatagacttcctccggcgtcgcccattttaactgatacccctttgcaatctcactcggggtaagtgaaagtggtgcctgcctgtccaaaacatcgcagtaaaaaaaaagagaatggcagataaactttttatccggctcaaaaatatctctgtgcagttctattatctcgcccagctcacagatactctccggcctgacataaagtcctgtctcctcttttacttcacggatcagcgtctgctcataattctcacccggctcctgcccgcctccggggatcttatattctccctcccggctgcactgcatggcaagcctgccgtcacgcacaatgatcgcccgtatcgaatacttttcatagatacccgtcgtgccctcataatcacgggcatcaaatgtcgcaaggatcttcatacgcatttcctccgtgccgcttcacttttcttgaattatattccctttttgcaattatcgcaatatttttcaaatatttttattttaaacattttctgtaataagaacaccgttttctaattgcagaaaaaaaatccaccccggtcgattgaccgggatggattccctcttcggatgggatttacatcattcccattccgcctgcgccgcctgccggcattgccggtgcgtcctctttgatgtttgccacaacagactctgtggtaagtaaggtagatgctacagaagttgcgttctgtaatgcggttcttgtcaccttaaccggatccaggataccctgctctaccatgtctacatactgctccgttgctgcgttaaatccaacgcctgccggagattcttttactttattgatgatgactgcgccctctaatcctgcatttgcggaaatgtagtacagcggagcctccaatgcctttaagataaccttcgcaccggtcttctcatcgccctcaagcgtatctgcgagtgctgccacatccttggttgcatgaatgtatgcggaaccgcctcctgcaatgatgccttcctcgactgctgctctcgttgcgtttaacgcatcttccatacgaagctttgcttccttcatctccgtctcagttgctgcgccgacacggatcactgctacgccgcctgcaagctttgcaagacgctcctgtaacttctccttgtcgaactcggaagttgtctcctcgatctgaccgcggatctggtggattctcgcctgaatagcgtccttattgcctgcaccgtccacgattaccgtgttctccttctgaactttaacggattttgcacgtccgagctgatccattgtggtatccttaagctctaatccgagatcggagctgataacctgaccaccggttaagattgcgatatcctcgagcattgcctttcttctgtcgccgtagcccggagccttgactgccactacattgaaagtaccacgcagtttgttgacgatcaatgtagtgagtgcctcgccctcgatgtcctcagcgatgatgagaagtcttgcgccgctctgtacgatctgctctaataacggcaggatctcctgaatgttgctgatcttcttatctgtaattaagatatacggatcatccagaaccgcttccattttatccatatcggtgcacatatatgcggatacatatccacggtcgaactgcataccttctaccagatcaagctctgtctgcatggtcttggactcctcgatggtaataacgccatcgttggataccttctccatcgcatctgctaccatgttgccgacttcctcgtcacctgcagagatagctgcaacttttgcgatctgatcttttccttttactttggaggacattgcaaggatggactccactgccttgtcagttgccttcttcataccgcgacgaagcacgatcgggttggcgcctgcctccagattcttcataccttcctggatcattgcctgtgcaagtacggttgcggttgtggtaccgtcaccggcaacatcgttggtcttggttgcaacttccttgacgagctgtgctcccatgttctcgaatgcatcctcaagctcgatctcctttgcgatcgtcacaccatcgttggtgataagtggtgcgccgtaggacttgtcgagtacgacgtttcttcctttcggtccgagtgttactctgacggtatttgccagcttatctacgccggctcctaatgctgttcttgcctctgttccgtatttgatttcctttgccatgactgatctacctctctatctcttattctgattcaaattacagggatgcctcccggctgcttattctacgacagccagaatatcgctctgtcttacaatgatgtattcctctccatccagctttacttctgttcctgcatatttggaatagatgaccttctgtccggtctttacctgcatggtaacttccttgccgtctaccattccgccaggacctacggcgattacctctgcctcctgcggcttctcctgtgcactgctggtaagaataataccagactttgtggtctcctctgcctcacactgttttaatacaactctgtcactcaatggtactaatttcattttgtagacctcctgttttatgatctgaaataatatctttcgttttgttattagcactcatttcgtttgagtgctaaccgatagtgttataatagttttttagcatgtgatctgcaaccggatatattcctgtatatttgtatttatgttgtttttttctcgttttttcttttgttttcttgtatttttatattttcatccattttttttgattttatactttttttagaaactcaccgtcgcttctctccaacgacctgtttcaccgttttgcggacagttttatttccctccgaccacaggagttttaaggcttttgcaaagaccttctggctcttctccggcagacggcttttcgccttcatcagctcctgcaccgccttccatttgctgtggtaaaaatcatccaccgtcttaatgtccgccgcttcaagcatgccgaataccgtatccacaatctgttcgcgttcctccccgttcagctggtaaatccatgccttcatcgtctcatccaacatcaggctctgggccgccacctccctgacatagacaaaggatgtgccgagcacctcccacgacatggcatcgtgctgctggattccactgttggaactgcgcaccacctcatacgcctcctgatgctctaagagcattccgacaatcgaagattccggcagaatcgtgtggattttcggcagtacgcgctggtatgccgcgctctctacaatatccctgcggaacccaggtccgtcattgctgtacaccgcaagaatcctgtcctgcagcccgctgctgcagtggactgcagcatagaccgcaagatttccgcccttggagtgacccccgatgcgcacggggcagctgccatctccaagcatctgttccacgtacgaaacggctttcagctgaccgggcgtctccgagaggtatcccatattaaaatcctctctccaccctgtgatcgtattgtctgtgccgcggaacgacacatagatactgccatccggcagcccggcgcacatgaccgcaaactgtgactgctcctcctcactgatgtcattgacgtaaccccagagctttacatcgcggaaccgctctgttttcgccatcttctccagaacaaacggcgccgcctttgtcattgacacccgcgcaaggatctcctccctgctgttctgctcccagaacacggcggatgcctccgcaagcgtgactgcctccgcctcgctctgcccggtcacaatcccgtcaaacgaagtatataccagctccgcaaaaagcagattatccacctcgttaaatccggacgcggtgaaagtcagatccccccgccagtccagataatccatcatatttgccatcccgctcctccttctcttcccgctgcaatcccgttgcttcctatccgatcagcccatagtgcttcagtccgtttttaattccatgattcataatatcggtcgtcacatactccgcggcagccttcgccgcaggtgccccgtttcccatggcgatgccatgtcccacataggtgagcatctccagatcattcgtgctgtcgccgaacgcataagtattctccctggcaatcccaagcatgtcacatacctgcgctattccggtcgcctttgtgtagcccttcggcaccacttcaatcagctgcggattgtgctcaatcacatcaaaatgcggcaccagttccgcttccaccgcacgcacgctcgccccgttcatataagcgctcaatttgttgatctcatactccgtctgcccacggatctcccgtacatcctctcccagttcactgcgcagatactgaataaacggatcttccttaaaatcttccccgtttgcgtagatataatgcggtccctccagcaccgcttccatgtggtatgcctcaatgacacgtagaagttcctctgcttcttcaggcgtaagcagcctctcgcacaccttctttccttcatattcaatatgtgtgccgcacgccgccacaatcccgtcaaaccctattccaaggatcttctcactgcggatgttcgaccggcttctgccgctgcacaaaaacgcataattcccgtcagccctaagttcgcgtatcgcttccgttgtactttccggcacctgcatgtgctcattccacaaggttccgtctatatcaaaaaacactgcttttttcatcttttctctccaatccgtatctattacacaaagaatctcgcttgcgagattctccgcgcgcgagcggttcgcaaagcgatattttccttaccgcgaactgcgcatcctcgcggagcgtttttgtgtaataggaatgaaatttcctattacacaaaaaacaccgcgcgggctgaactcattatatcagcccgcgcggtgtctggcaacttgcggtttctatttcaaatatcctgttactctctgtgcatggagatggtgttcatctcgtaatgctcaatgttctcgtgaattccacgatcatctgcctgggaaatcagaatgtcgcggttcttcttggaagagatctggtcgttgaacgcactcggtccgccgacacagccgccctcacatgccataccctcgatgaaatcctccggcagtctggctgctttcagaagaagcagtgctttcttacactcggcagctccgtttgccacgcatacctttgcatcgatctcatcctcagactctttcagactctgaagaacagctgcggttacaccgccggaatttgcaaaacgcttaccaaaggtggatgcgatctggtcgtcatttgcagccggctgcagtacgacgctcttcgctttcatgatcgcacggatctcactgtaggtcagtacatagtctgcattgcccggaatctgctgatccacaacctcagacttctttgcaatacacggtccgataaataccgtgacagcttctggatctcttgccttgatgagacgggaaaccgcgcacatcggagataccgtcgtcgatacacagtctgccagatccggatagtgcaggcgcaccatatttacgaatgccggacagcaggaggtaactttcttctcgcctgccttgtaagcttccgcccactcctcggactcgtaagccgccgtcatatcaccgccgagacctacatcgaagaaatcggtaaatccgagttctttcatcgcattcttccagcttgccatcgtgatgtcatccccgaactgtccctcggtcgccggtgcagccatcgcatagatatgcttaccctcgcgcagtgcattgattacatctacgataaagctcttggagccgatcgctccgaacggacagctgtggatacatttaccgcagcggatacatttcttcttgtcgatgacggagatcccgtgctcatcgtatgtaatcgcgttgaccgggcagctgaacttacacggtctcttcagatgtgcaattgcattgtacggacaggcctgcgcacatcttccacattctttacattttgtaggatcgatgtgggagcgggttcttcccggctcaatcgcaccgaatttgcaggcattgatacaagcctttccaagacagttctggcagttctccgttacaatataactggaaatcggacagtcctcacatgcagaactgatgacctggatcacattaccgtcatcggtcaggcctggcgcttttccctccgccagacggactctctgtctgataatctctctttctttataaatacagcagcgaaactgcggtgtcggacctgggatcaggctcattgcgatattatctctcttctcgtcaagctcaccggcaaatgccagctttgccacttcatagagtacgtcgtgtttgattttgatcacattttcatcagcatacatcgtgttttacctcgcccttttctattcgttaattttttaaccatcttagacattatatattatctgtatggaattgcaagagaaacgcatgtatttctttgcgtacataatgtataccgtcaaattgcaaaaaatccgcctgccgttttgtgcaatatttttccggaatgcccgccgtactgttactttggtacctgttccatcaggaatactctcatctgttcctcctcccagatcacgggaaccggatagttcggattgccctctttgagtgcccgcgccgcaagttccggcacgtcctccttacgcagcatggcaagctcctccgagatgcccatgctccggttcatccgacggattctctcgataaacgcctccgccagcacggcatccgtctcctcacggctttcatcctcagccacggacgtacgcacttccctctccagcctggccagcggcgtatacacggcacttccgtatgccgcaagcaccttcggcagcagaattgcattcgcctccccgtgtgggacatggtagagtccgccgatcccgtgtgcaatcgcatgcacatatccgacataggcattggtaaacgcgatccccgcctcgtaggagccggccagcatgttcatccgcgcctctttgttctccggctcacggtaagccgtcagaagattggcaccaatcaggcgcaccgccttcttggcatgcgctttcatcttcggggaacagaaccggttgcagtatgcctccaccgcgtgcgtcagcgcatccatcccgctgtaggcagtcatatccggcggcagggaacagctaagtccaggatcgagaaacgcatagcgcggtatgagacagtaatccatgacggcatgcttatagtggcatgtctcatccgtgatgacagccgccagcgtcacctccgagccggttcccgccgtcgtcggcaccgcaagaagaagcggcagctttttgtgtatcttaagcatcccgctcatttttccgaccgggagatctctccttactgtgcgcgctcccgccaccttggcacagtccataacagagccgcctccgatggcaaggatcgcctcacagccggatacaaaaaaacattccgctgccgcctccacctccgccaccgtcggatcaggcgatacctctgtgtataacaccgtccggatgcctgcatcctcacactgcgccagaagcggcgcaatcgtcccgcgccggatcgttcccggcgtggtgatgatctgcaccgcttttatcccgtgtgtcttcaatacttccggtatccgggtgatacacccgtccccctgcaccagtgtctgcctccccgccggaaacaggcggagcattcccgcgcagagcgcctgatagacgcggtatatagcatgctttccgttcatctcattcctccctgcccttatgcttctccatctttctgcagggcatactttttcacataatgatgatgctggatcgccacattgaccggggagagcgatgccgacgcacccgtcgcgcgcacatgaagacagcagactgctgcctttgccacaagcgcccttaacgcctccacatcatccgccgttcccgcggataccacaacgccgacacgcggtacaagcaccgccccgtattttcttaaaagtccaagcatatctctgcgcacatgaagacagcacggaatcttcctgccgatcatctgtgccatatcatccacctgcgccgggattccccgtccgctcgccgcgcagagaaggactgccggcgtatcgcagattcccacataatgaaaatgcttctgtaagacgtgaaacagcttttcctggcgcttctggtcttttctcggcttctttttcggctgtcccaaaatgctcctcttacagatctcctctaagagcatggcgcgggaaaacgcctcctccctgtcctttccgcagatcagcacgccgtggtgcaccataaagaccacctttgctcctgactgcatggcatcgtagaccgcccctgcaagcttctccgtactggaaagcccgtatgccgctctcgcgatcccgccgagcttctctgcctcttcctccgtcatggcaagctgctcaaagccgcagagcccgatcgccgtggcataggtctgatgggtgtgaatgacataccccacctccgggaatgtctgatacgccgccagatgcacacccttttcgctcgaaggcttatgcgcgccgcagcacacaccgtttcttatgtccatcagcaccagatcccgcgccgtcatcgtctcataatccagcccgctcggcgtgataacaaaatgattctcgtcgatacggcagctgatattgccccaggttctcgccaccagtcccgcctgctgcagcttttttccctccgctgcgacaaggcgtctcgccatctgttcttccattccagtctcctccgcttctgccggtgcccgctgtcacccggctttttctctattctctattatcttccataagaagctgttttgcaaccgcatgtgaaacattatatgtccgaagtcccgtctcatttaatgcctcttcattcgcctcgcagtacagctgataccagccctgctttctgtagtccgccgcgtcgctttttcccgcatatttttcaatcgccggcgccgcatccgtcgagagggtgtaaagatagctgtagtccaccgtctcctccccggacgcttcccacgaggtgtgcgtcagattgtaggcggcgataaaataatccacatgggaaaaggcaaatacgagatacaccgctcccgccagcacaaatccataccggaacagcgggaactgcggttttacaatctttgcgatcacgccagccatcaaaagtgcaattaccgccagtgccaccagcaccgacacacgcagaaacgtcagttggtacgcccggatatagagaagcatccggcaggcgctcgacgccgtcataataagcgtgcagcctgaaatggcaaggagcagcgccttcaatactctgttctccttaaaatagctctgaatggaaagcaccgcagccagattcagcacgcacacgaacaaaagctggaaaaacccgcgtctggcgtactccgcgtaagtaacccccgccggaagctgcatgtttccgataaaaagatacacgatctggattgccgaaaacagaagatacagcacggcaatcggcgcggtaaacgcaatcgctatcagcggttccgccgtttttccggcggaaggcttaatgtctgccgcgtgcttttgtacataccgcacaccgcagtaggaggataagaacccaaacaccagcatgagcagaatccgaaacagcttcgccgggaaccggaacactcccgcaaaccgtacgagcagatctgcaaataccatgtccgcggacattaacagaagcaccagaaccatcagacagggcaccgccgcgcagatcccgatgagaacataccagcccgcatggctctctcccgtctttttgctgcggtaaaatgcgccgccatccgcaaacggcttcccgataaagcagaccgcaccgcacaccgccatcacaatctccgccagatatttcccaaaattccatccggcatcctgcgcgaagttgtgcagaagaatcccaacaagcagcacaaaaatgataagatcattcatccagccgatccattcgttccccgtcaggacggtagagattccaagcagcacaatcatccccagcacaatgccgttgtcccgtctctccttttccccgaacatccggaacacaaaacgtacataccacacactcgacgccacccaaagcaccgacgccagtcccatcacattttcaaacaggcatcccgtgtatacaagcgcatagagcaggctggcgcccgccagcttcccaaaaatctttgccccttcctgattctcttcctccggaatcatttccttcggattcatttccctaccgatcatgatctcttccatcgccgttctcctccccttcttcctctacatactccagaatatctcccggctgacagcctaatgaccggcagatcttatcaagcgtatccatccggatcgcctttgcctttccattctttaaaatcgaaatatttgccattgtaatgccgactttttccgataactcggtcacgctcattttccgcttcgccaacatgacatctatattgatcctgattgccattctcttcctcatttccggacgatccgcagccgtcctatattgtcaactccgcatcctgcttcatctcatacgacttatagatcagatgggacagcgccgccgcaagcaccgcgatcaccacattgataaaaatgagcagaatcataaaaatcagaaatgccggtccaagcgcccgctttgccgcgaggaacagaattcctgcaaaccagaccaccgccagcacaaacgccagcctgctgattaccacaaacgaccttgcattctcaccggaaaaagaattgtcgcgtccgatctgcacgcagaccttccagaactgatagagaatggcgtagcagaacaccgcaatgccccacccgtagagaatccccggaatgcggagcgccgcgtagtccggatatgtcaccgccatgtcccatgccagatacggcaccaccagcccgaagaacaacagtcccatccctgcaatcgaaagtgtgatcccctttaaccaacctgccacctgtttctgactcataattacctcttttccgcaatcttactgctgtatttttctcacagctttattatatccatgtttttccattttgcaatatatttttatcgtttttcgataaattcatatcgttttaaggaaatcttaagaaacaaaaagagcaccgatctctcggtactctccagtggaagcaacggggctcgaacccgtgacctctcgcgtgtgaggcgaacgctcatcccggctgagctatgcttccatatctgctattatagtcctttcgcagaaaaatacaacctcaatttaaaaattcctctttctcgagcaaaagccgcatggcccacggcggcaccgccgcttcgtcatagtcctccagaaacagaaacgcagtccggtagtccgggcgctttgccggataccgcccctttccgtccgtaaaatagagcagtcccgccagctcttttaattctccctgttccagaagatcattgacataggaaaacgccgggcgaaaatccgtgccgcccccgccaaggagtgtaaagtccctaagaaatgcctccatctcctgctcacccgtgatctttgcatcgcttcgtaccacattgtcgcactgtaaaacccggatcacggaacgcgcaaagaaactgtcgctctggtgcaggatgtttgccgtctcgcgcaaaaactgttcgaccagttcaccgctggtggaatagctggtgtcaatcacgatcacaaactcgcggatcttctttacctccctgctctcaagcggctcgatgagcggcagattcccgtataccgaaagtccgtacgtgtaataactcagatcaaattcctcagggtcggcatgcagttcctcgtgcagcacggcaaatttctgcaggaaatcccggtaacttcgtctgcttttccccgccgcaagctgcgccgccagaaggtcttcaccgtccttgggcttctctccccgccgctcctgctccatgcgggtctgcctggcgatctgattccactttttctgattgtccgccgcagccgcacactttgccgcatcgtcctcccgcttcggccaatatttgtgactgtccgtgtaaaattcgcgcgctaacgcctgccattcctcacagaccggcattccctccgccggcagcggaaaatagcgctcccacaaaagatcgtagacgacggcagccgacacgccctttttttgttcccgcagttcttcgtacagcttctggcgcgtccagcttaagatccgtttcgtacatttttttcccagaccgtcaatcgtatattccacagcaacatcacaggcgagattccacagccgcctgtcgcggttccccgcaatccacggatgggagaaaatacagtgcagcactgtgtgaagataggcacggtttaggtacggtgcatttttctcaaacacacgcagtatctgctctgtggagtaaaacagatgtcccccgtccgtggcaaagctctgcagcgacgcatccgcctgcggcacaagtgccgcgaacgcgacgtccagataccgcatttccaggtacagttcgttgcgcacataagaaagtatcttttccgctatctgcacttcccattcttcctgtgtctgtatatgtcccatgtcctctctcctcttccggtttctttttcagaataccctgcatccgcacgtacttttccgtgtaaaaacaatcttaaaaatcgtcaaacgaatagcgctcgtccggtgttttctccgcgaaatactgctgcatcagatgaagcagcgccgccgctccctccgcccagtccgcttcccccgcacgcatggcgcacgccgccacgtcctcccgcgtcagaaacttccggctgcagcaatcttccgccagttccagatcccggtcatccgtgatgcggcggatgagataaccgctgtgcgccttcagatactcctcgtagagtccacgcggcgcctccgaaagttccgccgcatagcgcacgcggtcgagtgccagccgtcccagcgttgcctccgattcatccacacacgcctgcgggaaaatcttatcgtactgtgcaaaatcgagcacgtcctcgcggaagctctgtctcgcccgaaatccctcccccacaatatttctgccgaaaatatgtgccggcgcgatctcgtcatagctctcataatattccggaaacagcagcttcgcccacacgccattttcgccgcttaaggccacttccagatccgacgaaagctgtgccagcaaaagcctgagccccgtcttttgcccggggtccgcatgcagtaacagccgcgacaggctccggcagttcataaacgcatcgctccccagcgtgtctatcccgcttccaagctccagttccgccagctccgtggcattataaaaagcaaagtttccgatcttttttatgccctccggcagcgtcacgcgcgttatatacgcccctgccagttccgccagcgcaccgtctgctcccggctctgctcccagtgcgccatccgctcccggcatcacgtctgcctccctgtccggcgctgtctccggtgcaccgtctgctcccggctccgcctgcatctccccgtccggcgctgtttccggcgcgccgtctgcctccggctccgccggcacgtagctgcaccggcattctgccgggagatgcgcctgcgccgcaaagcagtagtccccgatctccgtaatcgctcttccctctatctctgccgggaaacgcggctccggcgtctcgccaaacgcccgaagcagccgcgcgtctccctcatttgtcagctcccagtataacttatagttcatcttctgctcctaatgtaaactctacgctccattatacgaaaggcgtttttctctgtcaaatctgcgtcattccgcccagcagaattccggcgttgtcccggtagatacccgcgaaatccgacatgggaagcggattttctcccatcccggcctcgatcgtgtagcccggtctgtcgtattcctggataaaccagtccttatacccggcatatcccgactgcgtgggcgtctcctccacggtatagccgctgacacgcccaaaatactgcgcaatctcgtaggagtgcgccggttcatagtccagatacttccagtagatgacctccccctgcgtgtgatacgcaaggatcagcctgaaatcatgtgatctggtaaacgcgtacaccgcctcgctctcgggcgccgtcaggggtgcctctcccacgtaatctctgggtgccggcttcgtgtacccctgcgcatatttaattctctttgcgttttcccagcctgccggaaactgtagattcaaatctatgccctcgatattcgccttccatccggacggaaacggaattgccggataatccgatgcaatctgctgcgcccgccggtaatacccgccgtccgtaagcagcccgttcaccagatccaccccgtcgggattgacgagcggcacaaggaaaagccggtactcctcaaacagttccgccgccggcacgccgtagagcgccgttcctttttcgtatgcctgcgcatattcctccgcaaatttgagcagaaccggcgttgtgatgctctcatttgcatgaaaagatgcgttgtagaatacctctttctccccgtttccgatctccagatacgaaatcggctttcccatcacacttttgccgatctccccgctctttaaaaacgggtagcgcgccaaaatcccgtcaatcactgctgctgtgagcagcgatgtataaggcacctccaccgacgttaccgggtcttcaaaaaggatccggttctctccctcctccgtggtgtatcctctcagatacggcagcagcttttcccaggcagatcgatccaccacgcatatgcggtccggcgtgcggtcggtctgcaaaaaatcagcgagcgcccggcaggtgttcgttccaaagatgccgtccaccaaaagcggataccccgcgcgctttaacgccagctgcatgtaagataccaggattccccggtctccctgatacagatttttcaaattctccttctttccggcacgagaagctcctcccctgccatacgccttcttcttatcttatgcagacactcagccatttagctgtcacttttccacagacgcaaaatggacatgggtggaaaaacagtccgtgtctttccctccatgtccattttatgattgttataaactctccgcctccggtcagcaggcttcgatctccttgatactgcattcattgcctgtcacaagatacgtttcatagcttccgcagtgcgggcactgtcttccgtatgtaaccgtctcataggtcttctgacagtcctcacagattgtgaccgccggaagggactctattttcatctcgcactctgcgatcagcggattctttttgcggtaaaattcccagcactccgtcagatattccggcacaatgccgctgacctcaccgatgtccaacgtgacagatccgattttttttaattcgttctccgctgcaacctgatccagcgtctttgcgatatgaacgataattcccagctcgtgcatatgactcctcttaattcttgttgcgtttgatcgcaaactgacgctttaacgcatacggtgcgatggctttcagtttgtcctcagacttccacatacggcttgcatccggcagatcgcgtgtcagatgaatcgcatcaaactcacacttcgtcgtacagattccacagccgatacacttgttctcatccacaaccgaagctccgcagccgaggcagcgctttgcctccgtcttgatctgctcctcggtgagtgtgcagcgcaagtcgcggaatgtctccttcgccacaccggcttttgtacccggaatctggcgctttgcgttgtcaaatgtctcaacatcgatgttgttcttatccagctcgatgaactctctgcggttacgtccgagcgttaagctctgtcccggattgacaaaacgatgcatggatacaaatccttcttttcctgctgcgatggcatcgatggcaaaacgcggtcctgtgtatacatcaccaccgacaaagatatccggctctgcggtctgataggttaccgggtcagcgatggctccgccgttcggtctgatctccactttcgttccctttaacagatctccccagacgatggactgtccgatggaaagaagtacgttctcgcactcaacggtcatcagatcattctcatcatactgcggattgaaacgtccgtccgcatccttgacggagagacacttcttgaagacgattgccttcaccttgccgttctctgtcagaatctccttcgggccccaggaattgtttacggaaatgccctcttcctcagcctctgccacttcgtcctttgccgccggcatgatatcgcgggactccagacagaacatggaaacctcgccggaacctgcgcgcagcgctgctcttgccacatcgactgccacgttaccgccgccgacaacaaccgtgcgtccggaaagctttgtgctctcatccaggttcacgcttcttaagaattccacaccggtcttcacgccatccgcgtcctcgcccggaactccggccttgcgtccgccctgtgcgccgattgccacgtagaatgccttgaagccttcctcgcggagctgctggatcgtcacgtcttttcctacctctacgccgcacttgaaggtaacgcccatctgacggagaacctcgatctctgcgtcaatgatgtttttctccagacggaacgacggaataccatttaacagcataccgcccggacggcactctttctcgaataccgttaccggataacccatctttctgcagtagaacgctgcggaaagaccagccgggccaccgccgacgatcgcgatcttctgcggcagatccacgccggttccgagatggttgacgatctctgggatatagcgcttatccgcatgcatctcctgctctgcgatgaatttcttgatctcatcgatggctaccgcctgatcgatcgttcctcttgtacatgcatcctcacaacggcggttacagatggaaccacagactgccgggaacggattctcgttcttgatcagctttaaggcgtccatatatctgccttccgctgccatcttcacataaccctgtaccggaacgtgtgccggacaggcggtcttacacggagctgtaccggtctcatagcagttgatctggttcttgtcgcgataatccttgctccacttctccggtccccactttgtcgcatccggaagttcctgcttcggataggtgatctcgccgttctttgtgcagagcttctgtccgagctttgcagcgccggtcgggcaatactccacgcagcggccgcatgccacacagttttccttggtcacatgtgcgcggtatgcagaacgggacatgttcggtgtattgaacagctgggaagtgcgcagcgcgttgcagacgccgactgcacagttacagattgcaaaaatcttatcctcgccgtcgatgttggtgatctgatgtacataacccatcttctcggcgcgctccaaaagctctaacacttcgtcaagctccacatagtgtcctcttccggtctgtaccaggaagtctgccatatcgccgacaccgatgcaccactcgccctcgatatcgccggttccctctccgcggactctctgctgcagacggcaggaacactgtccgatcgcatacttatccttgtattttttcagccagtgggaaatgtgctccacatccgcagactcctgcactgccggaatagccttctctaccggaataacatgcataccgataccggctccgccgagcggcaccatcggtgtcaccttctccagcggaagtcttgacatattctcaaagaaatcagcgatctctgtgtgcttttccacctgctctttgttcattaccatgaactcggcgcttcccggtacatacatcggcagaatgtactgcttctcatgctgcggattctcccagttgtactcaatgattccgacaaccgccatctcctgcagcagcttctctaactctgcctccggtttcttggtcttctttgccagctttggaagggtgatcggcttgcgcacgtccatgcatagtgccacttccgccatctcatcggtaaccacacctgcaaggccccagtattccggatcgtttaccgtgagcttctccataccaagcttgtacggaatacggtcggtaatctttttcccgagctttaaaatcagttctctttcttctgccataacagtctcctttttcctttgtttttcgttgtttttcctgtttgttttattctgtctcgtctgttttcgtcttatattgcataaatagtgcgcactcagagagtgcgcatactcatagcctgtgtatacccataaaatatgtatgccgcttccggcagtttttaattattccactgttttacttccgtgcgaagccagtcgtaccacgcatccatcccctcgccggtgcgggaagagatcggaatgatctgaatgttcgggttcagcttcttcacgcgctctttgcatgcctcgatgtcaaaatcaaagtacggaagtacgtcgatcttgttgattaaaagcacgtcgcagatggaaaacattaacggatattttaacggcttgtcatccccttccggaacgcttaagatcatggcgttctttacggctcccgtatcgaactctgcagggcagaccagattgccgacgttctcgagaatggcgagatccacgtcctttgtcccgaggctctcaatgccctgtctcgtcatgtccgcatccagatggcacatgccacccgtatggatctggattgccttcgcgccagtctgtgcgatcgtgtcggcatccacatccgaatcgatatccgcctccatgactccaatgcgcatctcgtcttttaacgcgcctatcgtccgcaccagcgtggtcgtctttccagaccccggtgaagacatcagattcagaagaaatgttctgtctgcctttaactcagaacgaagcacatctgcttctctgtcattgtcttccagaatgttcttcttgatttcaatcaccttaaactcactcattcgtatgcccctttccctgtgccgaggtattcctttgttcggttgcgttctggtcatacctcatgtttgtctaaattttaacacactttttctgtgaaatcaacgctattttgcactatatttacggttctgtttttgtgcaatctgccatctggcgtctggtatgaccagaagttttgtcagaaggcagactctttttttgccaaaaggagagcagcgcaacaaatgctctgccctccttctttttaaacctgtatgcggtctgcgatttcttttccaagcgccacccgctcgttctgcacccctatgatcaggctgtcccgcagcttacggatgacctgtatggtctctccctcctccacgtgatgctggcgcagaaaatcgactgcctccggaagcccgaacatccacttgatcgtacatatatctcctgcctgtgcttttgacaatgcgtacataaaaaccccctccttttcttcccattgtaagtgccccaacatctgttagtcaatagaaatattttttattattattcgcattttttattattattcgcacgaattttctggcatttctattttaccatgatatgtacgactaatcgttttttctcattttcgctcaatcgcgtgcgcaggacagttctcatagcagttcccgcaacggagacaatgattccgatgaatccggtacggcgcgccctcctcaatgcaccgctgcgggcatattgccgcacaggcgccgcatcccgcgcaggcatctgtaatgtagtatcccttctcttttacaccggcatccctaagcgtataggtttcccggaaaatcggatttaactttatatccatatcttctataatcggaatatattatctccttccaaactaaaactccaagctatctgcattaagcagaaaatatttcatgcccatgattacaaatccttcctcatttctccaaggcttttttgttccatttactataataatcttcttaaatgaatcaggaatattacggagtgaattaagttcctgtgtctgcttttcctcagaagtcatatcataagctacctgaatataatatctctgactaccctggttcactacaaaatcaacctctaactgcttatgaaccctctttccttcactattctttgcaaatacatccacaataccgacatccacattgtaaccacgcacaagcagctcattataaacaatgttctccataatatgagtcggctcctgctgtctgaagttcagtctggcaatcatcaatgataagaacatttgcacgatcctcagaatccaaaggaagaatggcatccttgatgattcgggttgaaagtattgttgtgaaacggatacagttaatctgaatcattttcataaaacgatatacagtatccttcgcaaaatcaagagtgttccgtcctgtgatcagtttcatgtacatgcttctgttagaaaaaatcagcagaaacaaatactggaaaatttccattactggaacgcctttctttttgtaggcattggacgctttcaaagcggaagaaacatgaaatctcgtaaaaaatcttttgacacccgaatcctttcataaaaaaagagccttccatatcctatgagattaaatctcaaaattcagatatccggctctttttcgttttcttcaaaatttttaatttttacttttctctgtcaaatgccgcgtaagcgcttcttctttcagcaacatttccatgatctgttcgtattcaaagatgcactgtagttcttcctcattgaacctgttcagggcgatctcatccatctgcctgtgcatactttcgtcgtatcgctggtgctctgtataaaactgctctcccttttcagtcagaaacgcaatgatctgccgtttgttttcttcattcttcctgcgacagacgtatcctttcttctccagacgtgatgcgatctgcgaaactgccccctgtgtaacattcatctctctggcaatctcagacatagtacgtccttcaccgggaccgatcgcgatcacaaagtgtgcctctctcatgtagagtttatcatctgccgtatactcacggtctgaatccatatactgtacaaaagctcttgctgtatttccctgctgatgtaataactttccgattaatttgatacgctgttccttcatctctatcccctccgcatatagaattattgcagacaattccaaaaattgcaaggaaacatcttacggcagtaagttaacgttcattcagcagtaaagcacttgctattttgctgcgtatgattttttatttttgcagcattgcaacaaacttcagtgtagcgatcacaccggtagataatactccttcatccacatcaaagaaaccattatgatgtgctgcacccgaaccgtaggacggattattaattccaaggtgtgccagtacactcggacaaattcttcgatagcaggagaatgactccgatgcataccatggctcacaagaggaaaccgttacgttctccagaagtacctccggcaatgcagcggaaataagatttgaataatactcatcgttgatcactggcgcacataaaacacagaaacgatcatcaaattgtacctgacaattattcattgcggccgtatgctctgctacattcttaaagattcggacagctttttctccttcttcatcattgaagaaacgcagggaaccaagtatatccgctgtgtccgggatgacatttggtgcttcgccgccctggatactggtcacacctaacgtaaccgttcttccggcagtaatctgattgacccaggccgtcgctgtattggtcagaatagaggctgcacaaaatacaggatttaccgacatatccggtctggagccatgtccccctctgccgataaccttaatgccgactcccgcagcaccagccattcgtggaccggcactaacacaaatctttccggattcaagccctgcatacacatggattccccagcaaacgtccacaccatgggcgctgagctgatttaacatagccaatattcctctgccatcctcttctccttcttcaaagcagaaatagatcacgcctgccagattatcacgttgctctgcaagaacacgcatagctcctaataacattgctgtatgggcatcatgaccacatgcatgactcgtatgtgggtcatcggacactacaacacgaggacctgcaaggttatttggctcctccggtaccagaagcgcatcaatatctgcccggagcgcaatacgtgatcctggcttccctgtgtcaagaattgcgatccaaccggtatcaccggctttttcataaggcagaccggcttttttaatctcttcttcaataaaagcacttgtcttgaattccttaccgcttacttcggcaaaacgatgaatggtacgtcggctttcaatcacataatcctgctgtgcttctgcctgcaggcgaattatttcattcgtcagcataaaaaccctcctccttttgttctacaaagctgcatttatgttcttttctgaaattagttatctaatacagaagcgatccgatccagagcctctaccagcgtttttcttgtacagccaatattcagccttaaataaccttcgccgcctttgccaaaccatggtcccggtacacagatcacttcttttcccataataatcttcttaataatctcttcgtctgtcagtccggcactggcaagatccagccagcataaaaatgtaccctgcggtgctgtaaatcctacattatgcttttgacaccactctgaaacaacctccacatttccctgaaggtaaactaataattcttccagccatgcctctccttccggtgaatatgccgcctgtaccatctccaaaccaaatgtattggatgcgctgtatgaataagcatcaatctcctgatcatactgttttttcagttctgctgaagagctgaaaatattcgcaaggcgaagtcctgctacattaaaggtttttccaagagatgtgcacaccagatgcggtgcatcacttgccagcgcaaacggtgtgtgaacatatcctgcatatacaagatcactgtggatttcatccgcgatcacaaggacattgttctttttacagatctcaccgacacgggcaagctcctcttttgtccagactcttcccaccggattatgtgggctgcataaaatcataatcttcgcatccggatctgctgcctgttcttcaagcagtgggaaatccatctcatatagtccatcattacagatcaggccattgttcaccattactcttcctgttttcttgatcagttctgcaaatggatcgtatacaggttgctgaataataactttatctcccggattactgaatgcacggattgcaacattgatcgcactgacaacggtcggcatcatggaaacaaggtccgtatggatcttcattccaaatcgcttatcaaaccaccaggttaatgcatcataatactcttgcttataagagcaataaccaaaaatctctttatcggctctttctttgatggctcttacgatgcactccgggcatgcaaaatccatgtctgcgatccacatcgggatctcattttccgaaacttctatcggaagatacccctttaatccttccgggcgccatttcacatcacttgtacttctacgatcgacctcacggttaaaatctacgctcatcttcattttcctcttatctttttactgcaattgcctcaatctcaactttcgcattttttggtaaagctgctacttcaaatgctgcacgtgctggaaatggttctgcaaaaaattctgcataaacctgattcatttccgcaaattctgcgatatcagcaagaagtactgttgtctttgtcacatctgccatcgtcataccattctctgctaaaattgcctgcacatttttcagggactgacgtgtctggcttgcaatgtcgttacctgcaaactctcctgttgcaggatcgattgggagctgtcctgatacaaatgcgatgttttcagctgaaatcccctgtgaatatggaccaattgctgccggtgcctgctctgttttgatttctttgtttgccatacttttttctccttaaatgaaatattttttatcttaataaaagcatactcgttttagaaactaaagtcaatatattttagagtctaaagtgtagaaaaaaaacactactttttgtgcaatgtgtttacatatatgaaattattttttaactattcggatacttattgatcatacgctcgatcagctcaaccgattccttgattccgtaacttgcactgtcaatacacagatcatagttgaccgcatcaccccattttttaccggtgtatgcatgataataacgttcatggcgtttatctaacttctttaacaggtgttccgcttgcttgtagtttaagctgtttatttccatcatacggcgtacactctgatcaaacgatgctgtgatgaaaatactgatatgtgggatatgatgattcgtgagtacaacgtccgcacatcttcccataacaataaagtcctcgtgctttgccatatcacagatcagatcactctggttaaagaaaatggcatcctgaaccggaagcccatgatatttcttaaaatctttgaaaaatctgcctgttccggtatctttttcaaatttccccatcatctcttccacatagttaatttgatattaacaacctgatgaaaagagaatttttatgaatcacaatatacagacattcaaaacaagccaacatccggtctatactttcagccggaaagttttcaccgaaggaatgcgggacggatttccgatcgcactcggttattttgcggtatccttttctcttggaatcgccacaaggaatgccggtctgaatcctttacagggatttcttgccagcctcctcaataacgcctcagcaggtgaatatgctgcttttacactgatcgcagcaaatgccacttatcttgaagttgcgatcatcacgctaatctccaatgcccgttatcttttgatgagctgtgcacttgcacaacgcttctcggaagacaccccttttatccatcggctttttatcgcctatgatgtgaccgacaagctgtttgggatcacaattgcacgccccggctatctgaacccgttctctttcaagtggaacaaggaccattcttttgacggtgatcctgtcttctgctgctgcgatcctattcccggtcaccccggaaaaagataaaaatgcaactacctaaattgaaacattacatatatttcactctgtcttcactatcgaaaggagtttttttatgacacacaacccttatttttatattgctgtcatggcacttgtatcttacacgacccgtgtgcttcctctgactcttatccgaaaaccgatcaaaaatcaatttatccagtctttcttatattctgttccatatattacgttatccgtcatgacttttcctgcgatcatcgaagcaacacaaagtcctgttgcaggtgctatcgcactcgtttttgggatgatcggtgcatggtttggcgcaagtctgtttcaagtatctgtcggctgctgtacggttgtattgatcctggaattaattcttgtatagaaatgtttttctgtccttttccctgtttttccccgtttttccttgtcattcctattttctcatgatatattacatatatatatcattattattctgatatgcaatcattcaaggaggtaccgcatacatggtacaatattacaatacaggggataaggatagtacgaatctcatcgcctatgccagtgatctttccatgttcgctatgctgttcacagatatgcaaaatggaactcgtgactacggtaatgatcgtccgatcaagtctgtcgaagtcgctatcttatctacgattgaacaaaatccagggattaccgtaagtgatttatcccaaaaacaacatcggacaaaaggaactatttcatccattgtttccaacctagaaaaaggtggctacatttaccgcgaaaagcgtcccggtaatgcaaaagtagtgcatctatacactactccggacggtgaacgtctgaataccctttatatcgcttttgtcacaaaaaaaacagcagagatacagtcagaactattaaaggtctgctctatcagtgaaatgaattctttttgtaaagtcttacatgaatatgttaaattattgtcaaaagcttttgatgaagaatcctagcagagagatatttaaaaacacaaggtttttatatctctcttttttctccccaaaaacaggaagttttttctgacatttatttaccaaatcagagtagggtgtcaaaacgtttgcatttaagtttacaaaacaaacattttgaccctccatatccgaatcatgaaaaaagacagcgtatccaatttggggacactctgtcttttttattcaacgtatcaacgcttgaattattctttcaacacactaatctttttcttattaattaagcttctttgccgtttgctgcgcggaattttacgattcttctatcggaaataaatgcacaaacaagaccaattaccatagccaaaatacagcttaagaagatctttttgtatccacctacaggatcagcttccagccatttaccacataatgatgtgtagaatgtatccggaatgaatccgattaaggatgagataccgataacactaccaacgatgttcttaggtgttccttcctcatctactgttgcgtaatacagagcacggaatacatagatcatcataagagcaactgtcattacaacaagcattggccacataactgctgtagatgctggtaagatttccataacaatatataaacctgctccaacaacaccggctacgatcataggttttgtggaacgttttaatttagttgctaaaataccagctgcagatgcagcgattaactgtgtaacgatcttgctgtagtttgaatataaaacaccgatttttaccggtaatccacaaatgttctgtaagtatggtgcaaaataagttgtagatgcaagacacatagatccacagaagatcatacctgctaacagatatgtgattggacatttaaatgcaacacccatagctttgatactgtcaagtaatgtatcgtttgttgcagcttcagtattctttggctttggcattaagaatgctaaaagaacaccgattacgatcataacaattgagataagtaatacattgattctcatagcttttgtgctatctgctgcgtttgctgcataaatggatgtaaagataatagtaagaaccagacctgaaacaccacgtcctgcttccaggcttccgaacataccgccctgttctccatcctcagcgagcatgttgacacattttacagaagaagaccagaatgtaagtacggttgttactgcaaataatatatggatcagtaacaggattgtgtagcttgggaatgttgcttcccagagaccaagaacacctgttgaaaccatggaaaatacaagtaacttcttgcagtcaaatttatctgctacccatccacctggcaggtataaaataacgtttgcaataccatatacgtttaataatctaccatagtcagcatctcttccaataagacccatagcctcctgtaatggtgtatagtatgtatacatcaggtatggcaacatataaatggtattcattgccaggatcataagaatcagagtaactactttactgctttttgatttttgtgtcataacgtttcccctccacgttttctctatcattattttatatgattccgttatatggcagcgcccagccgaataaaaggaagagtgtcactgcaattcctgctgcgatcagaagatatccaaatactttgtcgatcttgtaatcttttattaccttttcagactccggtaatatcagaagtttttcccgatatgctttttcctcctctgtcaccggatgtaattttgatccgagtatcgcaaaaaagaggctcaggtaaattccaataaagaatgggtctaaaaagttaataaatacagttgcaaataatcctacatgaaatccaaccagacattttgtaacaatgaatccaacaaatccggcgatcatagaccatctcgctccggtagcggaaagctttttacttaccacacttccgatggcggaaacgccccagcttgctgcgatgatcgtagatgcaaaataagtaacgatgcggacacttccgattcctgtatatgctaacagtaaggaaatcgcaccgaggatcagcattatcactctgctgacaaataactgctgcttttcacttttaaattccacaaaaacaatatccgatgtaatagaaaatccaatgaccgacaggaatgtggatgcagaagataatcctgctgccataatgccggcaagcatcaatgttccgacaagcttcggcattacatgaaatgctgcccagatcagaactctctgcggatcttccattccagggttaagattcagtacggtcacagactgcagattcaaatacatcaggaaaatcaccgtacatgccgctgcgatcgcacctgcgcggaatgtaacatgctcgctctttgccatcatgttacgtcctgcctgccaaggcgataccgacactgtaataaaccagataattcccatcgtcactgcatacatcactgcaccaaaaacatctgttgccccggctcctggaatattgccatgataatccaaaaggttctccggaatgtttggattattcatgagattctccagcagatgaccaattccaccctgtgccttgaaaacataaggaccggcaatgatcgtcgctattaaaaataccatgaacatcatcgtatccgtaagaataactcctttcgaaccggaataaaaagtaaaagcggtaaaacaaaaccatgccaggaagagacagagctcataagaaagccctgtcagttcctgcattaaaattccaactccggtgatacatgagagcaaatacgctgtgagggaaactgctgtaataattccggcaactctccggtttttcagatcgcagtaacgcgctccgaaatattccggcattgttgtacattctgaccgccttaaatatcgtccgaacataagtggtccggcaatataacccattgcacacatggaatttagcaataccagtgttgtaatgttgccggaatagcaccatccctggtctcccatgaacccgtttaccgaaagcatcgatgcaaacagggttccggcgatcaaaatcgtcggggcatttcttccactgacataatagtcatttacgtcctttacagaacgacctgcccagattccaaccactatgtaaaccagtatgctgacaaccactcctataaagaatatattcatgcagcatcctccttatcttttctaacctttttttcctctttcccaaggacgaaaatcataaggattcctgaagcgatcagacagcctccaactacaactgaaaatagtatttctcccatcgtatcatcctccatttctgtctccagaaactatttcagcaaatttcctgcaattaccatcttctggatctcagaagtgccttcatagatttctgtgatcttagcgtcacgcatcattctttctactggataatctcttgtatatccatatccaccgaataactgtactgctctccaggtaacttctcttgctgtttcagaagcgaataatttagccatagcagctttgtcagagtatggttcgccgttatcttttgcacaagcagcgctatatacaaggtatctagcagcttctactcttgtcttcatatcagcaagtgtgaattttgtattctggaatgctgcgataggacgtccaaactgttctcttgtcttaacatattctacagctgcgtctaatgcgccttcagcaataccaagtgcctgtgcagcgataccgatacgtccgccatcaagagttgccatagcaatcttgaatcctttgttaacttctcccaaaaggttttccttcggaacttttacgttttcgaaaatcagctcgcatgtagaagatccacggatacccattttcttctcatgacttccaaagctgaatccttcccatcctttttctacgatgaaagcactgattcctttgtttccaagttctttgtttgtcattgcaaatacaacgtaaacatcagcaacttcaccgtttgtgatgaagatcttgcttccgtttaataagtagtgatcgcctttgtcttctgcaactgttctctgtccagcagcgtcagatccagcgcccggctcagtaagaccgaaagcaccaagtttttcaccagatgcaagatctggaaggtatttctgtttctgttcttctgttccgaatgcttcgattggccagcagcataaagatgtatgagctgaaattgtaacacctgtgcttgcgcatgctttagaaacttcttctactgcaagaacgtaagacatattgtctgcacctgctccgccgtactcttcagcgaccgggattccgagaagtcctgtttctccaagctgtggaatcagttcttccgggaagcgctcctgctcatctaactctgcagcgattggtttgacaaactgctctgtaaattcaacgaacatgtctttcattaactgctggtcttcatttaatttaaattccatagtgttttacctctcttctcttacttttttaatcaaaaaacctctggctacttcttataaccctttgtattttctgatcttttctgtcagaattggcagaactactttcaggtctccaacaagaccgtaatcagccacattgaaaattggtgcatctggatctttgttgattgcaatgatcacgtcagagctgctcataccggcaagatgctgaattgctccggaaattccgcaggcaatgtagatctttggtccaactgttttaccagtctggcctacctggtgtgcatgtgggatccatcctgcatcaacagctgctctggatgctcctactgtagcacctaatacttctgcaagctctcttacaggtgcaaaaccttctggtccgcctactccacgtccaccggaaacgatgatttctgcgttttccagatcaacgagttcccctgccatctcattgatcacttcgagtaactctacacgtttttctgcatctgtgatctcaactttttctttgatcaccggaatgtcttttacttcacctggttcactcttcttgaatacgccaggtctgactgttccaagctgtggtctgtggtcaggacacataattgttgccatcaggtttccaccgaatgcaggtcttgtccatgccatgttgcctgtctcatcatcaatatctaatgctgtacagtctgctgttaaaccagttccaagtctgcaggaaatacgaggtccgatgtctcttccgttatttgtagcaccgatcagcattacggatggtccgtatttttcgatcagttcgcaaagaacttttgcataagcatctgtgttatagtgctttaattcaggctgatccacaacgattgcttcgtcagcgccgtgtgcttttacagcttcgagtgctggtgcaacattgcttcctaaaattactgcaacaagttttccgttctgtttatctgcaagtcttctacctggaacgagtaactcaagtcctacgcttttcgcagtaccttcatcctctgtttcgataaagacccaaagatcctttgtcttttctaccgccatctcttttcacctccttaaaatactttatcttcgcagagaatggcaaataatttttctgcgccttcttctgatgtcggttcattgatcttcacacctgaagtttttacttctggggtaaatgttttcttaacctttgttggagaaccttttaatccgattctctcattatccataccagcttctaagtctgcataggcgagaacattgatctctgctttctttgcagccatcttggatttgatggtagggaatctaggatcgaaggatggttttgttacggtgatcagacatgggtaagaaactgcaaccttctcaaatccggcttctacttctttcttgatcacaagtctgtcttcctcagcttctgcttcgatcgcatatgttacctgtggaagtccgatatgctcagcgatttcaggtccaacctgtgctgtatcaccatcaattgcctgttttccacagaagatgatgtcgaattttccttctaattcttctaatttcttaattgcgcaggaaagaatgtaacttgttgcaagtgtatcacttcctccaaattctcttccgctgacaaggtatgctttgtctccgcctacagcaagacactctcttaaagcgttctctgcctgtggtggtcccatagatactaatgtaatcttcgtacctggttctttatctttgattcttgctgcgagttccaatgcgtatgcatcaaatggattgacaatacttggtactccttcgcgaatcagtgttttctttaccggatcgatacggatttctgtcgtatccggtacctgcttaatgcagacaagaatattcttcattgcaaatatcctccattcctctctctttatttatatttctttaatacctgacggcttgcaataactgtctgaatctcacctgttccaccggaaatacgtgtgattcttaagtctctataaatacggcttacgcggcttccgcagtatccgattccgcccattacctggagtgcatggtcagcgatatcatttgcagattcagaacagaactgttttgcaatagatgcctctgctcttgtcaggcagttgttatctttgttccatgcgtagtgaagaagcatatttctcatagcttcgatcttcatggtcatttccatgatatggttctggatcagctgtaaacgtccgatctcctgaccttttacgattctctggtttgcgtatctgcatgcatcttcgtatgcacataatgcctgtccatatgcgttgaatgcatcgatcagacgctcgtaatcaaaacctttggatgttgccattaatccgtttccttcgaagctgaacatatcgctttcttcgatctcaacatcatcaaaccagatgtcgtttacgttttccatgtttaatcccattttttccattggctctttcttgcagcctggaacgtttgtaggaacaaaccataatgtaagctgttctggattctcgctgtttttagcaagtgtcagacagtaatcattgtcctgtgctccggaaatgaaatgtttgtgtccattgatgtatacttttccgttacgacgtgtataagttgtaaggattgtattgctggataattcagtacctgcagttggttctgagaatccctgtgcgaatgctccgtttcctttgaagaataaaggcatgaatttatcgatctgctcttttgttccattctctaaaagtgcatcagcttttacatgatcccagaaaaggtagattggtgcgccacagcgtcctaaagcttccattacgaggaacattgtaactgcgccttcgccgccacctggttctccgtcttctccttcagcttcttctggtaagaacatactaaagcatccgagctcttttaagatttcccaccatttctctggatgtgtgtggtttttgtcacagtcctggaagtaaggctcaagattttctcttgtcatagcctcttcgattgcctgtaccattaattcctgttcttctgtaattctgaaatccatattatttcctccattatttttcttaattatattttacatggtttcttttttcattccatgccaaacacttgttattatctgcctttccagtccggtttgcgtttctctaagaacgcttttggtccttctactgcatcttctgttttctcgatgtaatcccagcagcgattgcaatatctctgtgcatcttcgaaagagcactgtgttgctacatggaaaatctctttgctgagttttaatgagatcggtgcgtttgcagcgatgatctctgctaattccattgctttgtccataacctgttctcttggaacaacatagttaacaagacctacctcgtaagcacgctgtgcatcgatcagttttcctgtcagaaccatctcagatgcgatcttcttaggaatgatgtttggtaaacggatcagtcctccgcttgttgccaggaatccgacttttacttcagaaagtccgaatcttgcattctcagatgcaacgataatgtcacatgcaagtgcgatctcaagacctcctgctactgcagttccgtttgctgcacagatgatcggttttgcggaaagacgttctgtgattcctgcaaagccatgtgccataattgtctgacaggttccgttttcatcataagctgctaaatcttctccggaacagaagcttctgtcgcctgttcctgtgataatgatcgcgccaacttccggattctgttcagcatcgtttaagatctgttccatcattgcggatgtttccgggtcgattgcattgcggcgctcttcacggttgattgttacgatcaatacgccatttttcagttcagtaagtactttctttgtttcccccataattgtcacctcattttttctatcatttacagctatctgcacatcttcagatagctgttatgtgctctttcccacttcaatgtggttgtgtcgccatgtccgggacatagggtaatgtcctctatggcaagattattaatttttctcaggctctgcatcatctggcgctcatttccaccttcaaagtccgttcttccgatacttccctggaaaatcgtatctccggtaaagattgcatcctttgtcagaaacagaacggatcccggcgtatgtcccggtgtttccatcacagtgatctctgttcctgcgatcaccagctcctgtccatcttcgatcgtcttcacattcttaaatgccctgactgtcgggaactgctgtcccatatcatactccgtaagactctccggaatatcctttgcattgcaatacaccggaatctctttccatcgttcctgcagcttcggtaccgcaagaatatgatcgtaatgaccatgtgtcagaagaattgcttccggacagatctgcttttcctccaggatggagatcagctttttcggattatctgcaggatcaacgagaaatcctcttcccggttcctgtccttctgcaatataacagtttgtgataaatgcccctaccgggactctgattatctgcatctttcctcctacgcaaaacctgtattctatctgtgatccaagattaaatcatgctgcttccgacaacaccgtctgcaaagagctggtcaatcttttcttcgctgtatccaagtcctgcaagaatctctctgctgtcttcgccaagaagtggtgctcctctccagatcgggcataactcgtcgttgaaccggatcggattgttatagaatctcatctgtccaatcttttcctgatcaacaagtgttgtcgtctctgttgaatttgcatgttctgaagtatatgcttcaataaaaggaagtacttcagatgccggtaccccggcttctgtcaggcgtttttctatctcgctccgtttataagtaacggttactttttcaagttcttctaccaggctgtccctgtttgcgattcttgccgcgttatctgcaaatcttggatcgtcttttaagtgtccggcatctaatgcatcacacatctttgcccagcgttcctcgctgtctgcaatgataactgcccagccgtctcttgcttcgaaaattccgtatggtgcggtgaagcggtcatgattaccgaatcttgactgtgtataagttccttttccgtaatcgacaacagtctcaccacaggagatcattaccgtatccatcataccgatatcaactctgcatccctctcctgtcttacgtgcctggatcaggccgatcagcgctgcgtttaatgcgtgtgttccggttaaggtatcacaatttgcatttcctgctttcattggtgcaccgtccggttctccgttgcttcctgcaaatccgccgcgggctgctgcgattgcatcataacatggatattttttcagaggtcctgtcgctccgaatccgctcagtgatacgaacacgatctttggattgatctttttcagttcttcgtatccaagtcccagtctgtcaatggaaccgctcttgaagttttcaagtacgacatctgcttcctttaccatatcgtagatgacctgtttgccttcctgagaagacagatccagctcaatgctctgcttattcttattatatgctgtataaagagtacttaatccgtttacgaatggatcccatgttcttgcctggtcgccgctgccgtagcgctctactttccagacttcagctcccatatctgcaaactgccatgccacatatacacctgcaagtgcaatcgtaaaatcaagcacttttacatctttcaatggtccctttctgttctctgttcccatagcctttgactctccttattctacaccgtattctgtcagaactgcctgcgtatctgcaccaagcacatgaccaggttctatgttatcaagatcatccgcaccggagaacttcgccggaattccgatctgtgtctctccgcctaccgtgatcatcattccacggtctgcaacctgttcatccttcatcagctcttctactgtattgcaaggtccgccaggtaccattgccctgcggcagatctgatctgcttcatcaattgagatcgttgcaaaatagtcttttaactgctggtcaagttctccgaagtaatgcttcatggaacgatccgggtcgtgtgcatatacgcttccctctccccagtcatccctgccggcctctcttgcaaagtcaagccactgtttatcgcttccgatacttaaagcgaaccagccgtccttacagtggaatgtgtcagtcgggttcgttgtcgggaatccgttgccgagacgtctaggtaacacattcagtccctgcatacattctgcaaaagtatcatcaagctccatcatcgtatgccatgagcttacggaaactttactgccctcgccgctctcttctgctttcagatatgcagccatcattccggctgtgagatgccagcttgcataaatgtaagccagtgggaaaccaaactttgtcggtctctccggaaaaccggtcttctcaagcagtccgcattttgccataacgatcaggtcatagtcaggacaatctttccatggtccttctttaccaaatggtgttaacactccgtaaataagcttcggattcactgcttttaagttctcgtaccccaatccgagtctttccatataatcttcctgtttatttaccgctaccatatcacattttgctgcaagctttcttacgatctcctgaccgtctgctgttgtgtaatcaattgcaatactcttcttgccgcgcagatagtactgtgcatatggtccttcttcctccggtgttcctccccggcgccggatatcatcgccgccctgtggcttttccaccttaagtactgttgccccgtaatctgcaaacacgcttccgatatacgggtttccctcagtgagatccaataccgatactgcttccaaaggtttcatgataacctcctcctgttttgtttgacgtccgaacaattcattttcgtttcaaacatttcgttttatttttatcatacttctattatttcgttattttgaataaattgcaagcttttttttattttttttcgatatttttttcaattatttacagttttattgttgacaccgcgctttattcataataagataagcttacaaatttaacattttgtcccgttttaaatttgtttcatttttcaaaattgtttttttaccatacaatttttaaacaattcaagacaatttgagacgacgcatggtattgtatcttctatttctatgattgaaacagtttaaaacaccacaaaaaataattttaggagcaggtgagcaaatgaaaattattacatgttgtaaagtagtaccggatgaagaacagatcaaagttcttcctaacagagagctggctcttgatgatgtaccagcaaaaatcagtcagtatgacttaaacgcccttgaagcagcaaagaagctttctgcagagacaaagggttccgttaccgcattaagcgttggttcttccaaagctcttgatgcaacaaagatccgtaaagatatcctttcccgtggtgcaaatgatttaaaacttgtgatcagcgacgatcacagcttctctgattcttttgaaacagcaaaagctcttgcagcagcaatccgtgagcaggaagaagttgacctcgttctttgcggaaccggttcttccgatctctacaatcaggtaacaggtatccagcttggtacattacttgactggccaaccttaaacaacgtaacttccatccagccaaacggtgataccgttcttgttgagcgtactcttgagaacagcactgaagtttttgaagtagcacttccagcagttctttccgtttcatctgagatcaacgttccgactgttccagctatgcgtgatatcatgcaggcaggtaaaaaaccggttgcagttcttactacagatcttgcagatttaaacgcttctgcatctactcttgagcagcttgctccagaacagcaggagagacgtcaggaaattatcgaaggagacaacgaagaagcagtagacgctttagttgctttccttaagaaagaagctttataggcttaaaggaggattttagatatgcaatcttatgtaattagtgaaaataatgctttattatccgaactctgtgccggagcaagaaacgttgcttccgatgttacagctgttgttttcggtgatggtgcagctgcagctgagtgtggagcagaccacattcttacatgtccattagaagaatccggttctccggaagattttgcaaaagctatcgcagaagagattttaaaatctgatgctgcctgcgttcttgttggaaatacaatccttggacgtgctcttgcaggaaaactcagtgtttacttaaacacagcagtgttcgcaaccatctcttctcttacttctgaagacggtaaaccatgcttcgagcgtactgtattcggtggaacagctgttaacaaacaggtgattgaaacagcttacagtgtattcactgtaaacagcggaatcttcgcagcagcagaaggaacaggtgcctgcacagacatcgctccaatcgccggtgctgcatccgcaagcttaaaacgtgtttctaaagatgagaaacgtgaaacagctgtaaaccttgttgctgcaaaacgtatcgtcgatgtcggccgtggacttgctgcacaggaagatcttgctatgtgtgagaagctggcttctgctatcgatggtgaagttggatgttcccgtccaatcgctgagaacaacaaatggttaccaaaatcttcctacatgggaatcacaggtgttcaggttaagccagatcttatcatctgtactggtgtatccggacaggttcagcatatcggtggtatcaacaaatccaaagtgatcgttgctatcaataaagataagtccgcacctattttcaaaaactgtgactttggacttgttggagatatgtataagatcatcccacttttaacggaaaaattatcctaatgaaaggcagaaatcatgactgatattgcaggtaaccgcactctttcctctcaatggaatgagactgtacaattttatggtaatcagaattttctggaatatatttcagttgatgaccagcttaccagctacacttattctgaatttcactaccgtgttattcagacagcaaactggtttcattcgctaggaatccgtaaaggcgaactggtggcacttcatctgcacaattcaccagaatatctgatgtgctggcttgcacttgcgcagatcggcgctgtatccgttccgctgaatgagcactatcgcctgcaggaaagcaaattcgtccttcagaaatgtgatatccatcgcattatcgttgagccgtcttcccttcctatttatcagtccaataaagaagatttactactctctaccattattttagcctggggagaatgtccggatccggacattctctctctttcagcaagtagtttttttgacggcagccgactggacgaatcctgcgagattcttccggaggatactgccgtcatcctatttacctctggaacaacgcagtacccgaaaggcgtgatctatacgcactgcaatgtcgtatatggtggtattatccatatgcagcagattggcatgtgccccggagaccgttttctttcgtgtatgccatgttaccatatggattttcaggaaatggctgctatgtccgtcattgttgccggcggtacactgatcatggtagagcattacagcgcacataaattctggaaacagatctgtgatacaaaagcaaactttacagataccatgtccattatgaaccggacactgatgctgcagcctgtacaaccatgggagcaggatcattgtctgaaacaggtctatttttctatgggattaagcacagaagaaaaagatgaattcgaacgtcgattccacgttcagtttctgaactcctatggaatgacagaaacgatttctgccgttacctgttctccgatctccggtgataaaaactggccttctgtagggcgcgctgctttatcttatgatatcaagatcatcgactgtgacggaaaggaagttgccccgggtaaaaccggtgagatctgtgtccacggtattccgggtcgttctcttacaccaggatattacaatgacccaggtgcgacagaatgtcttctggacaaagatggatggcttcattccggtgacagaggatatatagacgaagccggctggctcttctttatcgatcgttggggaaatatgatcaaacgatccggcgaaaatatcagcagcctggaagtagaatgtgttctcacttcccacccaaaaattgctgatgctgccgtaatcggcattccggatccaatccgcaaccaggcagtaaaagcatttattcagtttgccgatggagaaagcctgacgattgcagaattagaacagtattgcagtgaccggctttccaaatttaaggttcctactttctggcagtttgtagatgactttccgcgaacagctaccggaaagattaagaaaaaagagctaaaataatgtattcacaaacgtaaaaacgtaaggaggcctattagatgaagtatgattttacaagtattttaaaccgcgacggcatggatgcaattgcagtaaatccgcctatgaatgccagctggatctcatttgcaccgatcaaagaaggctttgatctgatcccgatgtgggtagcagacatgaacttcccaacagtaccaacgatacaggacgctattatcgagcgcacgaagcaccctgctttcggatatttccgcccacgtcctgaatattttgaatccattatcaactggcataagttaagaaacggtgtaaccgggttatctgaggaacatatcggatatgaaaacggtgttctcggcggcgtgatcagcgcattaagtgttttatgctcgaagggtgattctgttttatttcattctcctacatacattggttttacagccagtctgacaaataatggctacaatatggtcctgagtccacttgtacgcgatgaaaatggggtttggcgtatggactatgaagacatggagcgtaagatcaaagaaaatcatatccatgctgctgttttctgtaccccgcataacccaaccggtcgtgtatgggagcgttgggaaatagaaagagcaatggaactcttccaaaaatatgatgtatttgttatttctgatgaaatctggtctgaccttatcttaaatggccacaagcatattccaacacagtctgtgtctgaagatgcaaaaaaccgtaccattgcattatatgcaccatctaagacattcaaccttgccggtctgatcggttcttatcatattatttataattcatggctgaaggatcgcatcgacaaagaatcttccctctgccattacaacgacatgaatgtcttatccatgcacgcattgatcggtgcttataagccggaaggtcatgaatgggtagacgaattatgcgaagtattaacagaaaatgtcaatatcgcatatgacttcttcagcaacattgatggtattgatactgcaaaaccagaaggtacttatatgcttttccttgactgtaaaggctggtgtactgcacacaaccagacattagaagacctttacaaaaaaggacagtctgtcggtgtctactggcaggatggacgaccattccataatgagtatggaatccgtgtaaaccttgctcttccaaagagccgtgttgaagaagcattaaatcgactcagaaactatgttttctgtgactaaaactttttcctatataatatatatttaccatattctttcgctgcagccgggttcctccccggctgtaaattttatccaaaaaagcagaatgtttgatttgcaaacattctgctttttatttcttatcaaaaatccctacgccaaatttccccagtcctctattcatagttctttaaaacattccgtataactatttcatctctacatcagcattttcaaaaagaaagagccgctgtataaatacagtgaccccctcttggaatgaatatcgatttatgtatgtagattaatttcttggatctaaaccgcagttgtgagcgaagaaatgagctcctctgcgtaatgcatcttctgcgtcatccataactttgctgtagtggataaatgcgtgaagagcacctttgtactcatggtattcagcctggattccgttgtttgtaagaatctcataaagtaacttactgtcatctctcagtggatcaagttctgccgaaacgatgaagcaaggtggaacatcatgtgtaaggtcattgataaatgtatcaaagtatggacaatctataggatctacgccttcgccaaggtaaatttccaagtagaatgcaaggtcttcctcgctcattccatcccagcttccaccgtgaaggttgctgctgacactggctttcataccataagatccgtagaataaaatgttacctttgattctagagatatcaaatccatcatcacgtaagtgcattgtaacgcccatagaaaggtttgctccgccggaatctcctgcgaatccaaatttttctggatcaatgccgtactcttctgcatgctctaatacatatttacaagctgtagtacattcctcaatcgcacgaggataaactacttctggtgataaagtatattcaatacctacaacaacacatccggaataagctgcaagctttctctgtaccagattgtgtgtatcgttatcacctaatacaaatccgccaccatgcataaagaagataactggaagcttctcagcttttactgggcgaagtaaacgtgctggaactttatcctcaccaaaaggaatctcaaagtcgattgtctctgccatttctggcccgccgctgttccacatctttctctcttcgcggtatgctgcacgcatctcctcgtaagttcctgcctgagtatcgaatgctgctgcatattctgcctgcatctcaagtactcttgcctgctgccagttcacctctggtgtagctggtttgttttttggattaattgttactctaaattcccccatcgtgtaacttcctttctctttacataaaaatttttacacacttttcaacatacaaccttttgacaaatacagcacaaatcccccccgattttccatctgcatttgtatcttttgtacatttcttatatccttattataagctcattatgttcagttgtcaaacaaatatcgctattttttgtatgtttttctaaattctcatctatcttttgttttaccgtcaaacaacccgtcttttttcatgaaatgcatcactttttgtacctcggactattttttccacatttttcaatcttttttcatccaaatccgttgccttcattcgtcttttttatcaaaaaaataaaaacaatatccttcctattttgatacccgaatcctataaaataatgaaaactatattttatgtaaaaatgatgtctggctttgatacggatgtgtttcacgccatcctcatcagagtaaagattaaagttttctatcactgtattcttgacattaagaacattcttgcataatgtattagcagaaaccatttgcgttatccttttttctatttgcttggtcgctaatacattaaaggaaaccaaatggttttttcaatatgtaaatgtaaatttatggtgtttacatacttacatactgcaacacactcttctatcgcaaccggataccttacttccggtaccaaaaaataatcgataccaattacaacacatccggaataagccgcaagttttctctgtaccagaccatgtgtatcattgtcaccttctacaaatcctccaccatgcataaagaaaataaccggcagtttctctgcctttaccggacgaagtaaacgtaccggaaccgtatatccttcataagggatctgatattcgatcgtttcttccatttcaggaccaccgctgttccacatctttctctcttcgccgtacgctgcacacatttcatcgtagcttccagtctgagtatcaaatgcatctgcgtactctgcctgcatctcaagtactcttgcctgctgccaacctactgccggtgcagccggtttgttgataggattcattgataatttaattcccccattttgcagctcctttatccgtgtgcattctttttaacaaatacagcacaaattccccgatcaaacatctgtatttgtattttcagcacactcccgacacctttattatagtacattatgtttaatcgttaaacaaatatcagtctattctacttgtttttatattttttcactaaatttatttttatttttgtttgatagcaaaatggctcaaaattattcaaaaaaatcgtttgttttgcaatattttttctgtaaattcatgtgaaacaaagcggacaagtccgcttcaagattcctgaatcccttaatctttgaggtacttgttacgctttgcgcgccagatgcattctgctttagcagacatattccacatgcatctggtcgcatcctcgcggagcgttttttgctttattggaacattacagagtaaatttcctataaagcaaaaagaggctatcatattctctaatatgatagccttccgtctagcgtagtaccctgcaattgcaattaccacgtaatcatttattcatttcttggatctaatccacagttatgtgcaaagaagtgagctcctctgcgtaatgcatcttctgcgtcatccattactttgctgtagtggataaatgcatgaagagctcctttatattcatgatattcagcctgaattccattatttgtaagaatctcataaagtaacttactgtcatctcttaatggatcaagctctgctgcaacaaggaaacacggtgggacatcatgtgtaagatcatttgcataaatgtggaaataaggacaatcaaaacggtttacatcaggagcaatataacaagatggtgaagataaatcagcttcactcattccatcccactttccgccatgctgatagctactaatactactcattaagccatatccaccatagtataagatattacctttaatcttggacacatcaaagccttcatctcttaaacacatgcagactcccatcgccatatttgctccgccggaatctcctgcaaatccaattttctccgggtcaattccatattcatccgcatgctctgatacataatggcatactgcaacacattctttgatcgcacgaggatatttaatttccggcgcaagggaatagtcaataccaatcacaacacatcctgaataagctgcaagctttctctgtgccatactgtgtgtatcattatttccttctacaaatccaccaccgtgcataaagaagataaccggaagtttctctgctttcaccggacgaagtaaacgtaccggtactttatctccttcatacggcacatcaaagtcaactgtctctgccatcacaggaccgccagtgttccacatctttctttcttcattgtatgctgcgcgcatctcttcgatcgtgtttaccagcgatgtatcaaatgcagctgcatactcttcctgcatttctaatactcgtgcctgctgccagttcactgccggtactgccggtctgttctttggattgatttgcagtttaatttctcccattttgtaactcctttctccatgtgacttattttgacaaatccgtcacaatacctcaacattgctcatctgtttttgtatcttttatacacttctgatactttatattataaagtattttttcactatgtcaaataagtatttgcattttttctatttttttactgacaaagtcaactccggtacctgactctatctaaataaataaagctggtatcaagcactccattatacttttttcggataccaataatattgtatgtttctctattttatatctgaagaaatttcataattcatagaccttgattttgctgatgttgcggagcatataaaaaacaacttacctcgatccgatatatattttgacaataaatatccacatccaaaggagataagttgcaaaatatgtatcgtcaacaatcgttaattaagaccagttctatgaatggattatatctatcgtgaattcaccttggatttcttcaagatggatcttaattctctgcctaaaaatgcatcctctcttaaattttccaagttcaattctaatgtaatggggctttgtttaaccatgcacgtaaatcttggaatgtctcttcgtaagacctaatatgccttaaaagaactttacaacattgacatatcccaccaacaggtagctaacttctgtaagacagttgctgtctgcatcaaaccattcgtagacaactacgattacaatgcaagaaaaatctttactgccgatgaaacctacataaaaatccgtggaattaaagcatacatctggtttattatggatgctgccagtcgttccctttcttggataccgcatatctacggagcgcgacgttggtgcatgcattctttcgatgcgtatggctttcaaacacgtctccaagcttcctgaaaatttcaaatttatcgctaatggttacagcgcatatcctcttgccgcccaacagttttatcgtgagttcaaagaagattttaaatttgatatcaccaggattatcggtcttacaaacggcgatgaagtttctaaagaataccgccctttcaagcagatgatagcgcgacttaatcgcacttataaagctctctatcgtccaaccaacggttttgacaacgtagacggagccaactatgatctagcgctttgggttgcttactataacttccttcgccctcacaaacacaataaatacaaggttcttaatgatgttgagatgctacatggtgcttcaaacatgcctggaaaatggcaacttctaatctttctcggtcaacaaacaatcctgaacttacaaaacggcgaagccgctaactgttcttagattaagagccaaaggtaataacccagccatcagaaccacaggttctgacaagacatttatgcctttgcccttgatggcacgaaaaagaactgctacactgctgtaatcgacataagaaaacaactgttcttaagttcttcgccgtcggtaatcgacctacagcggttctttttcgtgctgtcaagggtggcggcaagctgccactacctataatatctacagttttcaaagttcatctgaacctttttctttaactcggttttttcattggtcatttgacactatcgcaagccacaggtctacagcaggatttttgctctgtgggacccgaaaatcggtgattttcgggtcccacagaacaattttagctccctgtgcccaaaaacttcgcttttgctgctttcttcccgcttttatcggcattttcgggtcccagacggctattttgtctctgtagacccgtgcatactcccggacatctcatttttcctgacaagacatgaaaaaaacaaatacagctttcctgacaaggcaaaaaaacaggactcctaacaacacaacaaaaaaacaagtacagctttcctgacaaggcaaaaaacggtccatgacatgcgtcacagaccgtttctgttacattttctagttctcattcatcttcgcgagcttagcagcctggtccgccgcgatacatgcatcgatgatctcctggatgtctccgttcatgatcttatccagcttgtacagggtaagattgattctgtgatccgtcacacgtccctgcgggaagttgtaggtacggatcttctcggaacggtcaccggtaccgatctggctgcggcgcatctcagcctccgcatcgtgacgctgctgctgctcgatatcgtagagctttgcctttaaaagagcaaacgcctttgccttattctggatctgtgacttctccgtctggctgtacacgacgataccggacgggtagtgggtcagacgcaccgcggaatcggtcgtgttgacacactgtccaccgtttccggaggcacgcataacgtcgatacggatatccttctcatcaatgacaatatcaatgtcgtcatccacttccggcattaccgccacactgatggtggaggtatggatacgtccgccggactccgtctcaggcacacgttgtacgcggtgcacaccggactcatacttcatcagggagtacgcgccctggccgttgatcataaaggtcacactcttcataccgccgatgccggtctcgtccgcctcaacaatctcggtcttccagttcttgctctctgcataatgctgatacatacggtagatctccgcagcgaaaagtgccgcctcgtccccgccggcaccggcacggatctccacgataacattcttatcatcattcggatcttttggaagaagcagaatctttaactcatgctccagctcctcaacacgcgccttggcatcgtttaattcttccttcgccagttcacgcatctcctcgtccgactcctcatccagcatggcgagggaatccgcaatattctgcttgcactgcttgtactccttatatgcagcaacaatcggtgccagatcactctgctccttcatcagcttgcgaaaacgctccggattgttcgcgacatccggctcactgagctcgctcatcaattcttcaaaacgaatcagtaaatcatccaacttatcaaacataacaaacatcctttcttatctcaaacaccagacaaccgtctgcaccaactatgcaaaattctctccaatcccgcaatcaactaaagcattccggtcaccacacggtcttttctcgccagatcctttatcacctgcacatcatggaacccgatctcccgcataagtgcagacaccttttgcccctgatcgtagccgatctcaaacaacagatgtccttccgggttcagatactgcttacactgtccgatgatcttcctgtaaaaatacagaccgtcctccttgccgtccagcgcttccatcggctcaaaatctcgcacctccggcatcagctttgcaatctcatccgtacagatatacggcggattcgagacgatcacatcaaatgtccccgtcacatggtcaaacaggtcgctgtgttcaaacaacaccggcacatcattgagccttgcattttccttcgcaacattgagcgcctgcttggatatgtcaaccgcatacccctccacatccgatacattgtgcagaatactgacaatcacgcatccggacccggtacacagatccagcacacgcattccggggcgcacgaccttcagcgcctcttccaccagagtctctgtatcctgtcttgggatgaggacactggaatttactttgaacttcagtcccatgaattccgtctcacccacaatatactgcagcgggacatgctctgcgcgcttgcgcagcgcaatctggtactcgctcatctgctcttccggcatatcctcttccatatgaagataataaaaactgcggtcgatcttacacaccatttcgagcaaaagccatgcatcggtctttgcctccgcaatatctgccatggagagaactgtctcccccagatttactgtctcacgatacgtcatttccaacctccatcatgcctgttcccggatctctttcacgtaagccttccagtcagacaccgcctcaacagaggcatttccaacctccatcatgcctgttcccggatctctttcacgtaagccttccagtcaaacaccgcctcaacagatgcaattccaacctcgatcatcgaatcatccggctctcttgtcgtaatccgctgcagcagaagccccggcttgctgaacagattgacaagcatatgatccgagcgtccggcaagccggataaactcgtacgatacccccgcaatcaccggaattaacaccaggcgcagcagaagctgcaggatccggttatccacgcggataaataaaaagaagacaatgctgatcagcatgacaatcagcagaaagcttgttccgcagcgcttgtgcagacgggaactcttccgcacattctccaccgtaagatccatcccctgctcaatacagttgatgcatttgtgctctgcgccatgatacatatagacacgcttaatatccggcatcagtgaaattgccgccacatatccgataaagatggtaaggcggatcacgccttccaacaacgcaagaagtgtctgcgatgtaataaaacgctgaaagaatacggatatgtaatatggaagcaccataaaaattgccaccgcaagaacaatggaaattgccaccgtaccgcccatcagtacattctcctgacgcttttcctttttcttctgctcttcttccgtcggcgccggttttttcgctccggcacgcttctccgctttccgggatccgctcttttcatcctcttcctcctcgaaaaaggatgccgagaacgtcagtgtcttcatccccagtaccaacgattctataaaactgaacacgccccgcaagatcggcatgtttcttattttcttatttttaatcagtccttcgtacgtcgaggtctcgacgacgatctcctggtccggcttgcgcacggctaccgcgtatttttcctgattcttcatcattacgccttccatgaccgcctgaccgccaattcccgaatatctcatagtctaaatccctgcttccggcacatgagctgcgccgtattccataaggtaaaaaaggttgagattaaacaacctcaaccttatctgtaaccgttttcacttaggagcataacgcttcacgcgccatactactgctgctgcataccatatttcttattgaacttatcaatacgtccgcgagcctgagctgctttctgctggcctgtgtagaacggatggcacttggagcagatctcaacgtggatatcttcctttgttgaacctgtaacaaatgtgttaccgcagttacatgtaacagttgcctgatagtaatctggatggattcctgccttcatgattttcacctctttataatcttatcgttattatgttcctgtctgtctctattctcttatgcccgtatgcccgatccgcatatggcacttactgcaaagaatagtcccgaataaacagcgttattattttatcatggtttttacgaaaaatcaagttctttttatacaatccggttctttttcaccatatggatatattcctgattgttgcgcgtgcgggcgaacatgttcagaatgttctccaccgcctcatcggtgcgcatgccgttgatcgctttgcgcatgatctcgacagcctcctgctcctccggctccagcagcagatcgtcgcgccgtgttcccgacttcacaatgtcgatggcggggaacacacgcttctcggaaagcttgcggtcaagcaccagctccatgttgccggttcccttaaactcctcgaataccacgtcgtccatcttgcttccggtatccaccagcgcagtggcaaggattgtgagacttcctccctcacgcatgtttctggccgcaccgaaaaagcgcttcggcatgtgcagcgctgccggatcaagacctccggataacgtacgtccgcttggcggaaccgtaaggttgtaggctcttgccagtctcgtgatgctgtccagcaggatcatgacatcctttccgtgctccacaaggcgcttggcccgctcgatcaccatctcggatacgcgcttgtggtgctccggcagttcatcaaacgtagaataaatcacttccacgttctccccgacaatcgcttccttgatgtccgtaacctcctccggtctctcgtcgatcagcaaaataatcagatgcatatccggatttccctttgtcactgattttgcaatctcttttaataaggttgtcttacctgccttcggctgggaaacgatcataccgcgctgtccctttccgatcggcgacaccagatccacaatgcgcattgcaacactgcagcccgggcgctccaagcggattctccggttcgggaaaatcggcgtcagatcctcaaaattcttgcgcttctgcgcgacactcggatgataaccattgactgatgaaacatataacagtgcagaaaacttttcctgctgcgtcttcacacgggtatttcccgccacgatatcgcccgtcttcagattaaacttgcggatctgtgacggcgatacatagacatcgttctccccggggaggtaattctcacagcggataaatccatatccgtccggcatgacctctaagataccgttcgccataattccgctgtccaaattggagatcgtctcatccgctgcggtgctctctcccttcccctctcttgtctctctcggctcacgcgccggccgctgctgcgcctgctcacgctgcggtatctgttcccgctgcgcctgctcacgctgcggtgtctgctcacgctgcggcgtctgctcacgctgcttcgtattctcttctctgccctggcgctcgtcctctgcaaccatcagatctaccagatcactctttttcatgccggagatatttttgagtcctctcgcttttgcaagatcacgcaaaacaacggctgacaagctctcatacttttctctcatccattcgctcctgttcttatcaatctgctattttcctctatgctctcaatcgtattgggaattgtgtctgaactgacaaaatgaatttacaatatgcgtattatacaacactttttccaaaataggaagtcctaatttccttgatttgtcaaaatgataatggtatgatttacatattgatttttatacaaaaataaactttatatacaggagacgatatcatggagaatcagacaatgacacttgccgagaaggcattgcttatgcatgaaaaatggaacggaaagcttgagaccatcgcaaaatccaaagtaaactcccgcgaggatctcgccatcgcatacacacctggcgttgcggagccatgtaagatgatcgccaaggatcccgaagctgcttacaaatataccatgaaagcgaacaccgtcgccgtcatttccgacggaagcgctgttctcggtctcggcaatatcggcgcatacgccgccatgcctgtcatggagggaaaatgcgttctgtttaaggaattcggcgatgtcaacgccgtaccgatctgtctcgatacccaggacacggaagaaatcattaccacaatcaagaacatcgcacccgcatacggcggcatcaacttagaagacatctccgcgccgcgctgctttgagattgaggagcgcctgaaggaaatgctcaacattccggtcttccatgacgaccagcacggcaccgccatcgtggtgcttgccggcatcatcaacggtctgcgtgtcaccggcaagaaaaaagaggactgccgcgttgtcgtaaacggcgccggctccgcgggtgttgccatcacaaagcttctgctcacctacggttttcgccatgttaccatgtgtgaccgcgagggaatcatcggcaaagattacccgaacttaaactggatgcagcagaaaatgactgaggtcaccaaccttgagaaccagaacggcacacttgccgacgccttaaagggtgccgatatctttgtcggcgtctccgcaccgaatatcgttaccccggagatggttgcctccatgaaccacgattccatcctgttcgccatggccaacccggtacctgagatcatgccggatgtggcaaaagccgcaggcgccagaatcgtcggaaccggacgcagcgattttccgaaccaagtcaacaatgtcgtggcatttccgggcatctttaagggtgctctcgagggacgggcgacacagattaccgaggagatgaagcttgccgccgcagaggcgatcgccggtcttgtctccgacgaagagttaaacgacgagtttattatgccggaagcatttgatccgcgtgtggcgcaggttgtcagcgaggcagtccgctcccacatcgtgcgctgaccggatatccaatgaacgacgcgcgttactactctctcaacacctatttaagacagacattcggtgagaaggtctaccgcctgtccttaaacggcggtatgacctgtccgaaccgtgacggcagtatcggtaccggaggatgcattttctgcagtgccggcggaagcggtgattttgccgcctccccgcagcaatctgtcaccgggcagatcgcgcaggcgaagcttctcctccgtgaaaagacaaactgccgcaaatatatcgcctattttcaggcatacacgaacacctacgctcccgtcggtgttcttcgtgcactttatacggaagctctcgcacagccagacattgtggcgctctccatcgctaccagatgtgactgtctgccacccgatgttttagatctgttagcagagttaaataccataaaacctgtctgggtcgaactcggtcttcagactatccatgaacacactctgcgttttatacgcagtggtttttcactcgcccagtataagcaggcggtatccgcgcttcacgcgcggggcatcaaggtcataacacatctgatcttaggtctgcccggtgagacaaccgaagatatgcgcgcttccgtgcgctatcttgccgcacatccggtcttcggcgtaaagctgcagctgcttcacgtcttagaaggcaccgatcttggaaccctctacaaaaatgacccgtttccgctttttacgctggaggaatactgcgaccttatcgcagactgccttgcccttcttccaccggaaatggtcatccaccgtctgaccggcgacggaccgcgccgcctgctcctcgctccgctgtggagcacggacaaaaagcgcgtgttaaacacgataaacaggcaacttgtacagcgcgatctctggcagggcaaatattatagaaacgaggaaacacatggctgaaccatttaccatatacaaactgaccattttaaacatgctggataaggtggattttcccctgacgaatacgcagatctccgactttttcctggagcaggaatacacggattattttcgggtacagcaggtcttaaacgatctcgccgactccggtctgatccgcacggaatccacgcacagcaacacccagtattatatcaccgctgcggggcgtgagacgctcggctttttccgcgacaagctcacggacgccattgagcacgacaccattgcctattttgaaaaaaataaaatggcactccgcaccgtcaactcaatcatcgcagactactacaagacgccgaatcaggactatgccgtgcgctgccagttccgtgtccacgacaccaacctgatcgacctgacactgaccgtcaaaaacaaagagcaggcggaagcgatctgtaacaactggaaaaagcagaacgaggatgtctacgcctatctgatggatattctgatccagtaacaatccgtttcctgtcagataccgcctgacattttttctaacagacagaagggagtccttattttatgggaaaaagtgctttcaaaccgggcaacatgctctatccgctgccagccgtcatggtaagctgccagtatcccggcacctcggatccggaatgcagcaatcctgcactctcaggcagaccgaacattcttaccgtcgcgtgggcaggcaccgtctgcaccaatccgccaatgctctccatctccgttcgtccggaacgctattcctaccatatgatcgaggccgccggcgagttcgtagtgaatctcacaaccgaatcgctcgtgcgcgccaccgactactgcggcgtgcgctccggcagggacgtcgacaaattcaaggagatgcatctgacaccgcttgcctcccgtgaggtatcggttcccggcattgccgagagccccgtcaatatcgaatgccgtgtgcgccagatcacgccgctcggcagccacaatctgattctcgcggatgtcgtcgccgtcacgatcgatgacgcgtatatggacgaagccggcaagttccacttaaacgataccgggctgatcacctactcccacggagaatattttctgctcgggaaaaagctcggcacgttcggctacagtgtgcggaaagattctcctgttaaaaagggaaacggcacctccgtaagaaaagaaactcctgtaaaaaaaggaactcctgtaaaaaaaggaattcctgcaaaaaaggattttctgcaaaaagggaacaacaaaaagaagaaaatgaaaacagatataaacaaaatcagataacgaagggatttttacgatgaagataagatttggtattgtaggctgcggttttctcggaaacattgtcgcaaacgcctggaaggatggttttctggaagattacgagcttgtcggcgtgaccagccgctcacaggaatcgcgcgataagaccgccgcggaaaccggctgcagatcctgtcgggatcttgcagaactgctctccttagagccggaatatattgtggaggcagcgtccgtggaagctgtccgggatatggcatgcaccgtactcgaacacggcgtcagcctcgttctcctctcgatcggtgcttttgccgacgctgccttttacgggcaggtcagggacgcagcccgcagaggatgcgccaaagtccatctggcaaacggcgcgatcggtggttttgacgtcttacagacgatcactttaatggcgcaggcgggaaagcttgacgagaccgccggcatcgagacgcacaccggtgcccgcggttttcgcaatacaccggtctgggcggaacaccttttaaccgataccgaaaagacgactgtctttaccggcagcgccaaggaggcgatcgtaacctttccgcgccgcgtcaacgtcgccgtcgccacctcgctcgccacgacaggacctgacatcacgcaggtaaccatgcactccgttccgggctggacgggcgatgaccactgcatcaccgcagagatcgacggcgtcaaagccaccgtggacatctgttcttccaccagcgcaatcgccggctggagcgcggtagccctgctccgcaatctcgcctcgccggtttgtttttattaacgcctgctaatttccaaaaagtcctgacatccagtcattgaactcttttacttttaatgtcacggaatcgaccgcatcggaaagctctccggcactctcgcgcatttcctgcgtcgttccgatggcatcattgataccatccacatcgacctgctgcagtttatctgccgcctcactcattgctgccgtcatctgactcatccggttgacaaaaaatccacccgcaataagcagaattaccagcattaccgccagcagcccgctgataagcttctgcattttcaactgttttttcatcacttccaacatttcttccatattacaatcttgcctccgattctcactcatccaacactgcttctatactatctcataaacggactgttcatcagttcctgttttgctacttccatcgcacgcgccacgctgcccggctcaaacggattcgacaggtttgcatagcgcaatgtctccagatagctcatgcttccgccgcatttgcagagatttaagtaatcctgccatgccgtctcatggttctcataatttttctttttgaactccatcgcccccatcgtggtcagcgtataattgatgtagtagaacggatagagatagatatgcagtttgtggtaccagaaaccgccacggtcgaagaaatcatccgcgtcgtattttctccacggcatatacttttcttccagcttcttccactctgcggtgcgctccttcggcgtcagttccggattggcgtagcagatgtgctggaactcatccaccgccacgccgaacggtacaaatgtgatcgcctcctgcaaatgtgcaaagcggaacttatccgcatactttccgaaaaatgcctccgcatacgggtaggaaaactgctccatcgacatggaatggatctccgcgatgtcggtggactcggaataatactctgtgatcggctgctcccgcatcgccatgtaccccgcaaacgcatgtcccagctcgtgtgtcagcacctgcatgtcaaagattgtctgattaaaattggagaacacaaacggtgcccgataatccgggagaaatgtcatatatcccgtagcagcttttcccggcttattcttcaaatccatcagttcgtgctcaatcataaaatcaatgaactctccagtctccgggctgatcttatggtacatcttccttgcctcttccaccataaaatcatcatctcccgcaggaacggcatttccatccggaaatacacgcttctcatcataaaacatcaatgtatccacaccaatccgcttcgcctgcgccgcatagagctgttcacacagcggtacgagttccgtacgcacctgctcgcggaacgctgccacctctttttccccataatccgtgcgtccctgctgcatgtaccccaccggaataaagttggcatagccgaggttcttccccatctgattgcggatggtaatgagttcctcccagatctcctccagccgcttctcattgctgtggtaaaaatcagaatatgcccgcacagccgcacgccgtacttctctgtcctcatgttcaaaatacttctgtacaccatagagattaagcgtctgcccttcaaattcgatcgccgccgttgccatgatcttctgatattcgtttgtcagcttcgcctcctgctgcatcagcggaatatttgcctcacagaaggtcttcctgttcagttccttctgtgcaaaatactgtttcccgtactctttctcgatgtcatcgcgaaacggactattcatcactgccgcatcaaatgcaagaaacttcggcatcacggtcggtatggtattgttgatatattcgtcttccttctcataataagtatccgtcgtatctaatgtatggcggatggacgcaatcgtgcacgcagtcataagcttattctgcacgcgctctgccttctttaagagttcctttaatccctcataggaggctgcctcctgtacctgttttaccagtttttcaaaaagctgttccacttctgtgaaatccggtctctcgtatttcagtgttgaaaatgtaaaatctgccatatgctcctcatttctgcgcaccccatcgcagcaattcttctcctgcaatatccgtagcgcttctctctttttcgttttattctacgttccgcagcttttcctgtcaagcaacagccggtaaccggcgtccatgagcaccatgcataaaagcatcagaaccgcatagcctgccagatagcccgggttccccaaaaacgacgccagccactccagcggcgatccgggcgaaggcacattcacaaacatgtaattggcatgaaactttttgtcaaacaggtaaaccggcggcacaaccaccagaagaaatacgatcaccttccacagcgccgcaagccgcgggataatgttgtgctgcaacagctggcagatcacgtagagcacaatcccggcatggaaggtaaatccctgtatcgtaataaaatgaatcgccggatagcgcacccagtccgggaataaaagcgcaagcacggttcccggcagacacagggtatagagaacctgtcccagccagtcccatttgaaaaaggcgtgaagacagcacaaaaaccctgccatgctgcacaggtgaagcggcagttgatacagcgacattttcccgatcagagccagcaccgcaatccggtacacttccagtcccaccagaaaaatgccgattcctctctccgccaaaagcctgcgccgtcctccccatcgcttataataatggaggaacagcagtaagagccccgcgcacacgcccagccataataaatgtaccggaccaaagtgggaaaatcccaccccgtccggtatctcatcttcatatgtgaaaaaataggaaagatcaatccccagtcgtctcattttcacacgcttctttcacagtgtttttctccgcggaatttccctccgcctagtctctctttgcaacttctccttctgtcgaatgttcctccgcagattctctctctgcagattctgcttctgccgaatctctctccgcagattccctctccacagagtctccttccgcagaatgttcctccgtagtatctgcattcgccggactcttatgcgtctcatccgcagattctttcttcacaaacttaagccgcgccagcttctcgctccaccatgcgcgccagcgtgcatgcctttctgcccgcgcctccttccgctgtctgcggcgctcgtcccgctctgccttcttctgcgctctcgcctcttcctttctggtaaacttcgcctgctttttctcctgcttcgcgaacgccctttccttcagacgcacttcctttagcgctgccttctcgatctctacgatatagcggttcgccttcttgcggttcctccggtccatccggtacggatcatacaggaagtaggacagtgctccgatcatgagcaccacaacacctgccacggcgaaaaccggtaccagaagcgcatattcctcaaaaccaagttcgtagcaggtaaacgtcacgagcataaccggaaacagcagcagatacacgcccttcgtcagcaccgtaaaaaacagtgactgcttcctcccgttggagagcaatgccccctcaatggccgtataaaatgccataaaaatgcagatctccgacccgaacccgtgcagtatgccgcagatcgcgatcagcacgagcgacaggaaaaacatggcaaacgccgtgccctgataccacgcattgcggtactccgtcatcccctgcagcttgtcctcactgatcccgtgcatccggtacacttccgtgcggatgcgctcctcgaactgctcgttgtaccgctgctcttccttggtattgcgcagatgattctccaccgacaggctcatccggtcaatatattcctgctcctgccggatccgtctgctgcgcagcttctcgatctcactctgtctctggacctcttcctcaaggcgcatgaccttgccgatgcgcggattcttcactgtgatatccgagtaatccggctccatatccgcgatccggacccgcgcgccggtctgccagacctccgcctcattttccgatctctccgccggctctatgctcgccgataacgtctctttcgccgatgtgctccctgcctcctgctctgccggtgtgcttcccgctgccgtcttttccgcttctgcgcttcccgccatcgtccgcgccttttcccctgcttttttccttctgcggctcatttgtactccccttttcttcattcgtactcttttttctcatcttagcacagaatccgttggattacaaacgggggattatcattcgattactgcacctcaaggtaggagtagcccatcaagctctcatcgacctcgcgcgcgacctcgcgtccctcgcggatcgcccagacgacaagggactgtcctctgtgcacatcgcccgccgcgaacacatttttcacgctggtctcataggcgccctccgccgttgcgacgttggttctgccgtttaagtccacaccgaacgcgtccgccacatatttttccgtgccgaggaatccggcagcgatcagcacaagatccgcttccatcttctgctcgcttcccgcaacctcggtcatcgtcacacgcccggtcttctcatcccgcttcggttcgagctttacagtgacaagcccgcagagattgccgttcttgtcttttaagaattccttcaccgtcgtctgatagatccgcgggtcgtgcccgaacaccgcaatcgcttcctcctggccgtaatcggtctttaacaccttcggccactctggccacggattattctccgcgcgctttgccggtgcctgcggcatcatctcaagctgtgtcacgctcgcgcagccgtggcggatggacgtgcccacgcagtcatttccggtatcgccgccgccgataatgaccacttttttcccttttgcggagatatagctgccgtcttttagctcagaatccaggagactcttcgtcgttgcttttaaaaaatccacggcaaaatagattcccttggcatcccgtcccggtgccttgatgtctctcggattcttggcgccgcacgctaaaatcacacggtcgtactcctttaacagcttggaggcctttacatcctttccgacattggtgccggtcacaaaggtgatgccctcctccttcatgacggcaaccttgcggtcgatgacccatttttccagcttcatattcggaattccgtacatcagaagtccgccgactctgtcgtcccgctcatagaccgtcacagaatgcccgcgcttgttgagctgatccgccgccgcaagccccgcaggaccggagccgatcaccgcgatcttcttgccggtgcgcactttcggaggctttgccgccgcataaccctgctcatacgcattctcgatgatgccgtgctcgttcgccttgcaggttaccggatcttcccagtgcccgcaggtgcaggcagcctcgcagagtgccggacatacccgggaggtaaactccgggaaattattggtcttcttcaggcggttgtatgcctgctcccagttccccgtgtatacaagatcattccactccggaaccaggttgtgcagcgggcatcccgaggtcatccccatgatgttcattcccgcctggcagaacggcacgccgcagttcatgcagcgcgcaccctgaatctgttgtctctctttggacagaggaatgtggaactcattaaaatttttgatccgctccttcggctcaatggcgcgggcatcttctctgtcatattccataaatcctgttggttttcccataattctatcctttctcgaaaatgcatgagtcacacatgtcaaacgacacctgctcacacactatccacgcgtatttgcataaaaagcttcaatctgtgcctgttcggaagaaagacctttctcctccatctgaacaatcgccataagcatacggttatagtcatacggtatgactttcttgaacttcggcagatactcgctgaaattatccaggatcttcttgcccttttccgagttggtcagcgccacatgttccttgatcatgtcctttaattccatgacatcatatttgttggaaatctcctggctgaataccatttccttattcattcttgtgtagaggtcattgtcctcgtcgagcacataagcgataccgccgctcatgccggctgcaaagttcttgcccgtcttgccgagcacgacgacacggccacccgtcatatactcacatccgtggtctccgacgccctccacaactgcggaagctcccgagttgcgcacgcagaaacgctcgcctgcgacgccgctgataaacgcttttccgctggttgctccgtagagcgccacattaccgatgatgatattctcatccttctcatacttcacgcccgccggtgcatagacgacaagcttgccgccggataatccttttccaaagtaatcgttggaatcgccgaccagctctaacgtcagtcccttcgggataaaagctccaaaactctgtccgccggcaccgttgcattttacaatgaaggtatcctccggcagtccctctccgccgtacttcttcgtgatctccgaaccgaaaatcgtaccgaaggaacggtcggtgttcgtcacctccacatcaatacttctgcgctgcttctgctctaacgcaccctttaactgttttaagagcacggtcacatccttggacttctccagttcaaaatcatagacatgcttcgggtcaaaggttactttctccttcggtcccgcaaacgggttgttcaaaagattggagagatcgatctcgcggtcgcgtcccgaaagatcctcgcgcaccttaagcagatcgcttctgccgaccatctcgtcgatcgtgcggcatccgagctttgccatatactcccgcagatcctgtgcgataaagcgcataaaattctccacatattccggcttgccggcaaaacgcttccgaagctccgggttctgtgtcgcaatacctgccggacaggtatccaggttacagacgcgcatcatcacgcagcctaaggtcacaagcggcgctgtggcaaatccgaactcctccgctccgagcagcgctgccgtagcgacatcgcggccgctcatcagcttgccgtccgtctcaatgcgtactttgttgcgcagtccgttcataatcaatgtctgatgtgtctccgcaagaccaagctcccacggaagtcccgcattgtggatcgagctggacggagccgcaccggtaccgccgtcatagccggagatcaggacaacctgtgcccctgcctttgcaacgccggctgcgaccgtaccgacgcccgcctcggataccagcttcacggtgatgcgcgcatcacggttcgcattctttaagtcgaagatcaactgctccagatcctcgatcgagtagatgtcatgatgcggcggcggggagatcaatgatacacccggtgtggaaagtctggtctttgcaatccacggatagaccttcttgcccggcaggtgtccgccctcgcccggctttgcgccctgtgccatcttgatctgaatctcctgcgcgctcaccagatactcactggtcacaccgaaacgtccgctcgccacctgcttgatcgcagagcaacggttgaccgggctgttcttgctcgcaagacggtctgcatcctctcctccttcgccggagttggacttgccgtgcagacggttcatggcgatcgccaacgtctcgtgcgcctccttggagatggaaccgtaggacattgcccccgtcttaaaacgcgtcacgatggaatcgacactctcgacctcctcgagcggcacgccctttttcgggtaattgaaatccatcagaccgcggagcgtgatctctctctcttccttattcacaagctccgtgtactgtttaaagagttcgtagtcgccgcgctttgtcgcctcctgaagcagatgaatcgtcgccggattgtagagatgcggatctgcgccgcttctcatcttgtggcgtcctctgctgtccaatgtgagatccgtctctaatcccagcggatcgtacgccgccgagtgaagctcattgacgtcatccgcaatatcctccagcgtaatgccgccgatcgggctgaccgtattcgtgaaatacttgtcaatcacatccttattgataccgatcgcctcgaagatcttggaaccctcgtaggactggatcgtcgagattcccatcttggatgcgatcttgacgatgccgtttaaaatcgctgcattgtaatcctgaaccgccgcataataatctttgtccagcatatgctcgtccaccagctgttttacggtatcctgtgccagatacgggttgatcgcacaggctccgtagccgaggagcgtcgcaaaatggtgtacctcacgaggctctccggactctaagatcatggcaaccgccgttctctttttcgtctttaccagatgctgctgcagtgctgatacagcgagcagtgacgggatcggcacatggttctcgtcgataccgcggtcggagagaatcagaatgttcgctccctcacggtacgcacggtccgcctccacaaacagacgctcgatcgccttctctaagcttgtattcttatagtagataatcggcagtacttctaccttaaatccgtcgactttcatcgccttgatcttcatcaggtcggtgttggtcagaatcgggttgttgaccttcaataccttacagttctccgcccgctcctctaagaggttgccgtcctcgccgatgtagacggtcgtagaggtcacgactttctcacggatcgagtcgatcggcgggttggtcacctgcgcaaacagctgtttgaagtaattaaacagcggctgatggtcactcgcaagcgctgcgagcggtgtgtcaatacccatggcggatgtaccctcgccgccgtttttcgccatcggcaggatcgcctcgcgcagagattcgtaggtataaccgaatgccttctgcatgcgctggcgctcttccttggtatactccggcacacgctcgttcgggatctttaaatcctcaagttttaagaggttgcggtcaagccactcaccatatggctgcttgttcgcgtaagtctccttgagttcgtcgtcatcgatgactctccccttgacggtatccacgagcagcatcttgcccggacgcagacgctcctttaccacaatcttcgtcgggtcgatgtccagcacgccgacctcggaggagaggatcagataatcatcatccgtaatatagtaacgggaaggacgcagaccattgcggtcaagcacggctcccatcatatcgccatcggaaaagaggatggatgccggtccgtcccacggctccatcatcgtcgcgtaatactggtaaaaatcctttttcttctgcgacatgatattgttgtttgcccacggctccgggatcatgatcatgactgcgagcggaagttccataccgctcatcacgaggaactccagcgtattgtccagcattgcggaatccgatccctcactgttgatgaccggaagtaccttctgaagttcgccctttaagtgctcggactccatcgtctcctcgcgggcgagcatcttatcggcgttgcccttaatcgtattgatctcaccgttatgtacgataaagcggttcggatgcgctctctcccagctcggattcgtgttcgtggagaaacgggagtgtacggttgcaatcgccgactcgtaatccttatcctgtaaatccgcaaaaaacagacgaagctgctctacaagaaacattcccttatagacgatcgtacggctggaaagggataccacataggtatcatcgttggactgctcaaagactcttcgcgccacatacagcttgcggtcaaacgccagtcccttctccacatccgccggacgcttcacaaagccctgcatgatgtacggcatgcagtccaccgctttctgtcccagcttcgtcggatcggtcggaacttcacgccagccgaggaactccattccctccttgccgacaatgacctcgaacatcttcttggcacggttgcgctttaactcgtcctgcgggaaaaagaacatgccgacaccatagtctctctcctcaccgagttcgattccaagctgttttgccgccttggaaaaaaacttgtgggatatctgcagcagaataccgacaccgtcaccggtctttccctccgcatccttgcctgctctgtgctttaagttctcaacgatctttaacgcattctccacagtctcgtgtgtcttgattcccttaatgttgacaaccgaaccgataccacagttatcgtgctcgtaacccggatcgtacattccggctgcctgcttccccgcatccgataccgagaaacggttgagggcgtccttcttataagtggtctgctctttcataatcagcttcctttctgcattctgtattccgatcagctgtctttactgcacggacagttgtctttaccgaatttgttatatcctaatatacaactttctcatttgtttgtctaccagtttattcttataattgtctgattatttgtatatttattattgttaaatctattgtcagattttattagttattatctgtgcaaataatacttatacaaacaattccatgtataagagcccaaaaaaaattttgcacgcaaaactttttccgggctctatttctgtcttttcttaaattgtatctgaattgtcacaccggtctatgcggtagccgtattctccagatctcccaccagatactccatgatgtcgcacagcgtcacgattccggtaaccccgccgtaggcgtctgtcacgaccgcaaaataattctgctgctgtttcatctgctcaaaaagccggtttgccttcatggaatccgctgccagcatcggtttttgcaccgcgcactgcatcactttgtcacgcgtgtggtctttcatgcggaaatacgcttttccatcgaggattcccacgacatcctcgcttctccccgcaaagatcggataataggtatgtacgctctccgccagaatccggtcccagacggcttcatcctcctccgtggacagagataccatctccctgcggtgcgtacagatcgttccgaccgcaatatcgtcaaatccgaacacgttctgtatcatctctgtctcctcggtcggaatggttccctgctctcttccctcggcgagcagcagccggatttcctcctccgacaccgtctcctcttcctcctccgggtcaatgccaaaccgtcttaaccagaaattggtcgatgcggtaagaagccacaccagcggtgcaaagatcttcgccaccagggagagcattcctgccattttaagcgccagctcctccgcctttttcatcgccacccgcttcggcacaagttccccgaagaccagattaaaatacgctaaaatcaatgtaatcaccacgatgcacgcggattttaacgcctcctctgcaaccggtattccggtgcccctcaaaagcgtcaccaacggctgtgcaaagttttccgcggcaaacgcactctgtaaaaatccggcgagcgtgatcgccacctggatcgtggcaaggaattttgccggctgctttatgagcgcctccagctttccggcgcgcctgtctcccgcctcgcagagctgtcggagttttaaatcactcatcgagattaccgcaatctccgcgcttgcaaatacggcattcaaaaaaatcaaaaccatcaataagaatatgggctgcaacatgtctgctcctttctgtttccggcgtcctgtgatacgccctcctgctgcctgttacgtgttgtgtcatttacgcacaaaaaggtatgaccttccggtgtccaaaaaagacctccggtaagccatacctttacctattcataacactgcatggagcagccgtattctctttttaaaagcctgcatatctgtgtatcgctgtcactgtccgcactatcgtccatgaaactgtcactctccttcctgcgatgctaaatggaccgggaatcccgccattcacgtcatttaacataccacaggaaactataacagtcaataactgcacctctacagatactgctaaggtttcaggcagcggacgttttctcctcttcctgccgcactccgccctttttcaccagcagaaccgcaaacgctgccaccgcaaacagcagcaccgtcactgtaacacctgccgccgtgggctggtaggcaatgtccagccagccggtctcgctgcgcacaaccgccatcacattcgccccgatatgcgccagaacgggcgcatacaaaaagccggttctctccagcagccacgcgagcagcagacctaaaatgcccgcatacaaaaactgtaccacgttccagtgcatcacgccgaaaataaccgccgagagcacgattgccggcgcactgccgcacagcagggatagtcttctctccacgacaccacggtacaaaagctcctccgccagcggaatcacgaggcaggagccgagcagttcaaacacaaccccgccggcaaaaaacgcctgattcgcgctttgaaagcctgcggacgcctcaatgagcggcgtcatggcaatcacgttgttgacagccatgccaagagatgctcccgcaagcagcgcccccgccacagtgcagaaaaactttgcgtccggtctgatgccgcgcctgccatagacagtctcccgcgcagcgcgatcctgcccataatgcatccagacgaacggaatcgtggcagccgcgcagagcatctgccgcagcatgtaggattcctcccccgcgccgagcagcagcgtcagaaaaaagtaggcaagcgatgacaccacataatagataccgatcggatatatgattctccagattttataagcacctgtcgtcttcactctgcctctccctctcccgctgcgtcattctcaatgtatgtctccacctcttcgatgcggtcgaagaccgcctccgcacctgcggcgagcagttcttccctggtaccgaagccatagctgacaccgatacagcggattccgaacgcctttgctccggcagcgtcatacttcgtgtccccgatcaggcacagttcgtttttcccgatatggctgcccgccatgcggcgccccagttcctcgagcacttccgccttcgtactgatcgagccgtccagcgtggaacctaccacctcatcaaaatatcccagcagatcaaagtgctctaatattcttctgcacgctgtctctggctttgaagacgcaagcgcaagcagataaccatgctccttgaagcgcgcgatcgcttccctgacgccgtcgtagaggctgcactcgaagattccctttacgtcaaaccgctctctgtacttttccacagactgccacgcttccgcttccgtcatgccatacttttcgcgaaataccggatctaagggcggtccgataaagcagcgcagcttcgtgcggtccggctcatcgatcccgtaggcgcgcagtgcgtattgcacgcactttgtgatgccctcctcggaattgatgatcgttccgtccagatcaaataatacagcttttatcatcgttatttcttcgttcctttcgtgtcgcggcccgccacatgcagccggtttaacatcacaggctttccttttacctccgtctgggcgctctcaccctcgccgagcagatgaatcgcagtaagcgcatctccgtccgcaagccgcatgccgcggacgccgaccgcaccctttttcttctccggaatggtatccaccgcaatccgaaggaagaaatcgcgctcggactgcatgacgatcgtctcattcccggcaaccggatgcacgaaaagcacctcgtccccgtcggtaagcttcgtcgccgcggtcgtgcgctttgcaacgtcaaactcgcttccgtccacaatcttaagcatcgccgtcttcgtgccaaagatcagcctgtggttgcagatcgctcccagattcgtgatatagacaaagttctcctcactgctgttgtaattgctcagattgtcaatcggcgttcccttgtcgcggaacttgccgaatggcagatccagcaccttgagcagatgcatctgtcccttgttcgtaaaaatgcagatcttatcggtattcttacaggtcagcacatagcggttctccgcatcggccgcctcgcggttgcgttcatacgccgccacgtcgatcgtcttcgcgtagccaaagcgatccatcaggaataccacgtccatctcctcaatcttcttctcctcgacaaccgcctctttgagattgtcaatgacagtgcgccgcggtctgccatactcctttttgtaagcttccagctcgcggataatcacctttgccatcgccgcacggttgcttaagatctcattgtactccgcaatattggcaagcgtcttctcgtgctctttcatcagcgcctcgatctcgagtccgatcagcttgtacagacgcatctctaagatggcatccgcctggcgctccgtaaaacgcaggctctgcgcgtccttttgggactgcgccgacttaaaggcaatcccctcgatgattccctcggtcagacaggctctcgccatcttgacgttcgcactgccgcgcaggatctcgatgataagatcgatcacatcgcaggcgtggatcaatccctcctgcacttccttcttctccagctccttggcaagcagcgttgtatactttctctttgccagctcatactggaaattcacatgatgacgtatgatcggcacaattcccatcgtctccggtcttccgtctaccaccgcaagcatattgacaccgaacgtgtcctcaagcttggtcttcttatataatagattctccagattggcagcgtccgctcccttgcgcagctcgatgacaatgcggatgccctccttggaggactggtttgtgatatccacaatgtcattcgtcttcttcgtctccacgaggctgtagacatcgtttaagaactttccgatatttgcaccgatcatcgtatacggaatctcggtaattaccaggcgttcctttccgcctttgacctgctcaacctccacttttccgcggatcttgatcttccccacgcctgtggagtagatggctgtcaactcgtccttgttggcgatcacaccgccggtcggaaaatccggtcccgggatatactgcatcatctgctcggtgttgatgtccggattcttcatataggcaatcacaccgtcaatgacctcgccgaaattgtgcgtcggaatgctcgtcgtcatgccaaccgcaattccctccgcaccgttgatcagaagattcggcacctttaccggcagaacctccggctctttctccgtctcgtcaaagttcggcacaaaatccacgacatccttgtcaaggtctgctaagaacgcctcctgcgtcagcttctgaagtctcgcctccgtgtaacgcatggcagccgctccgtctccctcgatggagccgaagttgccgtgtccgtccaccagcgtctgtcccattttaaaatcctgtgccagcaccaccaacgcaccgtagatcgaactgtctccgtgcgggtgatacttacccatggtatccccgacaatacgcgcactcttacggtacggcttgtcatagcggatgccgagttcatacatatcataaagtgtccgcctctgtaccggctttaacccatccctgatatccggcagtgcacgtgagataatcacgctcattgcatagtcgatataggatttctgcatcagctccgaatactcggtgcggataatctgttcttcctgtttcatggtaatcctcatttcctgccgcttcttcctgcggctctctcatcccgcgcatgatcctgccgcacggtatcgcatctgtcatgcgtccacggtcgcatccgtcgcatgctcatagataaaggtcttgcgcggcggcacgtcattgcccatcagaagctccgtgatgtcggacgccatgcgaccgtcctcaatctcaatccgctttaacagacgtctcttcggatcgagcgtcgtctcccagagctgctccgcgtccatctcgccgagacctttgtacctctgcagtgtaaaactgcccttgtggctccgtctatagcgctccagcgcctcatcatcgtagaggtattcttcctctccgcggcttggaatcgccttgtaaagcggcggcattgccacatagacatgtccctcatagatcagttctggcatgaaccggtagaataacgtcaaaagcagcgtggaaatatgcgctccgtcgacgtcggcatccgccatgatgataatcttgtcatagcggagcttcgtgatgtcgaaatcattgccgtagccctcggaaaatccgcagccgaacgcattgatcatcgtcttgatctccgcgttggctaaaatcttatcgatgctcgccttctccacgtttaagatcttaccgcggatcggcagaatcgcctgaaagctgcggtctctcgctgtcttcgcggaacctcccgcagaatctccctcgacgataaaaatctcgcagatcgatgcgtccctgctctcgcagttcgcaagcttgccgttggagtcaaaggagaacttctgctttgtcagaagattcgtcttcgctttctcctcggtcttgcggatcttcgccgccttttccgcacaggaaatgacggtcttaagcacttccagattcttgtcaaaatagagctggatctcgtcgccggtcaccttcgccgtcgcccgcgacgcgtcctggttatccagcttcgtcttcgtctgtccctcgaagcgcggatccgggtgcttgatggagacgactgccgtcatgccgttgcgcacgtccgcaccggtaaaattggcgtccttatcctttaagatgccaagctctctcgcataggcattaataacagtcgtaaacaccgtcttaaaaccggtgatgtgtgttccgccctccgcgttgaaaatattattacagaagcccagaatattctcatgaaattcgttcgtgtactggaacgccgcctcgacggtaatgccctcagtctctcccttaaaatacacgacatcatgcagaacttccgtgctcttgttgagatccttcacaaaccccttgatgccttccggctcgtggtagacgatatgctcggtctcctcccctctccggtcctcatagatgatcgtaagctccgggtttaaatatgccgtctcatgcatacggctcttgacctcgtcctccttgaaacgcgtcttctcgaaaatctccgggtccggcaggaaattgaccttcgttccggtcttcttcgtcttaccaatcttcgggagcagtccgttctcaagctccaccaccggcacaccgcgctcatagcggtcgtgatgaatgtagccgtctctgctgatctcgacgtccatataggtggacagtgcattcacgaccgaggaacccactccgtgcagtccgccgctggtcttgtatgcggaatcgtcaaacttgccgcccgcatgcagcgtcgtgtacacaattcgcgctgccgacacgcccttcgcgtgcatgccgaccggcacgcctcgtccgttatcttccactgtacaggagccgtccgcctccaatgtgacatatatggtatcgcaggcacccgccagatgctcgtccactgcgttgtccacaatctcgtaaataagatgattcagaccctttctggacacgcttccgatgtacattccgggtctcttccttacggcttcgagtccttccagaacggaaatgctactctcgtcataagtctctttctttgccatgttcttcttcctttccttgacattcctctggataatataacatactgggaaaacccgtgcaagcaacagaacgtatgttttgtaaaaattttctatttttgtgcaaacagacgaaatacgcggaaaagaatccgattgctttctttgtccgcgtattatcatttgcttttctgttgtatcttacatgttcatcagctcggctgccttatccttcagatcagaggaaatctccttcaccgaatctgtggatgcggcgatctcctcggtgcttgccgccagattggtcatccgctcatccacttcccggataatctctgtcagatgatccgactcctccaacagctttccgatcgcctgactgatctcattcttgttatcgttgctgtcgtttgcggttgctctgctgttctccgagagattcttgatctcctccgccaccaccgcaaatcctctgcctgccgcaccggcacgggcagcctcgatggaagcgttcagtgagagcagattggtctggttggcaatcttcgtgatgtcgttgttgttgttctcaagcttatccaaaagctccgtgatcgcctcaaacgactgcttcatctcctggcagaatccggtcacgccggtcatcgcatccgtaatcgccgtgctctcgctcgcattgctgctattcccggcagccatctgcccgatggcggaatccagttcctgaaaatcggaattcagtccctcgataattcctgcaatcagatcgcttctgcgctggatctccacattcgcctgctggctttcctccgcagccgcctgtgccgcacgccctctttcctccgcctcgttcttgataaaatgaatacaggaattctcactgttgcacccgttgtagatcgctgtcgccatatcccggcaggtcttataaccgcaggcgctgcagtcgatcgcacgatccatcgccgtctgcttgttcagacggctgtatactgcttctaactcctgtccctccggcacgcggatctcattccccttcgaccggtcggtataccggcgcgtaaaatccgccggatcaagctgcgcaaactgacggttcagctgtgccagccgctgcttcggcgtcgccgatctcgcccacggtcccttgaccttcttgctcttctcccggatcttatgcagctcgtagagcacatcatccccggcagtcttctccggctcaacgcccgtaccgtagatgcatcccatcgcacagttcagcgcatcgaccataaacggcagttccttgtgctctgcgacacgcttgcgataggcatccaggaattcatagacatggcgctctccctcaatctgccggataaatacatcctctccgcagaaccagtagacattctccttcagtcctcccggcatcggatagatcgagccgagaccgtattcgatctcatcgctgacccccggtccactgatccggtgcttcctgcagtaatccatcaggtgatcgaatgtcacattataagaaacatagccgtctgtatccggatcggaaatctcgttcttcttcgcaatgcacggactgatgaacgcaagcttgtccatgatatgtaaatacttcttcgcgtagattgccgcacacatcatcgggctgtgtaccggcatcagcttcggaagcagttccggtgcatacatctcgatgtagttgaccaccgcaggacacggctgcgagatcccgcccgtaaactgattcttcgtaatataattgatatacgcccaggtcgtaatgtcggcgccaaagctgacactgatgatccgctttgcccccatctgtcttaagccgcctaaaatctgctcatactctctgggataattcgccagaaatgccggcgccagaagcagtgaaatggattcgcctctctgcagatccgcaaaaaactgctccgtatcatcggcatattccctcgcctgatgttcacaggcatcaaaacatgcaccgcagttgatgcactgtgcatggttgacctcaatgcgtgacttcccgtccaccacgacagcctgattcgctgtcagaatgggacagacggaaatgcaccggttgcacccaatacagttctcattcgtgtaaacatagccagccataactcttccactcccttatgctgtcttttgtttaattttaacatatagtgttgttttcatcaactaattcagtgcattatcactatttttgacatactgcatgtgggaaatgaccatcattgcaatcttgaatgtcatcgcatcatcaaacttgcggatatcaagcccgatcaccttctccaggcgctccagacggtacaccaacgtgttcctgtgcacataaagctgtcttgccgtctcagagatattcagattgttctcaaagaacttctgaatcgttgtcgtcgtctcctcgttgaacacatccggaatttcatccccaaatacctcatgaataaacatctcgcacagagacatcggaagctgatagatcagtctgccaatacccagataacggtatgcgattgtctctttttccacatagaagattttccccacctcaagcgccatctttgcctcctggtaggatttcgcaatatcctgcaggttgttcacacggttgccgtagccgacccggacgcgtaccatcgcctccgcgtgcatattgtccacgatcattgacgccagggaggccagatcctcgtcctctcccatctctctggtatctttgatgagcacaatgctctgctcgtccacctctgtgacgaaatccctggtcttcgccgcgaacagattcttgaccagttcgatcgccgtaccgtcctttttaccttccagctcgatcacaaataccacgcgctccgcctgctcgatgtgaagcttctgcgccttgttatacatatcgaccacgagcatattgccgagcaggatattctgcataaaattgttccggtcaaactgctccatataagcagacacaagcgtccgaatctggcagactgccagttttccgaccatgtacgcgtcctccgcagaagatttggtcaaaaggacatattccagttccccgtccacatacaccttaaagaaatgacatccggacagcatctggctctccgccatggaacccgcaaaagaattcacagcgtactccatatccccttccgtttcaaacgtcgctgccacctgctttcccttatccgtatatagtgccagatcaatcttggaaatctcttttatctcatctaatgctgcctgtatcttgtgattcgaaatcatgtgtctcacctttcctgtcaaatattactgtacattgacatgcctcatgtgttccatacgttaataaaaactgggtacaacatgtgcacccagttttacttttaagtcctattcaattctaacggattagttggtaattgtcaattctgtttctttgtcgaatacgtgaatcttctccggatcaattgccatcttgatgtggtcgcccatacgtgcagttgttctggaatcaacctttgcagtcatgcttgcgcctgcaactttgaagtataacagtacctcagaacctaataactcatatcctgtcacatctgtctcgaatgcagcatccttatgagcctcgatctcgatctcggaatcaccgatatcctccggtctgatacccataacaactgtcttgccattgtatccgccgtcagctaacttcttagcttttgcaggaggaagaataacagttgtgttctcgaaggaaagggttaccttctcaccctcaaccttgcatacagcatctacgaagttcatctgcggagatccgatgaatcctgctacgaataagttattcggctcgttgtataacttctgcggggaatctacctgcatgataacgccgtcctttaatacgacgattctggtaccaagtgtcatagcctcggtctgatcatgtgttacgtagatgatggttgcttttaatctgttatgtaaggaagcgatctcggaacgcatctgtacacgaagctttgcatccaggttggagagcggctcatccatcaggaataccttcgggttacgtacgatggcacgtcccatggcaacacgctgtctctgtccaccggagagagccttcggcttacgatctaataacttctcaaggtcaaggatctttgcagcctcctcaacttttctcttaatctcatccttcggaacttttcttaacttaagaccgaatgccatgttgtcgaatacggtcatatgcggatacagagcgtagttctggaataccattgcgatatcacgatccttcggctctacgtcgttcatgagctttccgtcgatgtagaactcaccggaggagatctcctcaagacctgcgatcatacgaagtgtagtagacttaccacatccggaaggtcctacgaagataatgaactcctgatcctctacttcaaggttgaaatccttaacagcctcaaagccgttcggatatactttgcaaacatttttcaatgataaacttgccattggtacgatacctcctaaaatttgttcgtttttaactactcttactatacaaaaaaaacagccaaaataccatagaccgcctacacaaagaatttttgcttttcttgtagaatgtcacagtgttttggttgttttttctattctttcgtcaaaccgacaggttttccatcaaaaagtaagcactttgacgaacgcattactgttttccagtgcttccgaatccgccgcggtttttgttgccgaggctctccacctcgtcaaacgtgatcttcggctgattttcaaaaatgcggaactggcagatgcggtcattgacgtgaatcaccgtgtcgcgcaccgcatagaccggcatccgccacatatcgtcatccccgcagtaggtgccatcgataatgccgcagctgttcgtctggatgattccgtaatttttgaaagtggagcttctcggtaccacatgcgcctcatagccctccggaagctccatggcaacgccgagtggaatcagacagaactcccccgctttcagtgtcacttcctcagacgcccgaagatcgatccagtccgactttccgtcaatataggtcagacgttcaatcgcatccgtaaaatatttaatcctgatctgtggcatgtatgttcctcctgttatgtcgatttctttatgtttcccactccggggcgccatgtcgcatttctatgctccccactccggggcgccatgtcgcatttctatgcttcccactccagggcactatgctctgcacgccggtcgcgcatcatcagttcccgcactgcttcttttgccggcttatcctcaaaaagcacacagttgacttcctcgatgatcggcatatcgaccccgtatttttttgcaagcgcgatcgccgccttggcggaatacacgccctcgaccaccatcttgacctcatccatcgcctgcttcatggtatagccctgcccgatcagcattcctgctttgcggtttctgctgtgtctgctctcacatgtcacgatcagatctccgattccggtcagaccgctcagtgtctccgcctttgcccccatcttgatggcaagacgcgacatttccgtgattccgcgcgtgattaacgccgctttggtgttgtccccgtagccgagtccgtccgccataccggctgccagtgcaatgacgttcttcagggaacctcccagttccatgccgagcacatccgggcttgtgtacacgcggaacacctcattcatgaaaatatcctgcacgccctctgccaccttgcgcttctttgctccagcaacaacggtcgtcggcagtccgacgccaacctcctcggcgtggctcggtccgcacatcacggcaacctccgccgcaggtacttcctcttctacaatatcggagagcgtcatcagcgtattttcttcaatgccctttgccacacagacaatgatctgtcccgccttcacaaaaggcgccatgctttttgccgtgcttctggtgaatacagacggtaccgccagaatcagatattccttatcttccactgccgccttaagatccgtggtaaatgccatatcctccggaagcttcacccccggaagcttatccacatgttcatgccgttcgcgcagcatcgcgatctccgcttccacaatcgaccacaccgtcacctggttgccgttggtgtgcaacaccttcgcgagcgctgtcccccagcttcccgctccgattaccgctacttttgccatatcttttattttccctcctgtttgttcttcttgaacgtgaacttattctccgtgccgtgcagcagacgtccgatgttgcttctgtgacgccacagcgccatcgctgtaaagcaggcgctcaccacatagaactccggaaggtacgcggcatcgatatgcagatatcccatatgtccgaagatcagtacctgcaccagatagctcgtcaccaccagaattgatccgagcgacacatatcttgtgatcgcaatggaaccgatgaataagatcagacaggccggcgccgccagcggacacacggcaagaatcatgcccgatgtgcaggcaattccctttccgcccttgaacttgaggtaaaacggaaaattatgtccgagcacagctccgaaaccggcatacagttccagaatcttaaccgcatccggataagcgttccggaacagaaccttcaccagaagaaccgccagaatcgccttgcacagatctcccgcaaacgtgatcagtccagccttgattccaagcacacgcagggaatttgtcgtccccgcgttgccacttccctcactgcggatatcaatcccctggctttttccgtagagataccccgtctgaaacagtccaaacagatacccgattcccaatgcaataacccttgctcctatcatcactgctcttcctttctctcccgaataatgaatttcagtgccgttccgcggaaaccgaacgtctcacggatacggttctccagatacctggtgtaggaaaaatgcatcaattccttatcgttgacgaaaatcacgaaggtcggcggctttaccgcaacctgcgtcgtatagtagatgcgcagacgttttcccttgtctgacggcggctgctgcatggcaactgcctctgtcacgatctcgtttaagacaccggtcgccacacgcatgctattgttcgcaataaccacatcaatcagctcaaaaatcttatttaagcgctgtcccgattttgcggagataaaaataatctcggcatacggcataaagcttaaaatctgacggatcttctccgtgtgacggtagatcgtcttgtcatccttctcgatcgcatcccacttgttgaccgcgatgataattccttttccgcgctcgtgtgcgattccggcaatcttggcatcctgctccgtgacgccctccgtcgcatcgatcacgatgatgcagacatccgcccgctccaccgctgtcaccgcacggatgatgctgtagcgctcgatctcttccttaatcttattcttccgtctaagacctgcggtatcaataaagacatattcttttccgtcgtaggtaatgtcggtatcaatcgcatcgcgtgttgttcccgcaatgtcggagacaatcacacggtcctcctgtgccagcttgttaatgagggaggacttgccgacattcggcttaccgatgatcgcaaccttcgggcgctcgtcctcctcctcgtccttcgcatagtccgggaagtgcttgaccacttcatccagcatatctccaagtcccagcatggatgccgccgagatcggaaacggatcgccgatgccgagattgtagaactcatacacatccggcatgaacttctcaaagctgtccactttgttgaccacaagcacgaccggcttgccggagcgtctgagcatatctgccaccttggaatccgaatcctgcagtccctgtctgacatccgtgaggaaaataatcacgtccgccgtcgcaatggcaatctccgcctgctctctcatctgcgagagaatgacatctctgctgtccggctcaataccgccggtatcgatcatcgtaaaatgataatccagccagttgacgtccgcatagatacggtctcttgtcactcccggcgtatcctttacaattgaaattcgctctcctgcaagtgcgttgaacagtgtggattttccaacattcggacgccctacaaccgctactacgggtttactcatctatctgacctttcctttctataaaaaacaatatcgtccatcttcttactgacaggcagacttcacctgtccctatcataatcctgaccgcttgattttacaatatctgtcccgacttgtaaagcagtttaacaaaggcaggcaagaggaactgccgcaataagcatagacctctttgtgggatacgtaatattattagaaaaccagcccttgggatttcagatgaaaatgcaaatggaaattcggttcaacaaatgtggcatttctaaccaaccgaatgtttgcatcttcgatgatccgtgtctttccaagtttggagcactccgcgggtcatgtccgcatcccggagacaatttgtaggacttttttgtgtgtcccttatggcacctctgaacaaaacataaccgcgcgaagccgctgtctgagtcggcatctgccctattttcaatagcagatgccggcgagttcggttcgcgcggttttatattgtctgtgaagaggtgccattagggacaccagaaagtccgcccattgtctccggtgtgtcggacatacacccgtcggattgtccaaacgtggaagagacacggaatccgatgcaaacattcagccggaagaaatgctcacatttttctcaaacgaatttccacctgcatttccacatgaaatccccaagtatgtttctaaaccatattacttatcaacacaaagcacaatatgcttcgtgcggcagttcctcttcctgccgtatctctactgcatcatctcttggttcgtcatcagcttccactcgtcatttgtgatgccaagtttctcaagcgtctctacgatatgcacgcagtccggtccgaacgtcagatacagattgccgcccgctgtcatctcctgaccgtccacggcttttccttccagcttctctaaactgttataatagtcataataatacatccagttgtcaacatacctgcctgtactataatattccagttcaatgttgctgtagtacgtgtcttccggctgctcgcaatactgataatacttcgccagatttccatcctcgatatccgcccggatggcctttaagatctgcttaatctccttctcggaaaacatgtgcgtattgttaagccccgtagaagtatacagatccatatatccagaggtaaaccggcactctgaatttccgataccaaaaatctcacgctccagattctccggctcactctcccacgcaaggatctgctctgccggtgtactgtcagcacccccatccgcctcagacagtggaagtgcataccgccgctccaccttggaaccatcctgcatataatacaggaacgttgtataataaaatcccgaaccggtacgttctacctcctgataggcatccttatttgcaataatctggcgctgcagctccgtcagtgtcgcaagttcttctcctttcacctgcaccggataatccagatagacgaacgccgtctccacatccgccacctccggcacatagcgctccagaccgaatgcatcgatttcaaacagggatacaaacaccactgtgatcacggcagtcgccgcccactccagcacgcgttttctgcgaaataccttgaaattcttttccagcagcatctctgccccgaagaaaaagaggaagcccatcgccacactgcaaagcagcagccacggatatttgcgcagctgcggcagatccgtgagcatggatatgaccgtgacaccgacgaccagacctccgcaaagtgctgctccccagcggaataccggcttgatgatcccgatgctgacccagtcgcccgccgtctcaatctgccgtcttttatacaactggtaagccgccacgacaagcacaactgctgccgccgcatagattccggtgagcggcatgcccgtgatcttaatgccggtaattccattcccgttctccgtgtagataagactgctgcgaagattattgttcagataataaagtggcgataaaatgcagctttttcccggattccatgcattctcaatcccgtagctgatggtttcaatcacctttgcaacaataaacatgcatcccacatacagatagttgacgatcacataatagcatggcattgcaaacgcctgccctgtgaacatcgccacgaaaaccgcaagtgagtatgcaaaaaatgtcacaccagcctgtgccaacagcgcagcgaacagatactgtatacaggtaaactggtttgccaggcatacgagcactgtgataaagaatgtgatgatctccggcacgatcagaaaaatgagtcctgacagataattcgtcacataaagttccagccggttgaccggcaacgcatgcatcatattggcgctttttgccgaatacagataggaaaacactgccagcgccgctgccactgcgaagaaaaagaccggcagaggagggatcatccggtgtactgccagctccaccagctgatacatgcggtaggttgtgtcctcgttccccgttccataatagtagtacggactggcagccttctgccacacccatacgggaatcaccacaaggagatatatctggtaaagcagccacagcggccagaaatgcgtgaagttcttcttaaatatcgtgcggttaaaacaggatgtctttgacttcataatctgcccctcccatctcgtagataaatatttcttccagtgtcagcggcagtacatccacaatcgtcggattgcaatatgacagtgccgcctctgcttcctttggatctccctttacgatcatggtatacacacgccctgtatttgccatgtgaagcacctgaaaatgttccggaagcttcggcattccgctctgacacgccacctggattttcgacacacttccctgcagatcactcagcgaacgctcgatcatgatttttccatgatgcatgataccgacatggtcacacacatcctcaagttcacgcagattgtgggacgatacaagcacggtcatctctttctctgcgacctccgacaatatgatgctccagatctgacgccgcatcacagggtcgagtccgtccaccggttcgtccagaatcagaatatccggcttgcagcagatggcaagccagaatgccacctgtttctgcattcctttcgacagccgtctgatattgcgcttcacatcaatattcgggaaaaactcctgcatccggtaaaacagctttccatcaaaagacggatagatcccctcataaaaacgcttcatctccatcgtgtctgcctgcatgaaataaaacagttcgtctggtatgtacgcgatttttgatttgaccgccttattctcatatacattttccccgtcgatctgcacctctccctgatccggacggtacacccccgtcaggtggcggatgagtgtggactttcctgctccgttcggtccgaccagaccgtagatggctcccttttccacgtgcatgtccacaccgtttagcgccacaaatccgtcaaatgccttttttaatccgtttacctgaatcataccttctctcctccctctgccgcatgttcgatccgtgtgatcagatcgctcctgctcactgacaggaaacagagctcctccaccacttcatcgaactcttccagcagttcatgctgtctcgtattcaggatttccctgtgctccgccacaaacgttcccttcccggcaaccgtgtatgtatatccctcgctctccagatcgcgatacgctttctgaatcgtattgggattgatcgccagtccggacgccagttcgcggacagacggcagcttctcgtttgccgaaagagaatttgtgataatcagcttccgaaagccatccttgatctgttcataaatcggtttggagtcccggtaatttaactgaatcaaatcataacctcccatctgtaccaactgtactatttgtcttaatacagctactatagcatggaaggttccctcatacaataaagataatcctatgaaattattaacttttatttaacttcgtcatcagcccagatatgcacacaggagtttgaaggtgttcttcacgccgtccacatggcttctctcgtagccgtgcgacgcgtacacgcccgcgccgatcagtccgtggcgcacgtcatagcccgccgtcagcgccacatccgcatccgatccgtaatgcgggtagacgtccaccgcaaagtcaagttcctcgcgctttgccgccgcaatcagtcccgtcacgacgtcgtagtgatacggtccgtggctgtccttcgcgcagatggacacctgtgtctcctcgcaggcaagaccgtctccaacgcagcccatgtcaacggaaataacctcagtcacaccctccggaatcgaagcggctccgccgtgtccgacttcctcaaagacggtgatgtgctggtaaatcatgcgctccggtgtgacattctcttcttttaaatatctcgcatagccaagcaggatgccgacgctaagcttatcatccaggaaacggctcttgatgtagccgctctctgtgacggtcgtgcgcggatcaaagcagacgatgtctcccgtcatgatgccgagtgcctccacgtcctctctggaatgtaccttctcgtccagcacgatctccgtctcgtcaaatgtacgcttcttgtcattgtaatcgccgttgacatggatcgatgcattggcaagctgtaaggttccctcgtagaccttttccccgaagcgggtatggattctgcagttctccgcctcggcattgttggcgttcattccgccgaccggtgttacccgcagtctgccgttggacttgatctccgctaccatggcgccgagcgtgtcaatgtgtgcctcgagcatcacggcattctttttgtccttgccgccaagcgctaccagcacgccgccctttgtggtcagcttcggctcataaccgagcttctggtacgctttcatcacataatccgccacatctgcggtatatccgctcgggctgtcgattgccagaatcttctttgtctcctcgaccatatattccacgtatttttttgtcttcatcttttttctccttttccgctttctatttgattctatctacagaccatacctggaggacgatcttatacatccttatttcaggtacagaaatccgcccagatttccgcgctttccatgacttgcgcggtgggaaaacaacagctttggattgcagcaggtacagatgtccgtcactgccagatgctcttttcgcacgcccgcctcctgaaaaatgatctcgttcgccttccagagatccagctggtattttttgtctgcgtgagccatcccgacgctgttcttctcactctctgccagaatctcctgctcatgccccggaaattcctccgcgaaaatatctgccacatctgcgctcacctcatagcagtccttgcaaatggacggaccgaccgcgcagaccacatcctctggtctggtgccgtatgcctcctgcatggcagacagagtgaccgctcccatgcgcgccgccgtgcctctccagcccgaatggctcattccgatggcgcggtgaacgggatccaccacatataacggcacacagtccgcgtagaacgtcgacaggacaagtcccggctcatccgtaatcagtccgtccacatcccggtagtcccgctctctggtcagtccttttccggcgtccgctgccgtgacgcggcgcacattgacggtatgtgtctgatccgagcagacaaactgccccacctctgccccgagtgccctcgccaggcgccggtaattttcacgcaccgcagcctcctcatcgcctctggtaaagcttaaattcatcgtagaaaaaatgtctgtgctgacgcctccgagccgtgttgtaaaacaatgctccacgatccccgtgcgctccaaaaggggatattttaacagcagcagcctgctgccgtcctcattttcatgccagtcctcccgcaaaaccgcatcctctgctgcttttctcacaaacgctgtcaagtctcatcctcccgtcatccctgaaattcaaatgcatttctcacaagccgcacttccccgtctgttccaagcaccgccgccacatcaaagcggcagggcgtcgtctccccgtatccgtgcgtcaggcagtaatattgcgccgttctgctgatgcggcgctgcttcgcccggtccaccgcctccagcggatcgcccgtctgcccgtctctgcggtatttcacttccacaaacaccaggtatctgccatcgcgggcgatgatgtcgatctctccctgccggcatctgaaattgtatccaatcagctcgtatccctgttccttcagatactcccccgcccgtctctcatacgctgttcccgtctgccgcctgttcatccggtatcctctctccctgcctttcgtccgatccatcaccacgttccgccgtccgggttcttcccgtgccttctgttaccatcacggcatctgtcatctgcctacagtaagccggattctttgagttttcccttcatgcggtccatatcgtccacaaagacaaggatctccgcgaccacctcgtagagttccggcggaatcgtatccccgatctgaagtctggataaggtctccgccagcttgttatcctgataaaacggaacatcgttttcttttgccgtctcaatgatgcgctccgccacctcgccttttccgactgcgaggatcttcggcgccacctcgcccggattgtaggcaacggcgaccgccgtcttttcttttcctgcaatatgcttgttctccgccatcgccacatcctcccttcaaagaatcctgctttcctatgctcttacatcaaaagaatagcggtgcaggcttcccaccgtcgcctttcctttctttacgatattctccttgaaactgatgtcttttttctcatgtgtgaccgtgatggaagactggtagcccttgctcttaagacgcttgttcagcacttccaggtgcttttccaccagatcataggaggcatcatcctccagataaaaattggtgcgtacgctgcggttctgcatccgcactgagacgtccgtggagccgagctgctccatgtccagatgtaaaaatgccgtcagttccgcatccggatcgcgcagattcttccggttcgcatagacatagagttccccgttcgcattttgtccggacatctttaacggcagctgcacatagtgataaatctggttcatctgattcatgaactccagattgccgtgaacctgcgatgccgtctgcaaaaacgtattctgcgtgcttccggtcgcccgaaccgcctcctccatctgggaaagctgctgctctaagcgctcatacagcccgctcaccttatgctcctgctttaattcctccggctgcagaagccactgcttctcgatcacactgcggaaaatggtctgaaattcctttccggcaaaaagcttctgcattcccgcaaagccgaacccgccattctgtgcgagcgctctgccgagcttctgtaaaaactgttctgccgtcaatttttcattcaagaccggctgctcctgcgccgcttcctcctgcgccatcagtttcgccacctccggaccttcttccgagagcgtatccacaaagacttcctcctgctctccaccggcaaaaatctcctcgttgccaatcagagccggaatgttccgaagcatttttcccagatgctcgatctgctccttcgacaacagttccccgactgtccccggagtctctgccgtccttccatatgtcagttccgcggtcactccgacccctgtctctgcttctgccgctgcgccctgtcccgctgtctccgcagtcgaagcggcacctgcctcctccgctactgccgatgccgctgcgattccctgttccgccgccgtgggcgcgcccgcctctgcttctgccaccgtggctgcattttcctgtcccactgcttccgccattgctccggcgcctgcctctgctgcggaagattcctgttccgctgccgcggtcactccggcatctgccgcttccgccccgggcataaaaatatcgagcattttcccatagagagaaaacgccgtctccggcgagagcgcctcgtccgaaagcagttccatcatatgtcccgctgccagatccatctctcccacgagtgcctgccggtcggacagataattttcaaactgcgccgccatctcctccgtcaccgggagtccgagcttcgtcatctgcacgatggtctgcacattggcatccggattcgcgccaaccagcttcgccatatcgagaatgctctgtctgccgatcgacatctgctcctgcatcatcgtatccaccatcacaagcgtccggtccgtcgcaggcacctgcgccgccgaaagcgcgttgagcagaatcggattgctgacatttccaagctcggtgtacgggcggatcgcaatcgtctgcccgtcattggcgcgcacctggaaaaacatgctcgagccctgctgtaaatccatttttccgtccagccgtgcggtgatggtctgtccgttgcccagcgccagcgtcacttttccgccgcgcacactgttgatcgtcccctcgaaaatacttcccgcggagagatccccgatcgtcgacaccagtttctgaacgctctgcgccccatgcaattcttccgttccgttggccacattccggctgtactgtcctaccagatccgatatctgcatgtatgttccctcttcccgtctatacctctacaaaatttccaataaagctccggcgatggatcggcgttggtccgtattttttcagcgccgcaatatgttccgccgagccgtagcccttattcgctgcgaatccgtaccctggcatgatcttgtcgtactccaccatcagccggtccctggtcacttttgccacaatgctggccgcgccgatcgagatgctcttggcatctcccttgataatcggcacctgccgtatcgcaaccccgggtatcgtcaccgcatcatttaataatatatcgggtgcatcgcccaatttgcttatagcttcccgcatcgcctcgtacgttgcctgcagaatgttgatctcatcaatgcgctccggtcccaccatgccgatgccgaccgccaccgctttttccataatcacatcgtacagttcctcccgctttgccgccgagagcttcttggaatcgttgatgtagaggatgtcgcagtccttcggcaaaatgaccgctcccgccacaacggggccggcaagcgggcctctccccacctcatcaatcccgcaaatgcgcgtatacatcccgtactcgcgctcgtacttccacagccggtcaatccttgcacgctccgcctccagctttgcaaggcgtccgttcgcctgctcgatgagcttttgtacgcccgcgcgctcatccgacctgtatttttcgataaaagaaggcagcatggtctcctctgccgccttgaattcttccctgatttctccgatctttttcgtctccatctgcttcctctcccgccgtatgttcccgctgcctgtgctagtcgggccgctccagtgtgatcctgccaagcttgccgctgcggaattcatcaatcagaagcgtcgccgccttgctgtagtcaatctcgtcgccctttgccacacagcgacggttttccgcgatcccacgcaggatctctgccggcgccgccgtctcgtcgatggcctgctcctctgttccgtagcgcgcctgaagcgctcccggatagtaggctgtcagcactttgatcaactccagggacaactcatcgatgtttaaaatctcgtccttgatggcaccaatcaacgccagttttaatccgaccgtctggtcttcaaacttcggccataagattccaggtgtgtccagaagttctacattcttgttcagccggatccactgcttgccctttgtgacacccggcttgttgccggtcttggcgcacgcctttccggcgtaggaattgataaacgtggatttccccacgttcgggattccaacaaccatcgcccgcaccggacggttcatgatgccgcgctttctgtcgcgctcgattttctccttgcacgcctccatgacgaccgccgtcacctgcttcatgccgtttctgtttctcgaatccaggcttaccacataatagcccttcttctgaaaatatgcactccacagctttcccgcttcctcgtccgcaagatccgacttgttcatgaggatcagccgcgctttatttttgcccagttcgtcaatgtccggattccggctgctgagcggaatccgcgcatcgacaagctcgatgaccagatcgattaacttgatatcttcctgcatctgacgctttgctttcgtcatatgccccgggtaccactgaaactgcataattactctccattctcttactgtctgttttataaaaatccaaagtccttaaacggcgccacgcggaaccatacttttccgataatatattccttcttaatgttcccgatgttggcataacggctgtcctcgctgttattgcggttgtcgccgagcacgaaatactcgtcctcacccagcgtgacctcttccgccgccagtccggcatcctccatctgtgccacatccacatcttccgcaaacagttcgccgttgacatacacttcgccgttcttaatctgaagcgtatcccccggcaccgctatgacgcgcttgatgtagtaatgtgatttttcattgccgttcggcaaaaatacaatcacatcgttcggcctgggatcggtaactttgtatataaaacggttgaccaggatctcatcgccgccgtttagtgtctccgccatggactgtcccacaacacttgtccgcagtccgacaaaatataccagtgtaaacgctaccagaagcgtgatcgcgatctcaatgatccacacacacacttccttcacgaccgacatattcacttttttcttctgtctgccaaagttcagtccgcttctacgtctgcgcattcttatcctccatgtgccatgtgcccgccgcacacgattcctgctttactttaacacaaaccctgtggcttcgcaatttaattttggtgccttacaatgcgaaaaaaccggaacacactccatatggaatcctgttccatacaaaatatgtcccggcttcttagcgctgcattgtattattttacaagctcttttacctttgccttcttgccgacacggtctcttaagtagaataactttgcacgtctgactttaccctgacgaacaacctctaccttctcaacgttcggagaatgtaacggccaggtcttctctacgccgacaccgttagagatctttctgactgtgaaagtctcgcggttgcttccgccctgtctctttaaaacagttccctcgaatacctggatacgctcacggttaccctctttgatcttaccgtaaacctttaccgtatcacctacgttaaactgcggtacttctgccttgagctgctctgcttcaatgctcttaatgatttcacttgcgttcattttgtgacctcctgattcattggatgttcttaatacgtcgattcgtaacagaggaccatctatttattcacaactattccagtataacacagattgtacggattgcaagcattttcggcaaatattttcattctctctcttcacgctccatccagtagatgcgtcccttagaaaaacagagtcccagggcctcctgcagtcctttggatgcatcattgccgatctcaacctgaccgtagggtctctcaccgcgctctaatccgagattgatcatatatgtctcaagtgccatgccgatccggcgtctgcggtactccggcgagacgaagagcatcccgatgccgccctccgcgtgcattccgataaagcccgcaagctgcccgtccacaaacgcaccgaagagcgctccttttttgatccggtctgtcacatacgcctcatccgatatcgtattgtaatcgcgcaccaccgcgtctaagtgttccatcgtaagcggacggatgaccacgccgttttcagccggtttgccgtccatgcggtacagtccggtgacaggcagcttttcgtgctttgtatacacgatctggttgcaggtcatcgccgtgcgaaatcccagatatttttctgtcggttccgtcatgaactcctgatgcagcaccagaaggccgctcccctccccggcgtccccgtgtagaatttcaagcatcctgcagccggctttgatgtcctccgccgtatgaaaatacgccccactgactttatcctgcagacagatatttttcccttctgcaaaaacaaggcgcgcctgcccgcgcgcaatcagctcggtcatatccacatgcagcagcttgtccccggcaagcacctttttgcaggacatcagtctctcgtagcctgcgtagagatccggccgcctctcctgtgtgcggcgctccgcctcctgtctgcgccactcggcaatttttctctgattgcccgacagcagcacctttggcacctgctttccgtgccattcctccgggcggctgtactgtggatactctaacagatcgccctcgaaggactccgtctccccggactctccgttcgccagtaccccgggcaccatccgtgagatcgcgtctatcatcaccatcgccggaagttccccgccggtcagcacataatcgccgatcgacacgtagtccgtgacggtctcctctaatacacgctcgtcgatcccctcatagtgcccgcacaggaaaataagatcttcctccttcgcgaactcctttgccatctgctggttgaacacggctccctgcggcgtcacatacaccgtgcgcaccggtctgtcccgcagctcctccggctgccggctcctgatttcctcgcaggctgccttccacgcatcgtagaccggctgcgcctgcatcagcatgccggctcccccgccgtaaggataatcatcgacttttttatgtcgatccgccgtataatcccggatgttgactgcattcacggacagcagtcccttttttgccgcacgtccaaggatgctctccgagagtccctgcgtcaccatctccggaaacagtgtcagaatatgataattcatgctgtgcctcctattttcggttgatgtcaagcagtcccggaagcagatgcacgcacatctgtccctgctctacgtccacatcgcggatgcagtccctgatcgccggaatgagcacttcctccccgtctgtcatggagatcacatagacatcgttcgcgccggtctgcatcacatccgacagcgttcccaattcctcaccctcgtccgtcgacaccttcatgccgatcagatctgcaataaagtattcgtcctttttcagctttaccgcgttctctctcgtcacataaaggctctttttgcgatatttttccacatcattgatatcatcaattcccttaaatttgagaatcaccatatttttaaagaacttgacgcctgcaatctcaagttctaatttttcttttccggtatccaaaatcacatttttgagttttttgaagcgcgctggatcgtccgtcgtcggaaataccttgacctccccacgcaccccgtgtgtcgtcgtgatgacaccgacctgcaataaatcttccatgcatgtcctccgtttctgtctctgatatccgcagtagccgcaatatgaacaaaggagctgccaccccattatctggcgcgacagctcctctgacctgttactgcatgatctctacaataactttcttctcttcctttgaggcagcagccttcacaacagaacggattgccttggcaatgcgtccctgtttgccgattaccttgcccatgtcggactgcgcaacgcgcagttcaagcacgatggctttctcattctctgtctctgttacgacgacctgatccggataatcgacgagtgatttcgcaattacttctactaattctttcattaggtccacctcgcgaatcctatttctcgatgcctgcgctcttgaaaatacgagcaactgtatcggtcggctgagctccgttagctaaccacttctttgctaactcctcatttacatgatactcgcttggatctttcgttggatcgtatgttccaatctcctcgatgcacttgccatctctcggggatctggaatctgctactacgattctatagaaaggagctttcttctgtcccattcttcttaatctgatctttactgccattactttcacctccttaaatttgcttaactgatctatttagaatgcgttatacgcaatttctaacattaaaacggaagcttgccgaacattccaccaccgcgtctgcccttcttcatcatgccaggcatctgcttcatcatcttcttcatctgttcaaactgcttcaccagacggttgacctccgcaatatcgacaccggctcccaccgcaatacggcgcttcctgctcggattcaaaagggaaggattctgtctctcctccggcgtcatggaatagatgatcgcctccgtacgcgataagctcttctcggctgctgcctcgtcaatatccggcatcttgcctgcgcccatcccgagtcccggcatcataccgaggatactggacagaccgcccatcttcttcatctgactcatcgactccagatacatctcaaagtcaaattcgttcttgcgcatcttctgctcaatcttcttcgcccgctcctcgtcaaagtcctcctgggctttttcgatgagggtcagcacatcgcccataccgagaatacgcgatgccatgcgatccgggtaaaactgctccagatccgaaagcttctctcccatacccgcataaaaaatcggcttaccggtcactgcccggatggaaagcgccgcaccgcctctggtatcaccgtcgagctttgtcagaatgactccgtcgataccgatgcgctcatcaaaggtcttcgccacattcaccgcatcctgtcctgtcatggcgtccaccacaaggacggtctgatgcactgtgacattttcttttatctgaatcaactctgccatcatatcttcatcgatgtgaagacgtccggcagtatcgatgataacgatgttaaaatcgttcttcgcagcatgttccatcgccgcttttgcaatgttcaccgggctgttcttatcgcccatggaaaatacttctacgccctgcttctgtccgttgatctgcagctgttcgatcgctgccggccggtagacatcacctgccacgagaagtaccttcctgcctttctgcttgaactttccggcaagctttgctgctgtggtcgtcttacctgctccctgaagaccggtcatcatgatgacggtgactgccttgccgggctgcagtgtgatctcggctgtctcagagcccatcagcttgaccatctcttcgtttacaatcttgatgaccatctgtcccggattcagtccgttcatcacgtcctgtccgacggcacgctcctctacgtccttgacgaactgcttgacgaccttgaagttgacatccgcctctaagagcgccatcttgacttccttaagcgctgtcttgacatccgcttccgtcagccgtcccttgctgcgcaggttcttgaatacattttgaagtttttcagataagctgtcaaatgccatctataactcctctaatatctgattggaaatctgttcaatctccacgatcactgcctcgtcatggctctcatgaaactgcttcgtcaatgcatgaatctgttccacactgtgcttcgccgacatgaactttgcgatcagatgaagcttctcctcatacccctcaagggtcttcgtacaccgcttcaccatatcgtgaacgccctgtctgctgataccttcctcgtccgcgatctctccgagggacagatcattgaacacgaaatcctcataaattcttctctgatgttcgttcagcagttctccgtaaaaatcatacagatacgcctgttcaatcttctcttccatctgaaatcccacaatcacgccgtatccggcatctctcactcattgccaccgtgatagaatagcataaaaggaaaaaggtgtcaagtattttttcttgacacactttttccttctttttacaccgccatcgccgtctgcacgatcatgcagaacagacatgccgccgcacagattccgtagagaatctcactctttccttctgttgaaaaaaatcccacgccggccaccacgaaccctgctcccgcggcaatgaccggccacatgaaaagaccgaaggcagtaccgctccatctgcagatcacaagcgccgcagcaaaaccgcatgctgctgcagccaaccaaaccatgatctgtttcatccatctgcgcatagggatacctccataccttcggttttcattttataagaagatgtatttgcacacaaacagtaccgccagcacatacatcagcggtgtgatcttctttgccttaccgcatacgacattgatgatgacataagagataacgccgatcgcaataccctcggagatgctgtacatgagcggcattgcaagcaggcataagtatgccggaattgcctctgtcatatccgtgaactcgatgcttgtcaccgtagacaccataaggaagccgacgaagatcagagccggtgctgtcgcaaagctcgggatcgagcagaaaatcggggacagtaccacagagatcaggaataagaatccggtcactacagaggagaggcctgttcttgctcctgctgccacaccggaggaactctcaacgaatgtggtcgttgtggaggtaccaagcacagcacctgcggtggttgcaaccgcatccgccagcagcgcttccttgatgcgcggcagtctgccgtccttgtccaacatatccgccttgtttgccacaccgattaacgttccgagtgtatcaaacatatctacaaacaggaatgcacatacaactgcgataaagtcaaaaacatgcacaccggagaaatccagtttaaagcactgtccgaatgtctgaccgatcgcggtcagatcggtaaatccgagcgccgggtataaggaataaaaaccggcttccgcatccggaacatagattcctgccgcctggcagagcattccaagcacccaggtaataacgataccgaataaaattgcgccttttacgttcttaatgtacataattgcaatcacaaacagaccgatcagcgctaacaaagcacagatgccggcagtcttgaaattgctggtaaagtcaacataggaaacaagtgtggagctgttcgccactacgatgccgccattctgcagaccgataaatgcgataaacagcccgatgccgacgctcacaccttttttcaggttcagcgggatcgcattaaagattgcttcacgcacattggtcaaagaaagtacgatgaaaaccagaccttccacaaaaacagccattaaagctacctgccaggaatatcccatcgcaccgcagaccgtgtatgcaaaatacgcattcagtcccatccccggtgccagtgcaaacggataattcgcaaggagcgccatcgccatggtaccgataaatgatgcaagtgcggttgcgatgagtactgccgtcttatccattcccgccgctgcaagcatggtcgggttgactgccagaatgtacgccatcgtcataaaggttgtgatacccgccatgacttcggtcttggctgtcgtgttgttttccttcagtttaaaccacttttctaacattttctttctcctcttctttggttacagactcgtgcgcaccagcttcggcttatagcccttcttctccagtgctttcatgatctgctttttgtgctcggtaccgaagctctcgagcgtgatacggagttccaccgcggcgctgcggttcgttgtcacaaactggttgtgctccagcttgatgacgttgccctgctctgcagcaatcgctgctgaaacctttgacagttctcccggcttatccggcagaagtaccgacacggtgaagatacggtcgcggaagatgagtccctgctgtaccacggaggacatcgtgatgacgtccatgttgccgccgcttaagatcgataccacacgcttgtcggaaacatccagatgtttcaacgcagctacggtcagcagaccggagttttccacaatcatcttgtgattctccaccatatccaggaatgccacgacgagttcattatcctccaccgtgatgatgtcatccagattcttctggatatacgggaaaatcttgcttcccggcgtcttgaccgccgtgccgtccgcaatggtgttgacctgcggcagtgtcgttacttttcccgccgcaaaggaagcctgcatacagtttgcgcccgccggctccacgccgatgaccttgatcttcggattcagaagcttcgccagtgtagacacgccggttgccagtccgccccctccgatcggaaccagaatatactccaccagcggaagctccttaaagatctccatggcgatcgttccctgtccggttgcaacggccagatcgtcgaacggatggataaaagtatatccctccttgtccgcaagctcgtacgctttctggcacgcctcgtcgtagacgtctccgtaaagcacgacttccgcaccgtaactcttggtgcggttcaccttgatgagcggtgtggtggtcggcatgacgatgactgccttgcagccgtagcattttgctgcgtatgccacaccctgcgcgtggtttcccgccgatgccgtgatcagcccctttgcacgctcctcatcacttaacgtgctgatcttataatatgcgcctctcaccttgtatgccccggtgaactgcatgttttccggcttaaggtaaaccttgttgccggtctgctgactccagtaatcgctgtataccagctttgtctcaagtgtcacttctttgactttttcacttgcttcctcgaacttgtctaatgtcaacatccgcttttctcctctcctacttcaaataatgcgtttacgaactggttggaatcgaacttctgcagatcctcgatcgtctccccgacgccgatatacttgaccggaatgccaagctccgagtggattgccactgcgataccgccctttgccgtgccgtccatcttcgttaaaataattcccgtgatgtcggcgcactcggaaaactctctcgcctggtttaacgcattctgtccggtcgtcgcatcgagcaccacaagcgtctcacggtacgcatccggatattctttctccagaatacgattgatcttttttaattcctccatgaggttcttcttattatgaaggcgtcccgccgtatcacacagcagaacatccgcatttctcgccttggctgccgccaccgcatcgtagacgatcgccgccgggtctgcgccctcctgtccgccgatcatatccacaccggcgcggtttgcccactcctgcagctggtctcccgccgctgcgcggaaggtatccgctgccgcaagcacgacctttttcccctggtccttgagctttcccgccagctttccaacggatgtggtcttgcccacgccgttgacaccgatcacgagaaccacggatttctccgtctcaaagcgatatgccgtctcgccgacatccatctgctccttgatgctgttaatcagaagttccttgcactctgccggatctttgatgtgattctccttcactttttccttgagactctcaatgatcgactcagtcgcattgacgccgatgtctcccataatcagaatctcctcgatctcctcatagaaatcatcgtcaatgctggaaaatccactgaaaatggaatctatgccggatacgatattatctctcgtcttgctgaggccctcgaccagacgtccccagaagcctttcttttcctcgcccataatgtactcattcctcctgctatttgtcgagatcgccctcgatcagattcacggataccagggtggatacacccttttcctgcatggtaataccatacagacggtctgccgccgccatcgtgccgcgcctgtgcgtaatcacaatgaactgcgtgctcttcgtcagcttatgcaaatactttgcaaaacgtccgacgttggaatcgtcgagcgccgcctcgatctcgtcgagcagacagaacggggacggctttaagttctggatggcgaacaacagtgaaatcgccgtcagggacttttctccaccggacatctgcatcatattctgcagtttctttcccggtggctgcgcgataatgcggatgccgcactccagaatatcctcgtcctcgaccagttccagcgttccttttccaccgccgaacagctccttgaataccttgtcaaactcggtctggatctccgcgaacttctccaggaactgcttgcgcatgccggtatcgagttcctcaataatgccgaccagcgtcttctccgcctcgaccagatcgtcatgctgtgttttcaaaaatccgtagcgctccgagatctccttataatcctcgatcgcgttgacattgacatcgcccagcttgcggatctcatccttgatggacgcgatcatcttcttcatcgccgcaagatccgtatattcttcgttgcggagctccatcgccgcatgcagggtcagttcatactcctcccacatgtaattgttctggtactcgtgcgcctcctccagcttttcacgctggctgttcagacggaaaatctccttgtccagatcggagatcttcttggaaatgtcttcacgcttctggaaaaatcccttgtattccgaggacatttcttccctgcgcgccgtgtgctccttaagcgcctgctccagctgctcggaattgtcctttgacgccaggatcgtctttttgatctcctcaatatcgtggcgcttcttctccgcatccgccttcgcttccttcgcttccgtgacgaatccctcgcgctcttcctcgtaacgtcttatctcaccgttcacacgctcgagattctgcagaacaaactctaacttctgacgcacaccggcttcctttaactgtacatcggacaccgccttctgggcttcttcctctctgcccgcattctcatccagaatcttctggaatccggcgctctcctcctcgatctgtgcctcccgctcctttgccgactgcagttcctctgcaatcttgtccttgttctccgcaatctcacggagctggctctcaatctcacggttctccatctgtaagcctgcaaacacgttctcgctctcgttcttctgctccatcgcgcgctccacgttcatcttcgcggtattctgcgcaatgtacgcctcctgcaggctcgccttattgctctcgacgtcctccgcgagcaggctctgcgccgtcttgatgtcctcaagacggtttttaagctctgcaatctgtttatccagatcttttacgttcttctcgagttcttcaatctcgcggtttcttgcgagcagattgctgctgttcttaaatgctccacctgtcatggaaccgcccgggcttaaatattctccctccagcgtcacaatatgtaacgagtagcggttctttttcgccagcttgatcgcatagtcgatattctccgtcacgatcactctgccaagcagataagcggtcactccagcatatttttcctccgtcttcacgagggtattggcaagaccgatgactcccggctcctttaaggcatccgtgtttttaaagttgcccttgccgtccacactcgtcagcggcagaaacgtcgcccgtccgtaccggttctgctttaagtaggagatcatctgttttgccgtctcctcgtcctcggtcacgatgttctggatatttccgccaagcgctgtctcaatcgccgtctcgtactttttgtccacctggatcagatcggaaacaacaccaaggattcccgcgttgcggctcttctgctccatgacgcggcggatgctgttgccgtagccgtcatagcgctccgcaatatttttcaaagactccagacgggactgctgcttatggtactgtgcaaccgcgctctccagcttctgattggcttccagggacttgcgcttccactcccggttctgctcatccattccggcagcgtttttcttcagttctgcgatcgacgcgttcaccgcatcgagctccttctgatagctttccagaacggaggtaagatccgcctcctcggtcttgcgcgcaagcagacgctgcgtcagctgcgccttgcggatgttcacctgctccatcatcgtgtcgtagcgctgctgtctcgccttgacggatgccttgcggttcaacagttcgataatctcgttcttgcccttttcaatgccctcggtgcagcgcgcgatctcctcctgaatgttccgcagctgctctgccgccgtctccttttccgtcgccgccgctgcaagctctgtgtcgagttcctgcttttccgcttcgtatgtaccgcgcgactcgatgcgctcctgcttttcccgatcgatcgagtccagacggctctttaaatgctcatcggtcatctccgccgtgtggatctgctcatttaagacattgatctgtccttccagctttcccttggtcacggtggactggctcatctcctcacgaatggatgcaatcttgtcatccatggaagccatgtcctgttccagcttctcgtattcactcttgatattctcgtaagactggctggcttccttcgattcctcgtccgcgatgtgatattttccttctacttccttaagctgcgcctcaatgcgctccacttccagaaggaacatattcacatcatattcttttaattcttcttttttcttcaggtagatgcgggctttctccgcctgacgctccaacggcccgacctggcgctccagctcggctaaaatatcattcacacgaaccagattctcgcgctcattctccagctttttctgtgctgtcgccttgcgctttttatattttacaatgccggccgcctcgtcgaacagctctctgcgctcctccggcttaccgcttaagatgcgctcgatctgtccctgtccgatgatggagtaaccctccttgccgataccggtatcgtaaaaaagctccgtcacatccttgagtctgcacggacttccgttgatcagatactcgctctcgccggagcggtacacacgccgcgccacggtgacttcctcaaaatcaatggcaagctgatgatccgaattgtccatggtaatcgccacataggcataacttaacggcttgcggttctccgtacccgcgaagatgacgtcctgcatgctggcgccgcgaagctgcttggcactctgctctccgagcacccagcgcacagcgtccgcgacattactttttccactgccgttcggtccgacaattcccgtaattccgttatgaaaatcaaatacgatcttgttcgcaaatgatttgaatccctgcacttcaatgctcttaagatacatataaacctctctctttcatccagagcaatgcctgatatgccgcctcctgctccgctgccttcttggtatgtccgcttccctcgccaattgtcgtattcccgatcaccgcctccaccaggaaacgtttgtcgtgatccggtccctcctcgccgatgagttcatagtgaagcggttcctcgtaatgcccctgtaccacttcctgcagaattgtcttgctgtcatagaacagcttcttgtgttcaatatccgtcagaatgaagcggtggataaaagcttttgccggctcaaaaccgccgtccagatagatcgcaccgatcacggcttccagcgcatccgaaagaatcgacttgcgtcctcttccgccggtcaggttctcccccttgcccagatacagatactttccaaggtcaatctccctggtgcacagcgcaagcgtcggctcacagacgatgctcgcgcgcagctttgtcagatcgccctccgggagatctgtatgctccttatagaggaactcactcgacacgacctctaagaccgcgtctcccaaaaactccagcctctcattatccgaaagcttcttcatgtgcttctcatttgcaaaagaactgtgtgtcagtgcctgctgcaacagtctctgctcgttaaactcataaccaatcacttgttccagttctgtcagttttgacatttcattatcctcctcgtctctttcggaggtcttttcttgccctacagcccttgtatagagtaagaaaaagcctcaaaatctctgtgccccgcggcaacgccgccgtacgggttcctcttatcaacaaaagcccttgctttccggacaagggctttatgacgcatcatcaaattgtctcttatgagtttaaagcattcttgatctcttctactgcatctgatacggtcacaatatgttctgcatcttcatttgcaatctcaatgtcaaattcctcttcaatccccataatgatctgaaaaatatcgagggaatctgctccgagatcatctacgaatgtggtctccatcgtaatctcctcttcatccacattcaaaacctctgcaatgatttttttcagcttttcaaattccataacctacattccttcctgttccgcagaacttactatatttttcctgatctttccattgatgtcctcttccttgaacgtcacacactggaaaatagaattcgtaatctcttttgcttttgcacttccgtgcgtcttgaccacgagaccgttcagtcccagaagcggcgcaccgccgtactgtgtcgcatcgaaagtctttaacgtagactttaatgccggcaatgcaagtgctgcaccgattttgctctttaccgtactcatcatgcccttcttgatggcaccgattaacgtaccgctgagtccttcgtacagctttaagatgacatttccaacgaaagcctcgcagacaatcacgtccgcctctccctttggaatctctctcgcctcaatgcttcccacaaaattgatgtcttcacacgccttcagcagaggaaatgtctccttcacgagggcattgcccttctcctcctctgcgccgatattgacaatcgccactctcggcttcttcactctgagaacattctccatataaatggaacccatcttcgcaaactgcaccagatgcgaagctctcgcatccacattcgctccacagtcaatcagaagagagactcccttctccgtcggaatcaaaggtgcaagcggcggtctctcaatgcctttgatacgaccgacaatcacctgtccgccgactaagatcgcaccggaacttcccgctgacacaaatgcgtctgcttccttctgctttaccatattcattccaatgacaatggatgactgcttcttcctgcggattgcattcaccggcggctctgcagtctctatcacctcttctgcatgtaccacctgaatctgatctccggggtacgtatactttgccagttcttcccgaacgacatcctcctgtcctaccaggagcacctgaatatccgaccgtgcgttcacggcatccactgcgcccttgaccggctccgccggtgcgtagtctccgcccatcgcatccaatacgattcttgtcctcacagccccgctgctctgctgcatactccatctcccatctgtcctgccggagtctagttctccacgcctactaaagaatatactataactctttctataaatcaataataaaaaatacgcttatttctaattgtaaaattcctgatttcgttcctgctccgcctccagatcttccgccgacatatacttacggaaaatgcgctccaggataaaattcgccaccaggatgtagactgccggaagcagtatcataagccacggaagcatccacaagccaaaggcgctcgctgccagaagcaccagaagaagcagcgaccacggaagattcgccaccgcaatcagcgccgcgttcttaaacgactgccccagactgttctcaaagcgcgccatgtaggcaaacagatataccgccagcatcacgacaagcacaatcagtaccaggaaaaccacatacagcacgccgctcttttgtccctgcgcagcaaactgatacataatatagcagtccagtcccagaaacagaaccactcctgtcagaatcagcgctgcgagcgccgcctgcttaaagttgctcttaaacgcatgccagtattctttccacagatagcttcttccgtgccggattaccttattgaccgcataatagagcgccgtcgttgccggtcccgccagaaacgatgtcagccagcacagaatccatccgaataccgatgcgctctgccatgccaggaaaaatgtcgttgccatcgggatgcagcagaacacccacagcacgcttaagatcacacagtcaaccaccttactgagtccctgaaaaaacttattgtccaaattaaaaaaatcacccatatgaatccttctttctgtctcctatgtttctcctgttattttctcataacatgacacgatcgcccgaagcgggactccccagtcgcgctcccctccggcatcctgtgaacatccgaatatcatgctgacaagttttccgttttcatcaaaaaccgccgatccggaatccccgtcagtaaccgccaggcgcacttccgtctccttttctccctgtccccacaggaattccgtctctttccgaagaagacttcccgtcagcgtgtggagcacattgccttcctgtccgatgcgcacgattccgaccggcaactctgcattgccaagttcttcccagctcgcaagatcatacgacaccgtctttagcttttcctgcactttctttggaatcgccgtccggtcaaccgccacgacgcccacatcataaacatcgtcggtacccgctttgcttcccgtaacgcaggttccatcataaaaatacacatcccagtcgtcgtactttgctatgacatggcggttcgtacacagatacaccgtatcatccgtcatttccataataaaaccggaacccgcggtatgtcctccctccggcgtcccgtgataaatctgtaccacacacggcagcacctgctccaacaccgcttccatagtgtcttccgcgccgtccgtctccaccccggttccttcactgctctgtaccgcttgttccgttcccgtcccggtctgcccgctgcccggtgccatttgttctgtttccgctccagtctgtccgctgtcttgcggcatctgttccgtgctctgcggtatctgctccgttgtcctgctctcttccccggcagcatcctgtgtctgttctgcacagcctcccagtcccagtaaaagccctataccccaaagcgtcagcactgccttcatcctgcatctatgcactctacgcatttcttcttcaatccgtttccaccagtttttcccttgtaccatattcatttattatagctttccataacgccccggtcaaggaacaaaaggcgcagcacaaagtgttttcctataaagaaaaaacagccgcgtctccgcggctgtttttccctaaagaatcattttagtaattgtactcggatgcatactcaccatacattgtggtctcgtctgcattgtagttgttgatgtcaacaacgcttccgttctcaatcttaaatacattccagatggtacctgcctgattcagaggtacattgtactctttcacaagaacagatccctggtatacctttacgtttgcgccagactcagacatctttgtggatgtagcgtcataacgatctgtaaagtcttttacagagtaatagtaagtagcatctgtacgtgcatttacgatggttaccgtctccggtccgtaggagcttacatcatccacatccagggatgcgatcacgttaccgtccgtatctctctctaccttattgtagtaagcgatgtggaatacagagttggcatcatctaatccaaccaggtgggaatcgagatctctcggtgtctcaccccaggtaagaacgattctgaattctgtgctggtaacctcgcttgtgctggtcgggcttaatacgccttcgcatgcaccaattgcattggagcttgctacgtttacaaaagtggatacgaatccgtctcttgcgaactcaagggtgtagtaacctctctcaagagagaagctgtaattgccgtctgcatctgtggtggtcgtagcgatcacatcaccggactgattgttccagttcgcacgtacatttacggttacaccttcaataccaaggcctgtggttgcgtcctttgcaacacctgcaacggtatttgcgccgctgatatcagagcttaacagctggaatgtcggcagtgtgaagcttccgttgtcagcgttgatgctgatggagttcagtgtcaaggttaagtaaccaacagctgctgcctgaacggaatatacacccggtacaaaattcgggatttcataataaccgtttgcatctgtggtaatctcatagtagccgtcacctgccgtcagaccatttcctgtctcttcagcagcttctgttgcttcggtagattcggtcgcctcggttgcctcagtagattccgtcgcctcggtagactcggctgccgcagtagattccgtcatctctgttaccgcctgcgtagtctctgctgcctcagcaacagactcagttgtctccgttgccacctgcgtgttctctgttgctacttctgtctgagcctctacttcctcagctgttgcattgaaacttgtgagcttaaatacaactgttgctcccgcaaccggtgctcctgtctccggattgaccaaacggccagccgttgtgagcggtgctgtgttggtagaagtattgttgccgttgtcagcacttcctgtattagaagatccgctgtaagaagactctgtgtagctggatgttgctgctacagctgcgctcgcatctcttccctctgctctaccaaactttaagtaatgcttgtaaagcgcaagcacatcgtaaccgaatgctgcctttaagtccggatatctgtctgcgtatgctcttgcatcaaaggtgccgaaagaatttcttccctcattgaagccgtatttgatgtagtggttcacatatgcatcccagttatcgccgaatgccgcatccagatccgggtacgctgctctgtatttctgtacgtcgataagtgcggtgcttgttctgccctctttcttaccgaatgttttataatgcttgtacaatgctgtctgattcgtgccgaatgtatccttgagatcactgtaggtctcagaataatactgtgcatcaaatacatctctcaatgttgccgcagatacggttgccgtacctccgaatgtcaacacacctgcaagaacaagtgctgtaattctgcgagccattccgcttctctttgcggagcgcttcgtttctgtctcgttcaattccttcttcactaacatttcctccttgttgttgtgacgttacatgtatcattgtaaatatctggaacaaaaaagcaaccactttttaacaatttgttaacactttttttcaataccagaacagagtatacggagtttccatgagaaccaagtgtgcgcttgccgcacacttgcgcgccctcgcggtatgcaaagcattatttacctcaccgcgaggtgtgcatccccgcggagcgtttttgtgtaataggaacggagtttcctattacacaaaaaagagacccggcagatccggatctcctctgtaccgctggaattagtcctgcggaatgatttcttttttgttgtaagagccacagttcttgcatactctgtgaggcatcatcagctctccacacttgctgcattttactaatgcaggagcagtcattttccagtttgctcttcttttatctcttcttcctttggaagatttattcttcggacaaatagacatttacttacacctccttaaatttgttaaagacatcttggattgctgccattcttggatccagttctgttctctggcaatcgcagttccccttattcaggttcattccgcacaccttgcaaattcctttgcaatcttctctgcacagaactttcatcggccagttcaccaaaatctctccatagataagcttatctatatccagatttaatccaatcaggtagtctgtttcttccatttcatcatccacaacttccgttccgtccatgcggagcttcttgtcgatgacaatgtggatgtccgtcggaacttccgtaagacatctgctgcacgggattgatactgtaagatctgtctccccgctcaaaagcagttcactgccctcgcggttcgcaatcctaagatcaaacggcgcgctcgctgtgatcgggaactcaccaagcctcgatacaaacgtatcctgctcgatatgaaccttctcggtaacttctctgttctcacaagatacaatctctgaaatatcaatctgcatggtttactccttcgcctcatacatatgaggttttcacacctaaccaattatacataggcgtccctggtttgtcaatcacttttttgcttttttgtcaaggaatttcccttgacagcaaaaactattttacaagcgctacagtctctcttgcaatcgcaagctcctcgttggtcgggatcacgcatacctttaccttggaatccgcggtagagatgatcgcctcgtcgccgtgggttgcatcgttcactgcctgatttaccgtcacgccgagataaccgagataagacattaccttctcacgaaccaggttcacgttctcaccgatacccgcggtaaatgcgatggcatctacaccgttcattgctgcgacataggagccgatgtattttgccacacgatagctgaatacctcgatcgcattggttgcaagctcgttgcctgcctcgtgtcctgcctgcaggtcacggaagtcagaggagagaccggacattccctgtacgccggacttcttatttaatacattcatgataccttcgatatcaagattctctttctttgcgatgaattccatgatcgccggatcaatatcaccggaacgtgttcccatgacaagtccctcaagcggtgtcagacccatggaggtatctacgcactcgccgtttaatacggcactgatggatgcgccgttgccgagatgtgccacgatgatcttggaatttttaagatccataccaaggaactctgcggtacgcttagatacaaagctgtggcttgttccgtggaaaccgtatcttctgaccttgtatttctcataatactcatgaggcagaccatagagatatgctttcttcggcattgtctgatggaaagcggtatcgaatacgccaaccatcggtacgttcggcatcagctccttgcaggcatcgataccgatcaggtttgccgggttgtgaagcggtgcaagatcgttgcactcctcgattgtctttaatacttccggtgtcagaagtgtagatgctgcgaacttctctccaccgtgtacgacacgatgtccgactgcgtcgatctcggaaaggcttgcgattgcaccggtcttcggattcaccagtgcatcaagaaccatctggattgcctgcttgtgcgtcggcattgcagcttctgtaatctctttgtccagtccggtcttctggtataccagtcttccgtcgattccgattctctcacagagaccttttgccagtaccgcttcgctctcagaatcgatgagctgatattttaatgaagagcttccacagttgataactaatacgttcataatatcctccttgttttgcaaagcaaaatccgagtcctctggcgaggagaggatctgcctccttgttttgcgaaggtctgtctctcacagaccgcatataattttagtatacgcttgtcacgcccacgaaacaagccagtaattgccagttttcttgtacaaaatgaaaaacagcctgacaaaaatttaacagtcacattccgctttcgtgttcatcaacccgcaccgcgtgcaccacaaaccgcagcccgtcgcccgagcaggtagacagtgtcagaaccttgtcatcctttcccaccgcaacgcccgtatccttgtaggaggacttaagcagttctgtgaggaacccatcaaaagtctcatccggcagatatccggtcgtatagacatccgaatcttccgggacatcactgtacgcaaaaatctgatagcggtaggctgcatcctccgtaaacacggtaaaatacgcatttttttcataaaagccgtcgtttttatattgtttcagcgaaccgaacatgcttccgtttttcatgttgtgtccgtacagaatcgtgtggcagtcgttaaaatcggggacgttgttcccctccataaaaatgcagccggatttcgacgcatttccatagagatcggtatgcaggtaggtctcgtcatccccggaatacagaatgggataattgatctgctctatattgtcaaaataaatccaaccgatcacatccggatttgcttcctttagcgtctcaaaatccacctgcaatgcctcataccatgccggcagttcctctccctcctcctgatcatccgaagctgcccccggctgtccggccacataggcatcgcgcagcgcctcgtaggtatcatcctcccgcttgtacgcgagcagcgccgggatcagttcataaagggctgccgcaatcagcaaaagccctgccgcaatcagaagaatcgatccaatgtttctgtttctcttcacgtgaaatgctcctttttctttttttctatttcacagtatgctatgatagctacagtttttatcacattgcagtacgggaggatccgccatgaacgtcattggcattatcgcagaatacaacccattccacaacgggcacgcctatcagatcgcgcatgtcagaaaaaatcttcacgccgactatatcgttgtcgccgcaagcggcgactatgtacagcgcggagagcccgcccttctggacaaatacacccgagcccgcatggcgctctcctcgggtgcggatctcgtgctcgagcttcccgtactctggtctaccgcttccgcggagcttttcgccgatgcaggaatctccctctttgagaaaacgggctgcgtaaacggcatctgttttggcgctgagagcggcgaccttgccctccttcgccgcattgcggacgttctcgcggatgaaccggcggatttaaaggcttccctgaagcacaacctaaaatccggtaatacatttccaaaggcaagggaagctgccctgctctcttattttgccgacgccgccgatcaggatggtgccctgcccgtatccacagagacgctctcctccctgctcgcctccccgaacaacatactggctctggaatacttaaaatcgctgcgccgccgcgcgtcttcgatcacgccctatctgctaaagcgggaaggcgccgcataccacgaaacatccatccgctccggcgcatccgaagtcccggcatccgcgtccgcgatccggcatacactcttcgccggtggcgccggagcatccgaagattctgccgacgggattctgcatcatgccatgccgcaggaggcactgtccatcctgcaggactaccgggcagattttccgctgctgtgcgccaatgacttttccagcattctgggttatctgctgttaagcagttctgcctcacaactcgcccggaccgccgattcctccccggaatttgccaaccgcatgcgaaaccagcttccttattatacctctttttcctccttcgcgtcacggttaaaaagcaaagaaatgacgctcacgcgcatcaaccgcattttgctgcactccatccttggcattacttcttccgattacgcatgcggcaatgccctggataaaattccctatctacgcattctcggctttcggaaaagctccgctcccctgcttgccgcactaaaagcctctgctgcagttccgcttatcacacggccgtcgcaggcgccaaagcttttgtcaccggatgccatgcaggtgtttgagcacgatgtatttgccgggaatctctatctgcagatgcgcaatcaaaaaggcggcacgcctctgcgcgccgcccgcatgcaggagcatgacgtcccccccgcctccgaatatcagcggcagatcgtcatcctgccatagtgcagtctcatttttttgtcttttttccaaatacggcggcggacagcagtgctaccagcgggaccgtacacacgatacccacgcttcccgcaatgcactggataatctcgatcgccacaaagtccgtattcatcagctgctgaaagctgacgtcataggagtagatcatcaacatcatgttcagcgatgtcccggcgactgccaggattagcgtgttcgccatggttcccatcgcgtctcttccgatattcatcccggaggcaaacagcttcgccatgccaagcgaccggtccacctgatggatctccgccaccgcggaacagatactcatcgccacatccatcaccgctcccatacacgaaatcagaataccgcacaaaaacagatcccggatcttcagttccgtggtgcttgtgatcagaagcagcgtctccgcctcatccatctggtaggtcgtaatcgacatggcattctgcgcgatcagtgcaaacaccgctcccgcgagcacacccagcatgcttccgattgccgccacaaccgtcttggtcgagatgccgtctatcaggaagaagctgacaaaattgcagaccagaatcagcagaatcgtgaccgccaacggcgagtagcccttcagcgcaagcggcagtaaaatccagaggatacataccacggtaaacgccagccccgccacagattttgcgccctttttccctccgatcaatacgagaagcagcacaaacgccacgatgcagccgatcatctgcggaacgcggtaataattgtagaccgatacctgatattcgtcctcccccgtcgtgtcgatgcggatggagactttatccccctccgccaccctgacgttatacagggagctgaaataattttccacaatggccgtatcgcccttgtagcgtccggtaaggatctcgacctccagcgtcatacttccccgccagattccgtccatctcctcatccaccgtcttgtgatcttccacaacccgcaggactcttccaacctcatagtccgttcccgccatgttgctgctcctataaaccggtctgtctttattcgcgaaccagatcagtccgtaaaaagcaacggcagccagtgccagaagcaccaggctgcgtattttgctctttttgaaattcatgttttaaccacccttatttcaaaaatatccttttcttgcgtgctgccgctgcaagcagaaccatacctgcaagaagcatcatcactgctgccgcaagcggggtgtcgtctcccgtctgcactgcaggcatctgatccagcaccaccacataatcggatgcatgtacaaaggtaagctccacatttccgtttgcatctacttttccggaagatgccagttccagccgtccctttgcttcattgtaataatataactttgcatacatgcccgcatactgtgttcccaccggcagcgtcatcactgcggtaaaaccgaatgcgccgtcatgatttaagctgatctggaaatagtctcttcctgccgcggtctgtcttgcaagcgcatccggcacggcatggctgttgatcgtcacgccgaagtcaatgtctgaaatcgtatccgatgtcacacttcttccgtcaatcgtccacacgattccgtttgccagcctaaataccagacgtacatcccttccgcgcactgccgcaataacatctcccggcacagaaacaccgtctgcaagaagaaccgtcacggtgctgcctgcggatgctgccccaattctgtttctgaccggatcccagtcattctgtgaagcaaccgtcaccgcgtctgtcatctgtccgtccgatacggtcacgctgccgcttacacttccaccgtttccagttccgtccgtgctgtcatttccgctgtctgacgaatctgttcccggcgtctctgtatccggtgtctcggtattgcccggcgtctccgtgtcatccggcgtctccccggacgtcacttccacgatctcatcgcagtttcttacacgcagacagatcactgcctcgtccgaggttccctccggatgtgcatagaccacgccgaccgccgacacgcgttttcctgtcgacacaaccgatgcgagttcattctttcctgtcgttgccgataagatatatccgtcgatgaaaatattggcattgacgccgctgccatcatccagccagaactgtgatacgccggtgcccgccgcatcatagagtacatccgttaccgttccctccacctgtaccagcttaccgccggacttttcatagtccatggcgtcttttgccgacagtttctccggtgcaatcaccttcggctcctcgtccagaatccggctgcttatcaccttaagctctttatcgccctggtaggcgtccacatatccggtaatctccaccttggttccgatggcaagtccgctctccgcatacgggaaaatatcaattcccgcggtgtcgtcctggatatagatcgtatcaaagaaggtgttgccctccacggctgttcctgcggtcacatagccttccacgcggtagacatcgcccgccgtaccgttcttacgcacttccgcaatcgtagacagcggaagctccactttcacttcatctaaaatattttctgcaatcgtgcggtttaagtatggcagatcccagatattgtccagctccgccttcacctcaaagtcggaaataaatacggttcccgcaacaaatacatttgcaccgcttcccagtgtctcatgtgcgagtgctaccatattgcctttttccacatacgtcgggcttccggtaactctgtttcccgcatcatccttgcagtcgatcgaatacgttgtatcatatccgctcacaagcgcttccgcacgtccggctgtcaccgcatccgcatccagcgccacggtacatccgctgtacgcactgtactcctgctcctcgcttgcgccgcgcagatatctggaatccttgttgtaggttcctttcagatataagcggtacggctgtccgccgttgttcgtctcgtcgtacgcctcgtcgctgtttaatctggtcgatgccccgatcgcagccaaaagcttattcatctctgtcgctgtctgtcccgaagtagaatcctgataatcggcaataccgcaggtaatcagcgtaccgccattgtcggtatagtcttttaccatctggataaagctgtcttcaaaatgcgacacggtgtaatctccggcatttgctgtcccggatttcttcgccggtgccgagatcacaagcaacgcacagtttgcaagcatctccggcgtaatctcgtctgtgaccacttccaccttgacgttctttgctcccgcaatcgccgtaaagtttccgacgttaccgccatagtaaccggtcacataatcgttgtaatgggttccgtcgatgataacctttgtcaccatctccgttgtcgcgtagcttaattttaagacgctcttgtataccttctgcacgccgttcatcgtcgcatgcacaactgctgtcatctccatgctgccgacgccgtcataggtatagtcaaagctgtagcttcccgtgctcatggatgcgacgcttcccaatcctgctgcggcaagatccgcctcatgtacggtctctccgcccacctcaaacgttatggaatcaatcgcgagctcgctgttttcattattatagagtccaaggttcaccgtcagcggctctccccttaccggaagcacctcgtccgtggaaaagctgtcaattcctgccgcctccacagagcctacccataccggtgccgtcacggcgatatcactgtccgcttccacaaccttgatatagtaataggaataatcatttttcacatcaaaggtgaccgtctcctcgtttccggaaacatttttctcggcaagcaccagtcctccgtttgtgatgacctgtactttaccgatggacgcatccgtcggatcacttaagtcaacggaaagatgtacggtatctccggtcgctccatcctctaaaatagaacccatgatgtagccgtccagcgtgtagtagatgctgaggtcgttatcctctgtcgcatacacgcggtaattgcgcatggcatcgtaaatattttcctgcgtcaggctgtccacaaggacaacggaacgcgccgtgtttgcatcgccccacaagcctttatggttatcctggttgttggtcggagcaagatgccagcccttgtccagcgcgcgctggtaatactcataggacgggaagtaacccgaacttccgatcgcaccctcgccgtttccgacctcgatcgtcgtaatcagcttgtcgatctcctcgtcatagtatgcgaaatcgctgaaatcaccgaacgtcgttcccgggtggttaaactggctgatggaatccggctgtgtctttaaggtcgcgtaataattctgcaatgccgtgctgtaagtcttgtactcattctgggtacggctctggaagccttcggtgttaaacgtattgatgtgtccaagtccgttcgaccaggtcatctcaaacccatagatgcacacaaatccgcttgtcgtatactgcgtggcaagcgcatggccttccttccattcctcactcatcgagccgtccgagatggacgcgctgtccgcattgtcaaacgagttggagtgatctgtcaccgcaacaaaatccagattgtcaacgttcgttgcatgctggtatgcatcctcacagcttcccgcaccgtccgaataggaagtgtgggaatgtaactgtccaaagtaaatctgatatttttcgtttgtgcgctcggtaaaggaaagtgtgagcacactgctgtccaggtaaccgtctttgacggctttcaccttataggtaaccggaagctctgtcaggacgagcttttcggtataatcctgccaggttgcaccgtcgtccgcggaatactgaatcgtcgcaccctcggtctcacaggtgaggttcaccgcagtatttttcaccacgctgccgccgttcggcgttgcttttaccgttgccacctgtgcctgctgataagagaatgtacggcggatgctgtccttatagccgtccttcgtcgcataggcagtcacaactgccggaaggtctgcaagctttggcttcgccgacgcatcatagatctgctccgcgccgccgtttacactgtaatggattgttacaccctccgtggcgcttgtcagtgtcaattcactgcccacagctaccacgccgctctgcggttctgctgccacatatccgcagagatctgaggcgatcagcggattgcctgtcactgtcaccgtgtccatacggatcactccgcccgctgccggtgccttatctcccttggcagaaaggctgcccgggaccatgcggatgtagagacggtctgcattcgccgcctcgttcggaatatcaaacgtgaacgaaatatagtttgccggcgcaaggcttgtctttgccacaccgtcggtaattttctccgcggcgctcacttcctgcggctcaccgcccacgtatttcgtgtacttataagcataggttcctgtggaaaggtttttaaaatccacaccgtccgtagaatactgcatctggaaggaacctgctccggtgttgcttgcgcgaaaccggaaggaaagtaccatgttagcatagcccgttgtcggcatcacaaactgcgcataatcattgcttccgcttccaatgccctttcctcccatataatgggaagtcgaaccggtggaagtgcttgtggcctcggtatacggtgccactgccgctccatttaccaccgccgaatatatagcatccgcatccagcagatcatttgcattgagagaatctcctgcaattccggtatctgccgtcacacctgccgtcttgtaatctgccgttccggaccactgtgccacgttttccgtgacggactcgtccgcacggatatgaaccgacggtgttccctcatcgatcagataaaaatagaatacatacgccgcatccgaagatgatttgtagctgtatgtcgtaaatccgttataatattccagatactgttctgtggtattattatattttgcgttggcattgatcacatagtatccgccgttctcatttgccttctgcagcttccagagactgtaatctcccgccgcgtccgcaaacgtcacggagctgcccgttgcgccggatgtcagatatttatcaccgctcacaaaggtataatagccgttttcatccacggaaaccgtaagttccgccgtatcctccggaatggcaagcgcgccgtccgctgcagttgccgacacaccctttaacttcttgccgcttgcggtctgggagagcacgcttccggttccgttgttctcgtaatagagggcgacaatatttccgtccgaaagtgtggtggcaagtgctgcctccttgctctttgcaccctgttttaccgtgtaggcaaattctgccgtctcactcgtctcataaccttcgagttcggctgtcgcgtagatcgtcacatcttcctcgatcacaagcgcttcggtgtatgtcttgtctgcactgtccagatcggtatggtatgtgatcgttgctccctccgtcgcacaggagagctccaccttcgtaccggcttccacatctcccggctccacggaagctttgactttggaacagaccgttccgtctgtcgccgcctcgccctgtgttccggtgactacaatgttgttgatgctggtcacaccgttcgtgccgactgtactctggttcacactcgtgtttccctgcatcgtcacacgcagtgtaaacgcttttccggacagcgccgccgggagtgccgtctgctgatacaccgaggctagactcgtgcttaaggtcacatccgttccgctgatctttgtccagctcgctccgtcaatggaatattccagtgcaaagttggcaggaccggttccgctggagcgcatgtctgcagaaaattttaaatctgtgtaatctgcagcattgaccgcaaccgtaaagcccgctccctcgctccatccttttgctgcgattcccttgctgaatccgctgtaagatgctccgcttacgtcaagcgttccgctgcccgctgtcgctgctgccggaagtcccgcttccggtgccgccgtataactgaaggccgcaaggctttctgcacccgccgtctggatgagcgccgtattctggtctgccccagactccgtattctgtaccgcatccgcctgcgctgcggcatctgtctgcgccgcgtccgtctgtccggcggcatctgcctgcgccgcatccgtctgaccggcgttctctgtctgcgccgcactttcctgatttatcgtgttctgtgcaccttccgtgctgtctgctccgctctccgctgccggcgacggattttccgccgcttcgcttccggcagtcgtctgcacctctgctgcatacgccgtaacaaaagacgcatctcctgctaccgtcgaaaacaccatgcagaatgcgaagaaaagcgcacatatgtttttccaatgattctttttcttcattttcacaactgttcctctcatttttttgtatgtaaaataaactgtaacgtttatgaatcttctcttctacccttgtccggtaaagccttgtaaaaaaagtgtaaaaaagaatctcgcttgcgagattctccgcgcgcgagcggttcgcaaagcgatattttccctaccgcgagccgcgcatcctcgcggagcgttttttatttcataggaaggttctactttcacacatgaatgtatcacggtatttcctatgaaataaaaaagggctgatgcaccctgcatacatcagccctctttggctcttcctagtgatggaacaggcggatgcccgtaaatgccatcgccatatgatatttattgcaagtctcaatcacatgatcgtcgcggatggaaccgcccggctgtgccacatacgcaacgccgcttctgtgtgcgcgctcgatgttgtcgccaaacgggaagaacgcatccgatccaagagatacctctgtgttcttatccagccatgcccgcttctcctctgcggtaaacacaggcggcttttctgtaaaaatattctgccatgcgccttctgccagcacatccatgtaatcctcgccaatatagaggtcaatggcgttgtcccggtctgcacgtttgatgcccggcttaaacggaagggaaagtacctgcggcgactgacgcagccaccagttgtccgccttggaaccggcaagtctcgtgcagtggattctggactgctgccccgctccgataccgatcgcctgaccgcccttgacatagcacacggaattggactgcgtgtattttaaagtgatcatcgcaatggcaagatctctcttcgccgcctccggaatctccttgttctccgtcacaacattgtcgaagaaatgttcatcgatcaccagctcatttcttccctgctcaaatgtgattccgaacacttccttgtgctcgatcggtgccggcacatagtccggatcgatctcgatgacattgtaattgccgtttttcttcgcctttaagatctcaagcgcctcatcggtgtaacccggggcaatgacgccgtccgatacctcccgcttgatgacaagcgctgtctccttgtcgcagacatccgaaagagagataaaatcaccgaacgaggacatgcggtctgcaccgcgcgcacgaatataggcatttgcaagcggtgtaaactccacatccatgtcatccacccagtagatcttgcgctccacctcggaaagcggaagtccgactgccgcgcccgccggcgacacatgcttaaacgaggtcgctgccggaagaccggttgccttttttaactcggacacgagctgccagccgttgaatgcatccaggaaattgatataacccggtctgccgcaaagcaccttgattggcagttcgccgttctccatatagattctggacggcttctggttcgggttgcagccatattttaattctaattctttcatgatcctattctcctcacacgttcttgttgatgattctcgtctcgtattttccggtctcaatctcaatataacgcacaaacaaagatactttattgtctgcgtttaagttctcccagaccgtgttcgtgaaggtgtcgatgtctccctcgatgccgacaagcttcggctctccctcaaaactcggcagcggattgccgtctcccatgtatgtatggataaaatgtccctcgccggccaccggattctggtatgcaaacgtatagcggttgcaggcttccggattgccgttgttgctttttaaaatggacatcgcgtaattgtaggtattgttctcgatgtgcatgataccggaaatccgcggtgtatagttcggtgcgtccggctcaaactctctggtgcgcagcgcctgctcgaacgtctgctgcttgtccatcagttcatagatcgtatcggtctgatcgccgtttgtcacgatcgtcttgttgccaagcacgcggaccggtgcataaatgatgaggctcggatctgtcagcttggacggatcaaatgcctgtgtgcggattccttcaccatcctccacaaagaccctgttgcggctgttctcgcttcttcccatgataaagtaagcggttaccgcatattttccatccccggatctgccaatcacaattcctcttcccggatatgtattggacgaaagttccttcgcaagtgacatcatcttcatgattttcctccttcacatcacacattgctgcattgattgccttcttccatcttatcatgcggattttctttttacaaggaatgcgctgtcattagtatcatgaatttatttactgaattctattagttttacttatctatatcgcgaagcgcctgcatcagaagcccggcgcggttcttccacctgtgccgcttttctgccatccgatatccccgctccgccaactctgccatccgcaccggatcctcaagcaggcttaccacctgatccggaagctgttgtaacgccctcagggagtaaaagcagatattttctccgtcccggcactcttcccgcagataccggctgtcgtccgtgagtgccgccgtcccctgcagcatcgccgtaaagacgcggtcatgtgctccgtctttgaaccagggcatcacgtttaacgcgatcctggcgtcacgcatcgcctgcacacacgccgccgagttcacttttccgccactcgtccgcacgttctgcggctttttgcagtgaattttctcccagtctgctccaaatacccgcactatgataccggcatccgcgagcgtctgcacaactttttcccggaaatagctgcggataaacagatcaatccagatcatcccggacatcgccgcgcaaagctgctcttccggcactgccccaagctcgttgcggatgtgccgctccataaccgcatctacagactgcgcgggatccgcgatcagatcctccgtgatccgccggtaaaagatccgataatcgtcatccagcgcctttactttttcctcgagcatctccatcgacacatagttggccgcaaatacaaggtcaaaggttctctgcccatacagtacaggctctggcacatcctcgcagtgcgttctgtgtattccgtgttctccgtctttctgtgaaacaaaaagttcattgcccgccagcggcaggaactccaccttcacccccgggtaaaaccgcctcacatagccgacgtgctctctgtccacacagaatacccgcatccgctccccggcttccttcaggcagctgtgatagtagagcggatgatccaccaaaatattcaaaatcggaagattctcctcctgccagatactgcgtccgctctccgtctgaaacacagactcgccgcggagcccgatgaaattaaaggtgacaagtgccgtctcttcccgctccagaaaatgcagcatctcatccatcgactcatacatccgctcatagtcgataaagcaggtctcgtatccgttcctctccagttccagtgcaatctgttcggaaaaatatcccagcgtctccaccgcattttttatgaaaatgatttttctgatctcttccattctgtgcttcctctgtccggataaaggaaaaacaacctccctgaatcatcctttcggattctgtctgatcagagaaggttgttttctatcacttattttccatgactcatgttcgttatattttaattcttgaagctgtggatcggcgccgggattctgccgccgcggttgatgaacgcgtcacaggagaactggttcaccggcatgatcggcgcatagccaaacagtccgccaaattctaccgtatcgcccaccccttttccgataaccggaatcaggcgcgccgcagtcgtcttctggttgaccatgccaagcgccatctcatcggcaatcataccggagatggtcgtcgccttggtgtctcccggaatcgcaatcatatcgagtcccacggaacatacgcaggtcatcgcctcaagcttctcaagtgtgatcgctcctgcctgtaccgcatcgatcatgccctgatcctcgctgaccggaataaaagcgccacttaatccgccgacataggaggaagccatcacgccgccctttttcacctgatcgttcagcatggcgagcgccgcagtcgttcccggtgctcccgcatactcaagtccgatctcgcagagaatgtccgccacggaatcgccgatcgccggtgtcggcgccagagacagatccacgataccaaacgggatattaagaagtctggatgcctcctgtgccaccagctgtccgactctcgtcaccttaaacgccgtcttcttaatggtctcacagagcacctcgaagttctcgccgcgcactttttccagagcagtcttcaccactcccggtccgctgacaccgacgttgatgatcgcatccgcctccgtcacaccgtggaacgcgcctgccataaacgggttgtcatccggtgcgttgcaaaatacaacaagcttcatgcagtccgcagaatcgcggtcctttgactgctccgcaagctctaagagaatctctcccatcagcttgactgcatccatattgatgccggtcttcgtggatgcaaggttcaccgaactgcagacacgctctgtccggcagagtgccatcggaatcgagtgaatcagcatctcatccgccttcgtcatacccttcgacaccagcgccgaatagcctccgatcaagttcgccccaaccgtcttggctgcgcggtccagcgtgtccgcaatcgtcgcaaaatcctccggcgtcttgcaggctgcaccgcccaccagtgcaattggtgtcacggagatacgcttattgacaatcggtatcccgtactcgttctcaatcttctctccgactgccgccagatccttcgccacggtcgtgatccggttgtagatattctcattgagcttttttaaatcagaatcaatacactccaaaagactgataccaatcgtgatggtacggacatcgagattctcctgctccaccatcttgttggtctcatttacttcccatatgttaatcattccgtctatccctttctgtggacattatgtccatcggtcgatcttcctgcacattttcctagattctgtgcattttttcaaaaatctcttccttctgacatttgatggacacaccgatctgctcccctaccgcatccagatccttctggcagtccccgaaagatctcgatgactgactcatgtccacaatcatcatcatgttaaaaaatccggacacgatcgtctgcgaaatatccagaacattgatatgattctccgaaagataggtacatacctttgcgataataccgacggtatcttttccaacgactgttatgattactttgtctactgtattctccatgccaatctcattcctcctgcttccacgttatcactttatcgtattaacactgattataatacacagggcttttataagtcaatgcttttagattgcttttgtgccagggcagcatcatcattctcttattcacccggtagacgcgcacaccgtccgtcagccggatcacaagctgatcgtgcgtcacccgccggaaaaactgcacgctctgaattctctcccccgggaaaaacaaaaacccatacgggtcgagtctgccggtgagatcattcaccacgatcacagaaatgcccgtcctgccgaaatgaatgacaaaatgctgcacctcaagcatcgtcgccatcatcgtccgcataaaggaatactttggcagaatcaccgcatagattgatgcatggtcggtgtaaggaatattcctggcgtatagataattctgaatatcggattctttgatcatcttgttcgtactacctcaattccggcgcctgcctccaaaagagctcttcgcctgtttcttttatgatatccgtgtctgccggcatatgcaatttcttttctcccaccttagaaccgcaccagctcggacggctcgtctctctttgccacatacatcgggaaatcatctcctttatacggattatctcccatcgtcacttccagccgcaccgtctcgtacgcaagttccgcgtagttattttccttggacagatgtcctaaaaagaccgtgccgaaatgatcgtgcagcacctccccgagcagccgcccggaaagctcgttggacaggtgtcccttttctccgagaatacgctgttttaacggatacggatagcttccgacctgcagcatatgtacatcatgattcgcctcgagaagaagcacgtcaagccccttcaacttctccacaatatggtcgtcataaattcccagatccgtcatgaccgccatggattttccgggctgcttcatcttatacgccaccggctcagccgcgtcatgcgatatggcaatcggctcgatcgtcatatctccgatcgtaaaatcctctcccgcatgaatctcatgaaacagggcgggatcgatcattccgacggatttggtgtgcagtatcgcatcgatcgtccccggagtcgcatacatcggcagaccgtaacgtctcgcgaggacgccaagtcccgcgatatgatccacatgctcatgtgtaatcagaattccctgcatctcttccgttttcagatcaatcgaattcagaccggattcaatccgctttccgctgattccggcatccaccaaaacatggcattcgtctgttcccacgcagatacagttgccactgctgccgcttgctatactgcataattccattttatttcttccactctctatctgttaatttcctgccagcgaagctcgatctgatctccctcggagagcactgccgaatactgtgcctgctgtccgttcagttttgtgatgatcgctcttcccgcagatgccgttaaatcaaaatcgtaaaaatcaaaaatatctacaaagatatagttcttctttccggtcaggcgtaccggctgctgattgataaatacaaccagttccagatccgtcttctgcgaagcctgctgcgcttccccttcggacggctgctctgcgccgctctctgctcctgcggcgtctgcctctgatgacggtgcctgtggcattccatgctccgcttcctctgaatctgtaccgttctgtgcctcgttctcggcggcatcctctgcctccgccgtctcagccagggtctcatccgctgtctgctccgtcccgccagccgcagccgtcacaggctgctccgcgatcggaagttctgccggatccaccgccgctgctccaaaggaaagcaccacccagtccacggaaaagttctcgtacacaagactctccatggttgccacgcggttattcacaagaatctcatgatccatatccacttccacatccataaatgccgccagctgctccacggtatagaagcttctcgtctcaaccgcatcgccctctttgatctcataggacggcagttccagacttccgttgacttccaggcacttcggacaacgcacaatcctgccgttgacgatcaccttcatatccgaagaggaatactcatccagctgctctaaggtacaaaccgccgcttcaccctgtgtcgacgcttcgatcacgatgtcgctgttcggctccaacggggtgttgatgttgaccagacggtcattcatatagatctcggcggactctcccagttcacctctgacaatccgcggtgtgccgttcacggtaaaattaagttccttaccgcgcttcgggaacagttcctcattcgggaaaccggcctgcagagccgcatccacgatcgtaagcttattgttgtcatacagcttgatccgctccccgttaaagcgcaccatgataaagctgtttctctgatcataataatttaggcagataccaatcggcgtgacgagcagcgggtccttctggatctctgtctgaaggaacgtcacttcctgcagcacttcctcaccgcgcagcgccacacgctctgccggcagatccagctttttggcaagcatctccgtgtagccgtggatcttaccgccaccgccgacgataaacgccgcactgacgctcttgtctccgttcagctccttgatcttcgccgctacctcggtcgtcattttatccaccaccgactccgtcagcttccacacatccttcgatggaatcgtgtgctcaatcatcatgatgtccttataagtcacctgatcttccatgccgctcgagagcttaatctgctccgccgtgttgaaatccaccagataactctgcacgatcagctcggtgatctcatcccccgcaagaggaatcataccgtatgcgatgatgcttccgtctctcgtcacggaaatatcggatgttcccgcaccgatatccacgagcgcaatattcaggagtctgtaattctccggaatcgccacattgatcgccgcaataggctccaacgtcatgtttgccacggtcagtcccgccatgccaactgctgcatacagaccgtccacaacatcctccggcaggaacgtcacgatgatgtcctcgctgatcctctctgccttatgggattccagactggagaacggttcatcatttaagaaatacttcatgacggaataacccacacagtaaaacttgtagcgggtatcgttcatttcctttaaaatggactgtgccttttcaattccaagcagatccagtgtatgaatatcctcgccggtaacgaccgtctcctccgggaaatcgtagctgatgttggtcgtcaccgtctttaacacacggcctgcggctgcaatacacacttcggtcagttcctgcccgatctgtgactccagctcctccttcaccttggcaatggtatgccccacgcgtccgatatcgtgaatctgaccgtccagcatggcacgcgtctcatgctcaagcatatactgtgccaccacgacaaattcattctccgtcttatagcctacggttcccaccacatttctcgttccaatatcaagaccaaacaccagcggctggtcgaatacgctcgtatcgctcatctgcagtatctcctaatctctatttcttctccgaaagcgccctgtcaatctgcgcaaaagcctccgccacactgccgttgttgtcaatcacaaccctgcagtgctcccggtagacttcctccgtcaactggcttgcaaaaatccggtctaccttttccgtggaatatcctctgcttgccatcaggcgttctctgcgaatatcctctctggtataaatataccagagttcgtcacaaatttcatcataatgttcttcaatcagaagcgctgcctccagcaccagaagttttcgttttccaccctgcttttctctcgccgcctctttttccacatagacgcgcaccgccgggtgtacaatggcattcatctgcctgcgcttcgcctcatcggaaaaaatgactgccgccagtttcccccgatccagtccgccctgcggcaggaaaatatcctccgcgccaaacgtctcacagatcctgtcatagcactccgtcccgggagacatcagctcatgggcaatctcatccgcaagcatcacgcgggtatccggcttcttcgccaggtatcccagtatttccgacttgccggctcctacaccgccggtaattcctataaatctcatcgttccactgcacctctattttgcctgataccagtcacttcccgcatgcacatcaatctcaagcatcaccgacaactgtgccgctccgtgcatctcttcggcaagaatcttccgcacttcctgttcttcctctgccgctgtctccaccagcagttcatcgtgcaccgtcaaaatcagccgggattttaacccctccgccagcaggcggtcatgcacccggttcatggcgatcttgataatgtccgccgccgttccctgtatcggggaattcatcgcaatgcgctctccgaacgaacgctgcataaaattactcgaggaaagttccggaatcggacgtcttcttccgaacatcgtcgtgacatagcctttttccttcgcctccgccaccagtccgtccagataccccttgatcttcggataggtctcaaaatagcgctcaatgtactccgccgcctccttcttcgtgatggagagatcctggctgagtccaaaggagctgattccgtagacgataccgaaattgaccgccttggcattgcggcgctgcagatcggtcacctcgtcaaacgggatatggaatacctgcgacgccgtcgtccggtgaatatcctgtgcattccggtatgcctcgatgagcttctcatccccggacagatgcgccagcacgcgcagctcgatctgcgaataatccgcatccacaaacacaaaaccggtctttggcaaaaatgccttgcggatcagtcttcccagctcaatccgcatcgggatgttctggaggttcggctccgtgctgctaaggcgtcccgtcgccgtgatggtctgattgaatgacgtgtggattcttccgtcctctgcgatatagttcaccagtccgtccgcataggtggactttagcttggtcagctgcctgtactctaaaatatccgctacaatcgggtaatccggcgccagacgatctaagacgtccgccgccgtcgaatagccggtcttcgtcttcttgccgttcggaagggaaagcttttcaaataagaccacaccgagctgcttgggagagttgatattgaattcctccccggcttcctcatagatcttacgctcaagttcgtcaatgcgcacggcaagcttgtctccgtactcctttagcgcctccccggacgcaatgattccctctttttccatatctgccagcgtgaagacaagcggcatctcaatctcgcgaaacaacgcttccattccggtgtctgcaagctctttttcaagcggctccctggtcttgtatgccacgtatgccatatagcagacgcactttaaaaattcctccggctttttctccgacgccttctcatacgtgagcttctcaataagatcctttctcgacggaatcatcagtcccgcataatccttggcaatgtcctcgtacggatattcattcttaatcgggtttagaaggtaggctgcgatcgtgttgtcgaacaggttctcctccgagatcgttccaagacattttttctctagcatccccagttcctttaactgcggctttaagtcaagtgtcgcgtaggaagcggctgcgctccccgcaaacagttcacggatcttacggcagggaagcgcttctgatgcctccacgtaacagatttcctcctcaccgcatgcaactgcaagtccgagaaaatccgggatatgacagcttcctgccgtctcctgccctcccgcttcttcgccggagttttgcatagcaaagctgccaaacagattcatctgaccgtcagcctccgtgtgggcgtcatgtgtttcctcctgtggcaccacatagaatccacatgcttttccacgcagggatgcaaaaaatgcttctgcctcctgcgccttttctatcttcttaaaatgctcctccgccgtattcttcggcgcttccacggagaatctgccgaggagattcttaaattccaatctcttacacaacaaataggcttcctctgtatacagatcggaaacctgttctaaatgcgcgtccgcaagcttgtaggcaatgtccgcatcgatatcgatcgtcgccagcgtcttgctcatctgcgccatatcataatgctcttttaaattcgtgctcgctctcggcggctttagttcatccacatgcgcataggcattctcaatgctgccgtattttgcgatgatcgccgtcgccgtcttctcgccgatgccgggaactcccggaatgttatcggaagtatcacccatcagtgccttcacatcgataaactctgtcggcgtcacctggtatttttcgaggacttccttcgcgttgtagtcctcaatctcggttcccgtcctcttcgtcttcgggatccggatcttgatatgatctgtggcaagctgcaggagatcccggtcaccggatacgaccgcaacctccacacctgccgcctcactgcgctttgcgatggttccaagcagatcatccgcctcgtaaccacctttttcaatgatggtcacacccatcgcacgcagcatctctttcatcagtggaacctgctgctttaactctgccgccatcggcttgcgggtgcccttgtattccgcaaacatcttgtggcgaaacgttggctcagacacatcaaacgcaaccgtcaggtaatcgggctgctcctcctccagtatcttgaacatgatatttaaaaatccgtataccgcgttcgtgtgaagtccctcggaattggtcagatccgggattccgaaaaatgcccggttcaaaatactgtgtccgtcaatcaataccagcttttcgctcatttctgtctccgtttctagattgctcttgtatacttcttcagccactcattctcttccggtgtcatgtacggagagagtgtcttatataccattgcatgatagtcatttaacatcttcttctcacgtcccgtcatctcgtccggatcaatggcatccagatcaatcggtgcgtacgtaatattttcaaaattcatgaactggccgtactcgtttttctccgccttgtggcataccagttcgttctcggtacggataccgtacttgccttccagatatacgcccggctcatccgtcgtgaccataccctcttccagcgtgccgttatcatggcgctccggcaccactctccagcggaagccgttcggtccctcgtgcacattcaaaatgtagcccacaccatgtccggtaccacacttgtaatcaatgcccatctgccagagcggcccgcgggataaaatatccagatttagtccggtgcagccgtagaggaacttggcgtttgcaaggttcatgttggaacggcataccgttgtaaaatgcagccgcatctcgtctgtgatcggtccgagcgccatcgttcttgtgatgtcggtcgttccctcgaaatagtgtccgccggaatctaccagcaggaagccttccggctttaactcggcatccgattccggagtcgccgcatagtgcatcatggcagcgttcggtccgtatgcacagatcgtgtcaaagctcaactcgataaagttatcctgctctcttctgcgcgcctccaggtaatctgaggcggagatctccgtcatcggaatcttgccgatattggtcttcagccagtacatgaatttggtgaatgccacaccgtccttcacatgtgccttgcggatattctccacctcgaccggattcttgaccgctttcatgatctcggtcgggttcggctggtccacaatgcggatctcttttttcaggctgctggtaatgcggtagttgaccgtattgccgttcatcagtacgcatgcgtccgccgggatctctttcacataatcatagattgcatcgtaaggtctggttgtgatgtgattctctttcagatatgctgcaatcttctcatccacaacttcttcctgtaaaaaccagatgcactccttgtcggtaagcaccaggtaggacaggatgaccggcacgtaatcgatgtctccgccgcggatgtttaacagccatgctatatcgtataaggaagtcagaatatgcacattggctccctctttttccattaccttgcgcagatccgcgatcttgtctgccgtgctcttgccggagtacttctcctcaagcaaaaacagcggttccttagaaagcgccgggcgatccttccagatcagatcaatcagatcctccgtcacgtacaaagaccccttctttttctccgcaatggcgagaagctttctgccccagcttccgttcaccactctgccgtcaaatccgatgcagccgctctccggcagttctttttcaacgaactcatccacggtcggcacaccctcttcacccatgcggtagagcatcacggtacttccggcaagctgcttttccgcctgcacgaaatagcgtccgtctgtccacagtcctgcctctgtcagggtaatgaccgccgtgcctgccgatccggtgaaaccggtgataaactttctggctttaaaatgctcccctacatattcggactcatgaaaatcggcggtcggtacaatataaatatcgatcttccgctttttcatctcctcgcgcaatgcgcttaatctttcctgaatcatagtattctccattccggagcgtctatccgctccattttgttctaaatatctgtgtactcaaagaactttgtatcaatctccggataagaccgtttcaacgaaatcggtcttccggaacggttcaaaaagcagtgggaacttgttcctgtagtgcgaagttctcccgtcgccttatccgtcatccggtactccacttccatcttgattccgttatacttggtaatccgcggctcaatgacaaccacatcatcaaaatgaaccatgctgtgatactcgcaggacaccgacagcaccgggctgatgatctccattgcctccatctccttataggagagtccgatctgatccatcagatccatccgcgcctcttccatccatttgatatagttggaatgatgaatgatgcccatctgatccgtctcgtaatacttggcgtgatgctcataaggccgaatcttgatctcatccacctgttttccatagagttcgatttccttctctgacatctgaattccttctttccttgcaatacatagacaacgacctctgtttccttcgccaggcaacccgcaggcgctttgcgctctgcgggtcgcgggcttcgcccgacttccccgtttggatgcggcggatatgtaacaggcaagcctgtacacttcgccgcatccaaacgtgctgcccggctcattgcctacgcgtacattatcccacatcccatttaaaatttcaatatccgcagacagcgttctaagcttccttccgttcgctacgaccggcttttgggcatgtggcaatttcctcttttatctcattttatctctaatcttcaaaatattctctgtagtcatcctcattcgagaagagcatgtattctccgtttacatatcccatatagcctgccgctacaacatatcctttcataaaaaatacactcctttcgtcatctgataaaaggagtgtatcgcatcatgtgtccaattctttggacacatgatcctgtttattatctttaacagctttaataagtaatattatcagaatacacttcgggatttcatgtggaaatgcagatggaatattcgttggagaaaaatgtgagcatttcttccggctgaatgtttgcatcggattccgtgtctcttccacgtttggacaatccgacgggtgcatgtccgacacaccggagacaatgggcggactttctggtgtccctaatggcacctcttcacagacatcggcttcgcacggttatgttctgttcagaggtgccaataagggacacacacaaaagtcctacaaattgtcttccgggatgcggacatgacccgcggagtgctccaaacttggaaagacacggatcatcgaagatgcaaacatccggctggttagaaatgccacattttttgaaccgaatttccagctgcattttcatctgaaatcccacggtgtgatcttctgataatattacttatccccaaaaagagttctatgcttattattgcggcaatcctcttctgtcatcgatcctttgattccaccacgagaagaatcccgctctcaaacgagatctctgccgtatctgccacgatctcgttgctcacgccaagcgaacagaatccccgcaggcaggcgtccgtgaggggatatttaaatcccttcagcgtcagatgctccacacattccgtatagggaatgagcgacacatacgttccgaactgttcctttctcacaaaggtcattccccggtcaatcatacggatgcggttatgggcatcgcagatctggatgggaattcccgcctttaacccaattccgagcagttcaatgttccccagcacatgatccagccgcgtccccgtcgctcccaaaagcgtgatgcgctctgctccgcgccggatcgcaagccggattgcggattcggtatccgtgtcgtccttctccggaatcagcttctggatcgccacaccaggcaatgtcttaaaataagcaagagcctccgttcccacggaatcgaaatccccgacaatcacatccggcacccggtggctgcggtacagatattccattccggcatccgcagcgataacggcatccggcttctcttcctcaaaccatctgtccgcaaaagaatcgtcgatcgttccgcctgaaattattacaaaatgtttcatacgctcccccgcttttctcccgccgttccttaagaatttaaaatatccagaaacatctgggtgttttcagcgacatctccgttaaaaacagcgcttcccgccacgatgatgttggcgccggcactcataatctcctccacgttggagagattgaccccgccgtccacctcaatgtctgttttcaacccgcgtgcatcaatcattttcttaagatcacgaaccttctgcaaggtatatgggataaacttctgcccaccgaatccagggttcaccgtcataatcagcaccatgtccactttttcaagcacatactccaccgtctgcagcggcgtagcaggatttaacgcaacccccgcaagaatcccccgctctttgatggaatcaatcgtgcggtccagatgcttgcagctctctgcatgcacggtaatcagatccgctccggctcctacaaaatcctcaatatagcgccccggctcctcgatcatcagatgcacgtcaaagatccggtccgtacagggacggatggagcggattaccggaagtccgaaggaaatacttggcacaaacattccgtccatgacatcaatatgtacatactgtgcccctgcctcgtccagttcacggatctgctctcccagtcttgaaaaatctgcggataatatggatggcgacaaacaattcatctctcttacccccttctttttaatatttcttctgttcttttaattcctgatataactgcctgtaattctcataacggagccggctgattttcccggcttccaccgcctcttttaccccgcagtccggctctccgatatgactgcagcccttaaaacggcagtttggctcatactcttcaaattccggataataccaccacagatcttccttttccagccccggaatatccagcgtggaaaatcccggtgtatccataatgtaagtctgctctttgatcggaataatttccgagtggcgggtcgtatggcggcctcgctcaatctttctgctgattgccccggtctccatctggcgctccggctgcagacagttgatgagcgatgacttgcccacacccgagggtcctgccaccgacgtcacctttccttccagccgctcaagcagcacatcgattccccgctgctctctcgccgaggtgtacaccaccggatagccacactgttcgtagacatccgaaaacgcgtgcagctcctccccggtcagaaggtcacacttgttaaaacagatcgtaaccggcactttctgatattccatcataatcagaaaacggtccagcagattaaaattcggcttcggctttgccgccgcaaaaatcacaagcgcctgatcgatgttggcaaccgccggacggatcaaggcattttctctcggaagaatctcctcaatatttccaagcatctgctcctcatccagcacggcaatcgtcacgttatcgcccaccagcggcttgatcttctggttgcggaaaattccttttgccttacattcataaattccggatcccgctacgtgaacgtagtagaatccggaaattccttttacaatctttccctgcatattcttatccattatgattccggtgtaaactggtaggtgctcgtggtctgatcgttgatcttgttgccgtttaaatccagccatgagatcaccagatagccctcttttgcaagcagtcccgtcttgctgatggaaaaatcatctgtgatcgccttatcccactgtcccagcacattgccggaagtatcatacaacgtgattgttgcgcctgatacgttggacgtatcgcccggcagattgatcgtcgccttgaagctgtaggtcgtcgctgtcacactctgggacggtgacggtcccatgcttaccgtgatcgtgatgtcgctgcctttttccacctgcttgcccggatcgatgctctgatccatgacaatgccctccggaagtgtatcactgtatgccgtctttaccgttacattaaaatcggtaagcagcgctttggcctgatcctcggacttgtaggtcgtcttcacatccggaacggtcactgcctctgcgccctggctgatgacgatcgtgatcgtatcacctgtttttgccttatctcctgcggacggtgtctgggaaatgacttttccctcctccacactgtcatcgtaagcatatgtcttgttcggcttaaagccttccttttccagtgcagacactgcatcatcctcagagtctccggtcacattcggcactgccacactgccttttccgttgctgatcacaacgccgatcgtcgtgccctcttcgacttccttgccgctctccgggtcctgattggcgatctcgccctcatcgtagtcgtcagaggatacttcgcccttattctccagctttaatcccttcttctccgcctcggtctgcgcatccgcatatgtcatgccgcggaaatccggaacggtaaccgtatcctcgttctggctctcggtctgtgtagtctctgtgcgcgacgtctccgtgtcagactgcttcttggacttgattccaccgaacagatttaccacaatcacaatgatgataatcacaatcacgactgccgcaacaattcccatgatcgtgatcgctttctccatcttcggattcagatcgccgtcatcctcgtcatccagctcatcatcgtccacatcttcttcgtcgtcctcatcctcatcgtagcggttcatctcctccgctctcgcgtgcaccgcctgatccgccttaagatagaggctgtctgcctcctccttgatctgctttaagtcatcctctccgataatacgtgtcttgtcctggttggttgcaggaaccatcacgacaaagtcctcattcgggctgacaagcgccttgcgcagatccgtcaaaagtgccgtcatggactcataacggcggtccggattcttctgcgtacattttaaaatgatcttctccatactgatcggaagattcggcgcgtaggcactcggcggaacaatctcctcctgcagatgctggatggcaaccgccacggtcgtatccccgtcaaacggcacacgtcccgtcaccatctcatacatcacaataccgagggaatagatatcgctcttgccgtccacaaatccgttgcgtgcctgctccggagaagaatagtgcacggatcccatcacatcggaactgatcgtgttactgcttgctgcgcgcgcgataccgaaatctgttacttttacttttccttctgtggaaataataatattctgtggcttgatgtcccggtggatgatacccttgctgtgcgccgcctcaatacctcttcccacctgaatggcaatgctgactgcctccttaaaagaaagctgaccctttttctcaatatatgtctttaacgtgatgccttccacatactccatcacgatataatgcattcctttttcgcttccgacatcgtagatatttacgatgttcggatgctctaatcccgcagcagactgtgcctccgtgcggaactttgtcacaaaattcagatcctccgaaaactccggctttaaaaccttgattgccacaaaacgtccgagcgtcagatcttttgccttatatacgtcagacattccgccggcaccaattttccctatgatttcataacggtccgctatatacattccctctgttaacatattaaacctccaacctgatttacaaagaacttcattctctatctagtctcatctgaaaacggctcaatcaaaaccaccgttatattatccttaccgccattctcgttcgcggcgtcgatcagccgttgtgttttctccacaatatcacgctgtcccagcacgatccgcttgatatccgtatcatcgaccatattggtcagaccgtccgaacacaatagaaccgtatctcccggcacaagcaccgtctcgaagaaatccgccgacacctccggaagcacgccgatcgctctcgtaataatatttttatccgggtgcacttttgcatcctctttgtccatctctcccagccgaaccatctcttctaccagagagtgatctcttgtaatctgtgtgatacgttcctgattgatcacatacaaccggctgtcgccgacattcgccgtgtagagcttatcgccaaccacgactgccgcaacaatcgtcgtgcccatgcccgctttgctcgcatccgcgttcgcctccgcaagcaaatgttcatttgcatatctgactgcctcaccgagcacggtcaccggctcgctctcctcggattctgttacgtattccacaatcttttcaactgtgaagcgcgaagcataatctccagccgcatggcctcccataccgtctgctaccagaaataaatccggaagcctgcccacggaggtctctgatgtgtacatataatcctggttcgtctcacgccgctgtcccacatgcgtcatggaaaacgtcttcattctattcctccattattagaatagcagtacctgcctgccatttatccaattaccaatgttagcatacaacgcgaaaaagggcaagacttactgctcctgcccgacacaccccgtttcctgcccggtatgctccatttcctgctctttgtgcatatgcttgcgtctcagctgcccgcatgcaccgtcaatatccctgcccatctcccggcgcacggtcacggtgagcccgtttctctccagctttttctggaatgcatgcactgcaccgtcatccggctgtctatagctgcgttccttgatcggattgaccggaatcagattgatatggcagttgatcccgcgcacaagctctgccagctctgcggcatcctccgccgtatcgtttacgcccgccaccagactgtactcaaacgtgatacgccggccggtctgttcaaaataataacggcaggcatcgaccgcttccttaatgtcatacttgttcgccacaggcatcagctgcaggcgcttttcctgattggatgcatgaagtgagagcgccagcgtgatctgcagctttttgtccgcaagttcccgcatgcgcggaacgatcccgcaggtggagaccgtgaggttccgctggctgatattgagtccgttttcatcgctcagcaattcgatgaattttaacaggttgtcataattatccaaaggctcgccggttcccatcaccacaacattggagatccgctcgccgatgtccgttccgatctgatagatctgatcgagcatctcggacggccacagaccgcgcaccagaccatccagcgtggaggcgcagaaacggcagcccatccggcagccgacctgtgaggaaatacagacggagttcccgtgcttataacgcattaagacactctcgatgacattgccgtcgtccagaagaaacaggtactttctggtaccgtcaattttcgagatctgcacatccgccttttttaagctggtcagcgtacagttctgattcaatttttcaatgagagccgcagaaatattggtcatctccgaaaaggatgccacatgcttcctgtgaatccactcgtaaatctgttttgcccggaactttttttctccgagcgactcgacaaatgcggtcagttcttccagattcaacgatttaatgtctgtcttttccattccttatccgttgtcctgctttcgcttaaattttgctataaaaaatccgtccccgagatgttcttccgggaacatctgccgcatcgtatcgagggcgaactccgggtgcgtctgctcaaaccatctggcattcccctcgttctccgccgtgtgaatcgtgcaggtggaataaatcagtgtcccgcccggcttcacatattcacacaccacagacagtatctgcctctgcagcgccacaagcgattcctccccttccgggttcatgcggtacttgatatcggtctttctgcgcagcaccccgagtcccgagcagggaagatccgcaatcagcacatccgccgtacgaaccgatgcctcgtccaaaacagtcgcatcctgacacttcgccgtaatattcgtaagccggcatctttttatattctcatcgatcagcgccactttctgttcgctgatgtcccgcgcctccacatgaccggtaccttttaacttttccgcaagatgaatgctcttgccgcccggcgccgcacagacgtcaatgcagtggtcgccctcctttggcgccgcatattccgccaccatcatggagctgatgtcctgcacatagaacagtccttcctgaaaactggaaagaccgtttaaatgatcaaacccaaagatcgtaaatgcatacgaaagtccgggatatttttccgtatccagaggaaccgcagtaacgccctcctccttaaaacgctctgcgagcgcctccggcgtgatccgttccagattcgtgcggacggtgatcggcgcttccaaaagggacgctgcaagaatctcttttgtgcgttcctttccgtagtcaccaatccactgcgcaacgatccattccggcatcgagtagcgcaccgaccaggcttttacggcatcggcgctctcctctggatatgtaagctgatccaggctgcgcgaaacaccgcgcagtaccccgttcacgaaaccggacagctgtccgaagccctttttcttcgcaagctttaccgcctcgttgcaggcggcggatgccggtacactgtccatatatttcagctggtatacgcccatcctgagaatggcgcggatcaccggcttcatttttctgacctttacttttgagaactgatccagaatatagtccagctcaatctggcgctgaatggtgccctccgccactctcgttaaaaaggcgcgctctcttttgtccagatactggtacttatccagcaccgaacggatcaccagatggctgtactgtcccttctccgtcacttctaaaaggatctcaagaatcagttcacgcgtattcacggaatcagtcgtcacgtcttcttcctccaaataataacaccagacgaagcagctgcagaatcgatgccgccgcactcgccacgtaagtaagcgccgccgccttcaacacttttcgcgtataaggcagctcactgtcgcttaagattccctgctctcctaaaatgcgcagcgcgcggtgtgatgcgttgaactccaccggaagcgtcacaagctgaaacagaacagcgaacgaaaaacaaagaattccaaggtcaatcaaaaatgcccccgtattgctggtaaaaaataatccgattaaaattaacggccacgccagcgtagaaccgatatttgccaccggcacgatcgccgagcggagcgtgagcggcacatatccctgctggtgctgaatggcatgtccgcactcatgcgccgccacaccgacagccgccaccgacgtgcttccatacacagaatccgacagattcagcgtcttgttcgacggattgtagtgatcggtcagattgcccgatacatgctgcaccgacacgtcgtagattcctgccgagtgcagaatccgttccgccgcctgtgctccggtcatgccggacatgctgcggtaggaagcatatttgttgtatgtcgacttcaccctcgcagatgcaaccagacagatgactgctccgatgagcacgagtatatacgtcggatcaaatccccagtaatagtatgaatatggcatagtaatcaccctttcttaaaatatgtgccctcttcgatctcatatccgttcagaaatgcctccaccggcatacgcttcttgccctcaagctgaagttcactgatggcaagcattccctttccggtctgcaccagaatatgatctttttccactttcacaatgcagcccggctccgccccggactcctcagaaacgacctgcgccttccagatctttaacatcttatcgcccagtctggtataagcactcggccacggatccagtccgcggatcaggcactcaatctcttttgcgccctgtttccagtcaatgcttcccatttctttgtaaatcttggcggtatgcgttgcctgggagttgtcctgcggcgtgtaggttgccgttcccgcatcgatcgcctccatcgtgcgcacgcacagcttcgcgccgacctcggacagccggtcgaacagactgccgcccgtctcatccgcacggatcttcacttcttcctttaagatcatatctccggtatcaagtccctcgtccatgcgcatcgtcgtcactccggtgacggtgtcgccgtttatgaccgcccactgaatcggtgcggcaccgcggtacttcggaagcagcgacgcgtgcacattcacacacccgtagcgcggcatatccagaatcgctctcggtataatctgcccaaaagcctccacaattatgatatccggatgatatgtccgcagacgctcgatacactcgctgtctctgactttctgcggctgatatacttcaatgccgtgctcgagcgcacatgccttgaccggtgtatagcggagcgccttgcttcttcccactgccttatccggctgggagacaaccagcaccacctcatgtcccgcttttatgatttcttccaacgttcccaccgcgaaatccggtgttcccatgaatatgactctcatcactgacctccattttcacagatcatccatgctttattcttcctcatcactctcataggtgacttcgtgaagcggaccttccaccttctcagtgtacatgtgtccgtccagatgatccagctcatgacagatggcacgcgccatcagctctgtcccctcaatctcatactcttccatatccagatcaaacgcccgcgctttcacgtagttcggtctggtcacggtgcctgccttgcccggaaggctcagacagccctcgtcgccggtctgctcgccggaagtctctaagatcaccgggttgatcatcacaaccggtccttcgccgatgtcgatgacgacgatgcgctttaacacgccgacctgcggacctgcaagtcccacgccgttcgcctcgtacatcgtatcaagcatatcctctgccagttctctgatcttcggtgtaatctctgtaatctctctgcattttttggtcaatacaggatctccctgtattctgattgtcctaagtgccatctttcctccattctgcctaaaagccgttcaccggattgaaatcaaacatcacggtcacattcttatagtaccggctctctctggcatacacttctgtcctattttttatctttaccagcgtgtcataattttctgccttgagataaattatttttttataaatatcattcacttttgcgatcgccgcgtcgacgggtcccacgagatagaccttctctttcgtattcttccctgtatacgcatccgctgccgccgcaagctctgccgccatggcatccgccgcctcctcgctcttagaggcgcacaagatcacaagcatgttccagaccggcgggtaaagcatgatcttgcggtacgcaatctcctgctcgtaaaacgcatcgtagtcctgcgccttcgccgtctctatactgtaatgctccgggtcataagtctggatgacgacctcgcccggcttattcccgcgaccggctcttcctgccgcctgtgtcagaagctggaatgtccgctccgccgcgcggtagtccccgacatgcagcgagagatctgctgcaagaacgccaaccagcgtcacatccgggaaatcatgcccctttacgatcatctgcgtaccgatcaggatatccgcctcatgattggcaaatgccgataaaatctgctcgtagtcttccttgccccgcgtggtatccatatccatgcgcagcacgcgcgcctcagggaatcgttttctgacaaccatctcgatcttctcggttcccgccttaaacccgctgatgtacttcgatccgcacgccggacattgtaccggcaccggctccgtatacccgcagtaatggcagaccatctgcccgttggcatgctggctcagcgatacatcgcaatgcggacattttatcacatgtccgcaggctctgcaagagacaaagcccgccacacccctgcggttgataaagagcatggtctgttctcccgcccgcaggcgctgctccatcagcccgtctaacctgcggcttaagatggagcggttgccctctcttaattcctgccgcagatccaccaccccacatgccggaagcggtctttccttcacgcgctttgtgagcgtaagcagccggtattccccgcgctttgcacggtagtaactgtccaccgacggcgttgccgatcccagcactacgctcgcgtcaagcatggcagcccgcgcgatggcggtctccctcgcatggtagcgcggaaccgtctcactcttataggaagtctcatgctcctcatcaatgatgataagccccagattggcaaacggtgtaaacagcgccgacctcggaccaatcatcacgtcgatctccccgttctttgcgcggagaaactgatcgtagcgctcccccggcgacattctggaatttaatatggatacccggtcgccgaaccggttgtagaaccgcagcaccgtctgatatgtcagcgcgatctccggaatcagaacgatggcctgccgccccgccttctgcatcttcgcaatcagctccatataaacttcggtcttgccgctgcccgtcacgccctttatcagatatgtcaaccggattcccttctcataatccgaccagaccgcgtccaccgcttcctgctgctcgtcatttaaggtaagcccgtatcccctgctggtcagatgggacaccggattgcggtactgcgtttcccggattactttgacgacgccggattcctccatcgcccggatcacgcttcccgacaccccaagcttgtgtgtgacaagatcccagtcgagttcctcctcttccagcagcgcatgaagcagcttggcgcgggcggtgctgtggcgtctctcgtacgctcccagctggttcttcgcctccaccggatgaagcgccagccgcactcttttatgctccacagcttttttcttctccttgatcgggagaaccatctttagcgcctggttcatcgtgccaccgtaatgctcccgcatccagcccgcgagtgcgatcagatgggactcgatcggcacactgtccgtcacgatccccgcaatatttttcagcttatcctcgtcatactccgcctcatcggaaagctcgaccacatagccggtgatcctgcggctgccaaacggaatatagacctgcattccgactgcgatccgctgtgtgagatacggcggaatgcggtactcaaatgtcttatccagtttttcctgtgaaatatccacaatcaccttcgcatattccgccatctgtccacctcgtttctgtctgtattctcccccatgtcagggcttcgtctcgcctcctccaccagctcgtattcactgagcggatagcgcacgccacgaatctcctgatatgcctcgtgcccttttcccgcaagcacaagcatgtcattctccatggcttgcgccatggcataccgcacggcttccctccggtccgcaatgcgcacatactgtccgccggttccccggatcccgtcctcaatgtcgtccagaatctcctccggatcttcccagcgcgggttgtcggaagtcagtatcgtaagatccgccagatgtcccgccgtctctcccatcttcgaccgcctgagtttcgaccggttgccgccgcacccgaacagtacgataagacgccgcggcttaaacccgcgcagcatttccagaagattttttaagctcatctcattgtgtgcatagtcaatcagaatgacataatcttcggaccgcctcacattctcacatcttccgggaacttttgcgctgcggagtgcaaggcagatatcgctctccgcggctcccaggtgtcctgccgcccttatggccgccagtgcattgtagacgttaaacgttccggggagctgcattctcaccggatacaccgccgtcttcccgcgcaccagaaagcttccccaaagttctcccgactgcataaaaaagcggatattctccgccgtcacatccgccggatgccgcagggaaaccgtctccacgctgcaggtatgtccctgtagtatgcgctccgtgtgcggatcatcccgattgacaatcccgatccggcactggcgcatcaggcggctcttgcagaacagatattccgcaaacgaagcatgctcgccctccccgatatgatccggctcgatgtttaagaacatgccgatgtcaaaaaatatcccctccacccgctgcatcttcaacccctgggaagagacctccatcacgcaggtatcacagccgttgtccaccatctgcgccagatacttctgtatctcgtaggcttccggcgtcgtatgtaccgccggaagaacgccgtctccggtatcgattgcgatcgttccgatcattccggtcttatgcccgctctcacgaagaatggcagaaagcagatatgccgtcgttgtcttccctttcgttcccgtgattccaaccatacgaagctttgccgccggataatcaaaaaaagctgccgcaagctctgcgagcgcgtgtctggtatccgccgcaatcacaacggagacctgccaccggtctatgacctccgagatccgcacaccaaactgttccgtgtacaaaagtgcatcattgtccagtggaaccacattctccgccgcaaccacaactgctgccgccccggcttccagcgctccctgcagatagtcatgcccgtcggcatgcagcccttttaggcaaacaaatagggagccttccctgacattcccggaatggtaacagatgtctgttatctcacggctctggcttccctgcacatgttcatatgtaagatgtttcaataattgattcagccgcatgtcatcctctgccgaattcgcttttttcattatatgccagatcttatggttttacaagttatcccgatttatttcattttaatttcagaaaatgtacatattttgtcagtaaccggaaatactgaaacacaaacgaaaaccggaggaatctctcatatgcgcggacgtaattttctcatctgcggactgaccggctggtgcatggaaattctgttcacctccgcaggctccctcgcaagacacgacggccgtctgatcggtcagacctccctgtggatgttccccatctacggtatggctgcctgtatcggtccggtctatgcaaaaatcaaaaagctgccggcacttctgcgcggcagcatctatacagtgggtattttttcattcgagtacttaagcgggtctctcttaaggcggcatcatttctgcccctgggactacagcagcgccagggcaaatgtcaacgggctgatccggctggattatgccccgctgtggcttggcgcgggtctgctctttgagcgcattctcgtgcacgcaaaccggctcacatagccagaccgcgcatggcgctctttcccggcacgcattcctgcgccctgtgaaagcagcggcttttcctacagatccacatcgtctgcaaggcttgcaccgatgtcctgcatgtttaacgtgcgtctcttgatgcgcgccgcctcggatgccttcagaagataattcttaatctcctttgcatgcttgatatgactcaggcgaagttccttgtctgtcacgtctccggtgtagcagatgatcgttcccagcccgaaaatccgctccggcagtgtggctgtcagcttgacatcctgcactttgtacatgtagcagtcattctcttccaccttgatcaatccctcatcgacggtaatcatatcctgactgatcgtatattttgtaaatgtccatggaagtccgaagaaaagtaaccgtttgcgctcctgatactttacctcctccgcttctccctgactaaaatttgtctcttctgccatgtctgttcttcctttccttgtatgttccgccccgggcgaaactttttgcattcttttctgcgtacctgtagtttacttcatttttctttttcgcgcaaccaaatatcagaaaatggcttccatcttttgaaatatcatgccaaacagcccgtcttttcccgattcgtgcgtaaatatttttccccttgaattcgcagagtgattattatatgatagaaaaaatgcctggagacagacagatttgttctgccgtttccggtcaatacaaggaggattttatgcgtcatttaatgagcccattggacttctccgtcgatgagttggacaagcttttggatcttgccaacgatatcgagaagtacccacagaagtatgcccatgcatgcgaagggaaaaagctggcgacctgtttttatgagccaagcacccgtaccagattaagttttgaagctgccatgttaaatctcggcggttctgttttaggtttcgccagtgccgattccagttcggcatccaaaggtgaaagtgtttccgataccattcgtattatttcctgctatgcagatatctgtgctatgcgtcatccaaaggaaggtgcacctcttgttgcctcccagaaatcccgaattcccgttatcaatgccggcgacggcggtcatcagcatcccacccagactcttaccgatctgttaaccatccgttctttaaaaggacgccttggcaatctcacgatcggactctgcggcgacttaaaattcggacgcaccgtacattctctgatctctgcactaatccgctacccgggcatccgcttcgtgctgatctccccggaagagcttagaatcccgagctacatccgcgaggacgtgcttgcggcgaacaacatcccgttcaccgaggtggagcgtctggaggatgccatgccggatctggatgttttatacatgacccgtgtacagaaggagcgtttcttcaacgaggaagactacgtccgtttaaaaaacttctacattctgaccaaagcgaagatggagctcgccaaggaggatatgctggtgctccacccgcttccgagagtcaacgagatctccgtcgaggtcgacgacgacccgagagccgcctacttcaagcaggcacagtacggcgtctatgtccgcatggcgctgatcttaacactcttagacatcaaggtcgattaacatcggcagaaaggacagatacatgttaaatatcagtggaatccacgagggttttgtattagaccatatcaaagccggcatgagcctgcagatctaccacgatctgaagctcgacgagcttgactgcacggttgccatcatcaaaaatgcgaagagcagcaagatgggcaagaaggatatcttaaaggtggaatgcccgatcgaagcgctggatctcgacatcctcggcttcatcgatcacaatatcacagtcaacgtcatcaaggacgacaagatctatgagaaaaaggagctgcaccttccaaagcaggtcaagaatgtcatcacctgcaggaatccgcgctgcattacttccatcgagcaggaactcgaccagatcttcctcctgaccgatgaggaaaaggaagtctaccgctgcaagtattgtgaagaaaaataccggaatccaaaccgcagataaaccggctgtgccttttgaagggataagcagtattacaggaagaactgagaacagaaagttccggaataaccatacggcggcaaattttttgaagcaaaattcaagtatttcttccatgccgcggctggtatttcattccgtgtctcttccacgtttggactctcccggagggtgtccgacaaatcagagacaatgagcggactttctagcggcgctaatgcgcgctccctcataaacattataaaatcgcgcggactgaaactcggagacttctgctattaaaaatatggcagaaatctcctcagacatcagtccgcgcgattaggttttactcggaagcgtgcaaagcgccgcacgaaagctcctaaaattgtctcatgatttgcggacaccgtccgaggagtgctccaaacttggaaagacacggatcatcatgaatgccagccttcgcttggttagaaataccggattttgcggtcaaaatttgctgccgtatggttatctggaactttcaggtatctatttctaatagtactgcttatcactacaaaagacactgaccgcttacagcaattcctttaagatctggttcaccagtgcaggatttgcttttcccttcatcgctttcatcgtctgtccgaccagaaagccgatcgctttttcttttccgttgtggtaatcctccaccgactgtggattctccgcaacgactttcgccaccgtctcacggagtgctccctcgtcgttgactgtcaaaagccccttttccttcacataggcttccggatcaatgtcctctttaaagactttctcgaagacttcctttgccacggtgttggtgacgaaaccggcatccgcaagatccaccagctttgcaagatgttccggtgaaaagcggatctgatccggatccatctcattttcttttaacaggcggattgtctccgtcatgatccagttggagacttttttcggctttccgcagatcgcggccgctgcctcaaacagatctgcaaatgatttgtctccggtcaggatctccgcatcgtattttggcagaccgaactcatcctgatagcggatcagcttctcatcccgcatctccggctggcgtgccttcacgcgctcaatccactcgtcgctgatgaccactggaaccagatccggctccgggaaataacggtagtcctgtgcgtcctccttggatcgcatcgcgtgggaggattccttgttgtcatcccagcggcgggtctcctggatgacctttttcccctcctcgatcagttcgatctggcgggcgcgctcgccttcgatggctctcgcaatcgccttgaaagagttcaggttcttcatctcggtacgtgttccaaactcagcggctcccgcctccctgacggacaggttgacgtcggcacgcatggaaccttcgtttaatttgcagtccgatgcgccaagatactggatgatcagcctcaatttttccagataggcaatgacctcctccgcggagcgcatatccggttccgacacgatctcgatcagtggaacgccggaacggttgtaatccacgatggacacgtcctcccactcgtcatgcaccagtttccccgcatcttcctccatatggatctcgtggatgccgatcgtctttttgccggcagccgtctcgatctccacgccgccgttgcggcagatcggcagatacagctgggaaatctgatagttctgcgggttatccgggtaaaaatagttcttgcggtcaaatttgcaatactgggtgatcgtgcaattcgtcgcaagtccgactgccatcgcatattccaccacctgcttgttcaataccggaagggatcccggcataccggtgcacaccgggcaggtgtggctgttgggcgctccgccaaaggctgtcgagcagccgcagaaaatttttgtctttgtcgctaattctacatggacttccagtccgattacggtttcgtatgttttgctcatctatctcatcctcccactgtcatcgtgccaacggactgtgttcgtagcttctggtctgctcgtaagtgtatgctgcgcggatgatttttttctccgcaaagcaatcgccgatgagctgtaaaccgatcgggagtccgctctgatccgttccgcagggaagcgtaattcccggaagtcccgcaaggttcacggaaatcgtatagatgtcgcccagatacattttcagcggatcgctcaaggactcgccaagcttcggtgccgtcgtcggtgccgccggtcccaggatcacgtcatatttttcaaatgccttgtcaaacgcctgcttgatcagcgctttcgtgcggagtgccttcaaatagtaggcatcatagtaaccgctgctcagcacgaaagatcccagcatgatacgtcgcttcgcttccgcgccgaatccttcggagcgggtctttttgtacatattgtgaagcccgtcatactgctctgtgcgataaccgtatttgacaccgtcaaaacgtgccaggttggagctcgcctccgcgcaggcgataacatagtaagccggaatcgcatactcgaccagacttaaatcaaactcctccacgatcgcgcctttctcctccagcttctttgccgcaccaagaaccgccacctttacctccgggtccagtccgtcgccgaaatagtctctcgggataccaatcttcatcccccgcacatcgtctacaagcgccgatgtaaaatcataatcctcgcgctgcaccgatgtggaatctttgacgtcatgtgatgcgatcgcctctaagattgtcgcacagtcggtcacatccttggcgatcggtccgatctgatccagggaggagccgtaggcaatcagtccgtaccgggataccgttccgtaagtcggcttgatgccggtcacgccgcagaaggagctcggctgacggatcgagccgccggtgtcggaaccgagcgcatagctgcactcttccgctgcaaccgccgcgcaggaaccgcccgacgaaccgcccggcacatgcccggtattccacggattttttgtcacgccgtacgccgaggtctcggttgtgcttcccatggcaaactcatccatgttcgtcttgccgaggatgaccgctcctgccttttccagattaaggaccgcctccgctgtgtaggtcgggacgaaattgtataaaattttggaagaacaagtcgtaagcagccctttcgtacacatgttgtccttgatcgctaccggcacacccgcaagcggtccggtcagttctcccgcatcaatcttcgcctgcacttccttggcacgctttaatgcaccctctctatcgaccgtcacaaagctgtgcacctgtgcctcacgcttctcaatcgcatctaaagccgccgtcactgcctcctcgacggtcacttctttttcttttatctttctgccgagttccacggcagtcaaactcatcaaactcatctgttttcctcactttccctctttcatgtgcatgcacgctctctctctcatgccctgccttatgaaatcgtcttcggaaccttaaagccgccgtcttttttcaccggagcgttcgcaagtgtgtccgcacttccgtcgccgtttgtcaccacgtcctcccgaaacacattattcaccgggaatacatgtgacatcggttccacgccctccgtgtccagttcattgagtttgtcaatgtaatcgagcatctctcccatatctttcttcgcccgctctttttcctcgtcgtcaagctccagcttcgcaaggattccgacgtactcgatcgtctcatcggaaatcacgttcttcggtgtgcgctctgtctgcgctccctgcttctcccctttcgcctctgcaccgtccgctgcccatcctgcagttccattcaactgcacgctatctgtcgtctgtgccacattcccggcacccacgtatgtcaccatgccgtacaatgcgcagtcacagataccggtattgttccagtctgcacggattctcgtgccctcgtagtgcatgccgcattttttcatgacctctccggaatacggattcttcggatcatgtctggactccagccgcagtacgccgacctcctcaaacagatagcgcatgacctcggcaagtgcctccgtggtaatgcctttgtgccagcggctcctgctgatgcaataaccgatctcgcaggactgcgccttttcattgcggctcacgacagcgatactgccgaccggctctccgctctccttttcctcgatacaccactggtatatctccggattgtcataggccgctacccactcttttaatatctgtctgctgatctctgcgctctcgtgtgtcggccaggtcagaaactttgtgacctcaggatcgcccgcccagttctcatacattttttctgcatcttctaatgtaaaacgtctcaaaatcagccgctctgtctcaagccgttttgttcccaaatctttcactgtcattctcctctctgcatcccgtacgtcccgccgaaacgctcccgcacttttgcattcagctttttgtatactctctcaatcatccacggttcactgcacgccgcgagcgcctcctccagggaaaaccaccgcacaccgctgttctcgtccggcttgatgcgaagcacttcctcttcatccgtctccagaagatacgacacattcagatgcagatgcgacggcacgtaggctccacgcttctcatgcccgtcgaccgtcagaatctcaagcgaaaagatgtcttccgaaatcgcccggatctctgtcacgccggtctcctccatcgcctcgcgcttcgcaaccgccagaagatctctgtctccgtctgcatgaccgcccgtccacgcccacgagtgataaatgttgtgatagatcatcagcaccttatcgtgcgtggcgttcaacagccacgatgacgctgtcatatgcgccacctgattctctcttgtaaataaatccggctgtgtggcaagaagctgccgcatcactgcctgatcgtgtgcttcctgctcattgtacggcttgtagtctgcaatctgttgttctatgttcatgtgtgagttccttttctgttgttattttaagccgttttgttctctttgtatttttctacagttccaggcggcttagaatctaaaagggatttaagcctcgttgttgctttgtattttttatggttccaaccgacttagaatccaaaagggaattaagccgcactcttcttttttatcctgtttacggttccaggcggcttaaatcccttgggaacagggttgtctcgcggacattgtcctcgccgaccagcttcatggtcaggcgctcaagtccgattcccagtccgccgtgcggtggcatgccgtatttgaataccgccagatactgttccatgccctcggtcgtcatgccgcgcttctcgatcttatccagcaacatctgataatcgtggattctctgaccacctgtcgtgatctccagtccatgatacaacaggtcaaagctcagcgtgtatgtcggatctgcgggatcgtccatcgcgtaaaacggacgttttttcgacgggtaatgtgtcacaaatacaaaatccgcaccacattcttccttataatactgtccgatcagcgcttcctcttccggctcaagatcgtaaggatttctgatctggcggtgatatttctccgccactttctgtttcgcctcatcaaagcgaaccgctgggatctgctccacattcggaagcgtcacgccaagcatctttaattccttggcgtaatcccgctccaaaagcttcatggtatattgtaaaaatccggtttccatcgccatgatgtcctcaaatccgtcgatgtatcccatctcaaagtcaaggctggtatattcgttcaaatgacgcttggtattgtgcttttccgcacggaacaccggcgcggtctcaaatacccggtcgaacacgcccaccatcatctgcttgtaaaactgcgggctctgctgcagcactgccggtctgtgaaaatactccagccggaacagattcgcgccgccctcggcgcttttcgctccgatcttcggtgtatgaatctccgtaaacccctcgctgtacagaaaatcacggaatcctctgaccacgccctcctggatgcggaacttcgcccgctctctgacgttgcgcaacgcaatcgcacggtgatccagattcgtctccaacgtcgttggcagtttccacttggaaatcgcaaacggaagctgttccgccggttccgacaacacgcggattgtatccagacgtacctcaaatccgttcggcgcgcggtgctctgcccgcacggttccctccacctcgatggtcgacgcttccttcagttcttttaaatcgaactttgtttttccctcttcaaatacgcactgcagtaatccctctctcttgcgcaggatcacaaatgcaacctcgcccatatcgcggatggtgtggacggcgccattcacttttacctgttttccctcgaaatccccggaaaggatttcactgatttccaccgtttcttttttgctcactcctgttacatattccatattgtacgctccttttcgtccggtgctgccggattgatctaggtgcgggacgggattcctttcgtgcatcggctgctttttcaagaatcatgtgtgcatttgccgcacacttgcgccgacattggctgactgcctgatgcggtatgcagagcactctctgcctttttgtaagatgcatatcccgtctgtcagggcttctgctctataggatgcactgctttctcatttaacctgatgcaatatttcctaaatagaacaaaaaagccccggaaagacaaactgtctttccggggcgggatcttcttctgcaacttctgcttgtattcccgcggtaccacccgctttgaaaaatgattcacaaaaatcattcttccactctttgtgcttaacgcgcaccaacgtactgacctactttaccactgccgtcccactcttacttctacccgcaggataagcgcctgttcaaccagtctgctccagagtgttcccgttatcttctctcccaaacagcgctctcagtcggtgacgctgtattcctgtcgatgtctgaagataagagtctccttcatagcctttcatgctttaacaatttaatgttgtaacatttataccacatcgttctggggttttcaagatattttttgaaatattttgtaaaatatgtgcgacaccgtgcattgccggcctcttttctatattgcgcctttttcttttaagtacgcaaggaatccctcgcatccggcatccacatcccggtaggtatcctcaaaattaccgctgtaccaagggtctgcgatcgagcaacccggtctgtccgtgtaatctaacaacagcttaatcttcctctccgtatccgctcccgtaatccggatcgtattgcggatattcgcggtatctgcacagagcagatagtcataatgctcatagtcttccccggtcacctgtctggcgcgcttgccgctaaagtccgtgtatgccgtcccgccaatcccacgccgtctcaattctgcctgcgccggcgggtagatcggattgccttttccgttccagatctcttctgtggaggtggcggcggaagcgatctcgaaacgtgaggtgagacctcgcttttcgactttgtcttttaagatgaactctgccatgggggaacgacagatgttgccgtggcaaacaaataatactttaatcatctttttatatctccatttaaatcttgtatttcttctcaaacgcttgatatttcagggttttccgacttttgagttttcctttcttttcaaggtatcttctcaaatcttctcgtattttcttgtgtttttccctgcaatcttggtaaatccgttggtaaagcaaacgtccttaccaacgggcttttttaactattcgctatccgatatacttcttcctttgcatcatcaaaattcacatgggtgtaagtgttcaaggttacactgatgtctgcgtgacccatgatatactgcaaggttttcggattcatcccggattttgccatattagagcaaaaggtgtgcctgcatacatgaggggtaactttcggcatctggatacggtaaatcctgttgtatttctgaatgatatgctccatgtacttctcccagtgaagggcaaccatcggcatatcgtttttatccaaaaataaaaatccagcgtatccttccaccatcggttcaacttttggtgtctttcggttggcaataattctgcgaaaacacgctgcgacagcttccgtcatcggcacatagcgaatacctttgtcagtttttggttcttcaattacatactgcatctgtgcagtacgctgtaactgatggtctaccttaatacgcatttctccaaactcaatctccgaaatcgtcagcccacagaactctgaaatacgaagccctgtgtgaaaaagaatatagattgcatcatagtatctgctgaaatgcttatcctcctgaataaacttcagcaaatctctctgctgctttcgggtaatcgcttctctggtaacagaatcattaacaatgacggatgccagctcaaattcaaatggatttttgcgaagcaggtcatcatctactgccatctgaaatgctggtctgagaactccccggatcgaatggatggaactgtatcctcgtccatcaatttgttggagcttaatcaaccatgcctttgcgtctgacaaacgcaccttatcaattcgcagattcccaaaactctcttttttcagcatattgatgaccgttttatatccggcaaccgtattgtgacgaactcctgttttcaatgaaacatacttttctaccagttccaaaacagtatagttgccaccgttggttacgatacggtcaaacaaatccgcttcaatctgtttttctttctcacgcagggaaggctcccgcttctttccttttggcattgggtcattcttgtccaaacgccaactgtatacatttttctcttttccgtcctcatcaatatagcggaaccgatacctcccatctttacgctggtactcgccctctcgcaaaatccgattacggttatctcgtcttttctcactcatcgtgaactctcctttcaaaaaagagagccagacttgcgctcttatcatagcacaaatccagctctccgcatagttatatcatgtgaaatcggtaaatctgtcagctctgtttacacagcagtagcctgatccagatacctctcaaatttctcacgcttaatgagggcacgattgccgttcatcacataaaaatcctcattgggatgtgtgtcaataagcgttctcaattttccttcgccgatatgataatatctggctgcttcctcaatggtaagcgtatatctacgccacaccggaacatccgagtaattttttccttcaatattcatcttattattcgccataggcagttatcctccatacatgaaaatagccagacagagggtgtcggcaacgaagtccggcaacgggcttcaaaagaccttgcaaacaatctcaatctggcactacttactatttatac

SEQ ID NO: 11 - DNA, 154867 bp, Roseburia hominis
gatcaaactctcatgttatagtttgtttccttttccagaataatctggcttattcagatgttactctgaatttactgttttaggttgttctttataagaacgttcgtctgtctttcaatctcttgattgacagcttgaaatttaggatctttcaaggtttattcactgttcagttatcaatgtacatcgtcaatacttcgtattgactttagaagttgctctgcaacttccgaacggatttttcaatctcattcatcgttgtcatctctcggcgacagcttatttactatatcatagtgccaaccgtttgtcaacaacttttttattttcttttgcttctttttaagaagcgctttgcctgtccgctgttctcgcggtcagcttgtttatattatcatcattattttagaatgtcaaccacatttccgccgttttaaaaaagaaagttttcggttctgaattgttttaattgtacatacaattcagaaccattcattttcccttcctgcggactaccgcatcacgtaatccatcgcatcctttaccgtgcgcacgccgacaagaccgatccccttgatctcctttaggctctccctgcacacctccggcagaatacatgtcttaaatccaagcttcttcgcctcgagcacacgctgctctgccatgctgaccgcgcgcacctcaccgctgagtcccacctcaccgaagcagatggtcttctcatcgatcgggcggtctttgtaactggagacaatcgccagcacaagaccaagatcgattgccggctcattcatccggatgcctcccgcaatattgatataggcatcacaatttcccagtgaaagtcccagacgcttttccagaaccgccatcagaagattcacccggttaaaatcggttcctgctgccgtccttctgggcataccgaaattgctgtggcagaccaatgcctgtatttccagaaggatcggtcgcgttccttccatcgagcatgccacaacagacccggaggctccctccggctttccgctcagcatgaattccgacgggttctccacctctgtcagaccatctccccgcatctcaaaaacaccgatctcgttcgtcgacccaaagcggttcttcacaccgcgcagaatacgatacgccgcatggcggtccccctcaaaatagagcaccgtatccaccatgtgttccagcacacgcggaccagccaccacgccttcctttgtcacatgtccgacgataaaaatggaaattccaagtcctttagcgatctgcatcagggtgccggtcgattcccgcacctgcgagacgcttcccggtgcagacgagacgtcttcattatacatcgtctgaatggagtcaatcacgacgatctcgggcttctcccggtcaatcacgcgccgtatggtatcaagattggtctcacagagcagacttaagctgtccccaaaggttccgatgcgttctgcccggattttgatctgctgcaaggattcctcaccggaaatatagagcaccttcaccttatgttccgcaagattcctgcatacctgcaaaagcagcgtcgattttccgattcccggatctccgcccacaagcaccagggatccctgcacaatcccgccgccaagcacccggtcaagctccttcatgccggtggacacccgctgttcctgcgtcatctcaatctgtgacagggggactgcctttgcctcacggctgctatccgcactgcggctcccacgcgcgctctttttctcgactgtctcctccacaaacgagttccactcatggcatgccggacactgtcccatccattttgctgactcgtatccacactcctgacagaagtacactgttgtttttccttttgccatgttcttatcttcctttcccgcagacgcggctgctgcccggacagggcttttttctccatagaaagcgcggctttcgcgctttaacataacacgtcatttcctatagagcaacaaagacctgtccatacggacaggtctcactgatgttgtaattgtcatatgcgaaagcggctgctctagcacttctgaacgcttacctttaccggagcatcgccgagctctacgctcaggcttaactttcctccgagattcgtcttcatcctgccggcatctgcaccgtcgatcacgatgtcgtactcagcctcatcctcaagctctacggtaacctgtgcgtcctctgcgccttctacgctaaactccattcctgtgtctgttgcttttaaatgctccactgcagtccccggaacagactcgtatacaaacatgccattgcgctccagcttggtaatctcctgacaggtctttactttgtaaaggtctccctggtgctcaaaattgtcaagctttgccttggtgctcaatgtataatccccaaagctgatcgttccatcctcctctgaacggagtaattcactaataacggccatcttatcctcctgtgatattgcagctccttcatccggtctgctttatcgtaaatttgtaaaaatattatataatatctgttctttgatttccagtgatttcactgacatttaagtaattttttactttttcttcggctccagaaaaattgcatttttcttcgtcgtgacgatcacttcgtcgccccggcggatgcttccgtcgagaagtttttccgcaagcggatcctcaatctcatcctgaatcttgcgccgcagcggtctggctccgtacttcgggtcatacgccttatccacaatgtactgctttgcggcatcgcgcacgaccagcgtaatgccaagctgtgtttcgcagcgcttcgccagctcttttgtcatcagacctacgatctgcttcatgtcgtccttattcagtgccctgaatacaatggtctcgtcaatacggtttaaaaattccggtttgaaaattctgcggacctcctccatcacgctgcccttcatccgctcgtagttctgcttctcgtcattgccggaagcaaagccaagcttcttcggctccacaatcgcctgcgctcccgcgttggaggtcataatgatgatggtattcttaaagtccacttttcttccctgagaatctgtgatatgtccgtcgtcaagcacctgcagcagaatattaaacacatccggatgcgccttctctatctcgtcaaacagaatcactgcgtatggatttctccgcactttttcactcagctgtccgccgtcctcatgtccgacatatccaggcggtgaaccgatcattttcgatacgctgtgtttctccatgtactcagacatatcgacgcggatcattgcctgctcctgtccaaagacagcttctgccagtgccttggatatctctgtcttgccgacgcctgtcggtcccaggaaaaggaacgatccgatcgggcgcttgggatcttttaatccgacgcggcctctccgcacggctttggccactgccgataccgcctcctcctgtccgatcacgcgcttgtgaagagttgcctccagctttttaagcctggcagcctccccctctgtaagcttcttcaccgggattttcgtccatcccgacaccacatcggcaatctcatcctctccgacggtctggtgatgccgtctgccgccctgctttgcctttgcgttcagtttttccaacttttcttccagttcctgacgctttgtctgtgcctctctcgccgcttccaggtctccgccggaaagtgcctgctccaatgtctcctgcgactccgcaatctcccgccggagttctgcagcctccctcgggtctccgcccacgtgaaggcgcacttttgccgcggcctcatccatcaggtcaatcgccttgtccgggaggaaacggtcgttgatgtaacgcgcagaaagacgcactgccgcctccacggcctcatccgtaatcgtcacatggtggtggctctcatactgtccgcgcaatccctttaatatggaaatggcttcttcctccgtcggctcctccacaacaaccggctggaaccgacgttccagagcggcatctttttcgatatatttgcggtactcctcgatggtcgtcgcaccaatcacctgcacctcacctctcgcaagcgcaggttttaaaatgttggatgcatcaatcgcgccttccgctccgcccgctccgatgatggtatgaatctcatcgatgaacagcaggacgtttccggctttcgccacctctgcaagcaccttcttgatgcgctcctcaaattcacccctgtacttcgaacctgccacaatcccggaaagatccagggagaccactctttttccaagcaccgtatccggaaccattccgcccataatgcgctctgcaattccctctacaatcgccgtttttcctacgccgggttctccgatcaggcacggattgttcttgcttctccggcttaaaatctggatgacacggtcgatctccgcctctctgccgaccaccgggtcaagctttccgtcgcgtgcaagttcggtcagatctctggaaaactgatccagtgacggcgttccctccgcgtttttccgcttgccgggtttcccgttctggaattcatccttatactggctcacatcctcgcccatcgcgatcagggtgtccacatacattttctgcacattgacagacaatgtattcaacagtctggacgccacacattccgtctccttgatcatcgcaattaaaaggtgttccgttccaatcttctccgagtggaaacgcgccgcctccgctttggatacctcaagcacatgcgccgctctcggggacaatccgtcctccagaaccgcaaccgcattccccggtgcaatcagctcctcgatcagttccagcaccttatcatactctacaccattgtcggcaagtacctggcttgccacaccggttccctctttcaacaggccaagcagtatgtgctccgtgccgatataactgtgatgcaatgactttgatatccgcgttgcaatatcaatcgccttttttgcctttgctgtatatgctgtctgcatcgctacctcctatttccagtccgatatcacattcgtctttacagatcattaaaatctatgatatccagctcatcgtcttgcttgtttttctgatctttgccgcctgaaactttttctttttcatcgtccggcgcatcgtcatccccgtacgcgtcatcatccccatacgtgtcatcgtcatccccgtacgcgtcatcatcctcgtacgcgtcgtcatcatcaaacagatcgtcatccagatcgtcagacttccgcttccagaaaccgaatctcttcttcggcggctcttcctcctcgatgtcatcctcatcgaatgcatcatcgaacgcgtcatcgtcagattcctgcgttttcgttttctcttctctctcttcctgttcgtcgaattcatctgcatccccggcatctgcagcagagcgcttcttccagtgccactttttccgggaatccttttccggttcctcgatcacatcatcctggttttcatccagcagttcttctgtatcatcatgctctgagacaccgtcatccataatgtcatcctcatccaggtcatctctatccgcttccctcctgtgcagtaacaggttaacaagtaccactgccattaccgccagcagaaatatcaatatgccaatcgcggttctggaaaacgctttttcttttttatatttctcggacagcgccagatattcctcctgcagataggccgcatcctcgtcctgcagtccgtcggaagatacagttgtccctgtatttacgcgctgataggtctcctctatggagtcgtactggtaccagccttccgttccgtcagaattcactccgtaaaaggtatagaactccgattccacctcagacccttcctcctgggtctcctgatatgccgtcacaagacttccgtccgccagcgtaagctgtgtctgctgcatcgtatccggcatcgtataatccaccggtggcagaagcgctatcacatagtgttccccattgaccatttttacaaacggatacagggtatctcttgtgctgtcatatacaaagaagcttcctgtgctctcttccgctccgtcctgcaccagataaagcatgaccacagatcccttgtcataactcacgccccgataatccgccccctgataattgacggttgtctccgaaaaatctgcaggaacattctctgttgcaaaattttctgcaattacataggaaatgccatttgccgtaaccgtgttttcactgctgtccgtctcctctgttgtctccacttccccctcatcggatgccgttgtctctccggacgaggttccctgctttgtcacattcacggtataggttgcggtcacgccattttccgccttgactacaatcttaatggtgttatctccacttttcagattggtatttcccgtaaccgactccacgaccgctttttcattgaccggtgtggcagatacggcgatattggttacatcgcttcccactgtagcactataagtcagcgttttcccgttaaatgccggcgagagcgttcccgttgaaatggtcaactctttcagagaattatccgcagactgttttcctgttgtctctccagtattcgccgcagaatccccgtttccacccgctgatgttccgtttccgttggaggttccactgttactgctactattattgcctgaatctgtatttgtacttgctgcattctttactgtgaccgatgcactgctgcccgacatggaatccatctcctcattggagtcaaagatcactccgtcgttggcagagacagagagggaggaatttcccgcactcacagcttttaatgtcaccgtgtagctttctcccgtcgccatcacgcttccgccgcctccgccgtatgtggtattgcaactcacaaactgcagcacactcgaatcataagacagcgtcatggtcgcattcgccttttcgccggatggaccgctcgcttttactgtaactgtaaccgtatcaccgatattgacacttcctgacgacaccgagacagatgttgatccgctcgccgcgaataccgtctgcggcactccgacaactccgaatgtcaggctaagcgccatcatcatcattgctatttttttcttcatttctgctctcccaattcttcctctcactgatcaatctgtgagattcccagtatgtgtttttgtaaaataaccagatccttattggaaataccgccgtccttgctgacgtttgccgcttccagacgactgccggactgactttcaattccaaggatctgtttctgcatcaataccagatccagattggaaacctttccgtcaccgttgatatctccatataccacaatctcatactgctgcacgagcgtgtcgccgacatacactgccagcttgttgcccgttcccaccgtctgtgtattctcactgccgtctgcattcagaatctttacggtacagttctgggttccgattcccgatgcgactgtggatgcgcttgttccaggctcaattcccgtcacataggttccgatcggataggatggcgtaatcgccgcgtcatccgccacctgaatggttccgccggcactgccccccgctcttgccacgatcagcgtataagtgcgcgaatctccgctctgcgagatgcaggtaatctgaatcgtattatctccataattcagcgaataatttccagtaccggaaacggttgacgttcccgccaccgccgtcgctcccacattgatcgaagccgcgctgtccggaacgaccagggaataggaggtattcgcaccggaaaatgccggtgtcagcgcatatccgtccaccgtgatcgaggaaagccagttgttcggattacccttgtccgcaaacgtcactgcgctctccggcatgttctgatagaccggaatgcggaaaacaaacgcctggttcttgtccgtgtaggcttttcccatattggtgccctcactcatcgccgcctgcacattggtcatgtactgatgtgcgtaaagactattggtatagacaacgttaaatttttcaaagtaaatggtattctgcccttttttcacataattatcagccacaaccgatgatccacccgcaatcgacttgtagatggagttccatccctgcaacttcgcatattccagtccgttcacaatcgccgacgcgctgcccgtcgtaaacgcacggacgttaaagtagttataatagcccgcatagttggaatatcgtcccgaaatcagatcgctcgtcccccgcacgccctgctcctgcttacagcgggatgccaggtggtaaggactcacgcccacattggagccgatctccacaaacgtatccgcatagctgcgaaccgctccgtccgtatcggtataattgcctgccataaatgtattggaaagaacgctctgcacacccgctgcgttctgatagcctgcatattccaacgtttcaaactgaaagatctgattctcgttaagaaaatttctgggatcgatgcagtatgcgatatattccggagacgccgacacccagcttgccccgtcaaacccgtaccacttgttggtctcccagttatacgcctgactgtccgtcgattttcttgcgtcattcacggaattctggatcaagtttcttccgatcagactctcattcgataccaccgtattccagtcaagtcccgtctgcaccggcacaaactgccagttcggatacttctgatgcagggatgccagtgcgctgcaatagcttgccggaaaacccgctgccgcaagcgccgcctcatactcgctgtccgtgacaccggtcgtctctccctgcgactggtcgtctgacgtctgaccgttcacggctacatagtccgcacaaatccacccggaataggaggcgcctccgaccacgagcgtcacactgtaccagttcattccgcccgccgagaccagctcgcccacattcacagcctgtcctttgtatacctttgtcaccacagagtaggacgttcccgctcccgagcgcacataaacacctttttccgtgttctgcaccaccccgtttgtcccacctgcactgctgtccgcattcgtctgtcccgcagaagaatccgtgccctgaagcgtcacaaaatccgagcgtatataaccggttacaccatccgacatctggatctggtaccatgtatacccgtctgatcctgccgtctcatcggttactgtcaccgcatttcccggatagagcagtgtcagcttatccccggtcaccggtgcgttgcgcaccttcaccggtccgtcgttgatcgttcccgccgtcgctgtgtacgcgtatacggcttcgggtccgtgaaaagcagatatgctggcagcaagcactcccatgctgattgccgccagcaatatctttctcttctttctatatataaagtggttcatcgaattcctccctgagtaccgcataagtccataaaatcatgcgcccaataattcagtctcattataggagattctatcacacgcgtcaacctaaatatagccattttcctgcacgctgtactatatttagacgtttttcgacaccaggttccggttctgtatcagcaggcttccccataatatgccccagagcccgcacacaattccggtaagcagtgcagcattgcactcctgaaactggattccgaacagtagcaccacacccgtcaccagtccgaacgctccaatcgccgccataagcgcacacaaaagtatcaattccatatccactgttttcatcttcttatcctccttttctaacctgccagatactgttcccactcctgcttcgtcatccacggccagcacgccttgtcatcgatatagacgtccgcggagatttttctggattccgttccatactgttccaacgtctgcgccacattttcatttaccgcatcaaattccagtccgaacattctgcaccaggccaccgcctcctccagcagatccccgcagcggcatgtccacaaaattacttttttgccctgccttctcgcacccttgagcaatgcaaagagcggcagattcggcatcccgatggcaggataacattcactgcacaatgttccgtcaaaatcgacggcaatgatctcgatctttttctccatgttcttccctccccatccgctttgatggtgtcagtatcgcacatgatgtgtccaattctttggacatttgttatgtaaacccatatttacaggacaaaaatcgtcgcacgaagcatagacctctttggggtgataagtaatattatgagaagaccgcaccgtgggatttcagatggaaatgcaggtggaaattcggttcaaaaaatgtggcatttctaaccagccggatgtttgcatctgcgatgatccgtgtctttccaagtttggagcactccgcgggtcatgtccgcatcccggagacaatttgtaggactttcgtgtgtgtcccttattggcacctctgaacaaaacataaccgcgcgaagccgatgtctgagtcggcatctgccttattttcaatagcagatgccggcgagtttcggttcgcgcggttttatattgtctgtgaagaggtgccattagggacaccagaaagtccgcccattgtctccgggatgcggacatgcacccgtcggattgtccaaacgtggaagagacacggaatccgatgcaaacattcagccggaagaaatgctcacatttttctccaacgaatttccatctgcatttccacatgaaatccccaagtgtgtttcctgtaatattacttatcaaaccaaagcacggtatgcttcgtgcgacacccccctttatctttatctctatacaatgtttttctgctatgcgttatacgccttcgccgtcaaacgccgggatgaagctctcttctgccgtctccccctcctgaataaatccctgctctacccccagtccgatcgcataatcgacgacctcctcatattcctcgtccgtgactttccggttcagctccgggtaggcgctgacattttccaacggcgtatactggttcatgatgctcagatatatctgattgccgtaggtttcatacaggtattttatcaccgccttagagtccctggtacagcccggcagcagcaggtgacgcacgataacgccctgtctcatcagaagtccctcctcgatcgggtcttctgcttcgtctccgtcaaacacgggtctcgggcactggcgcaccatctccgcaaccgccgctttggccacgtcggcataatccggagcgtgtgaatattttgcactgagcgcaggacttatatatttaaagtccggcaggtagatatccacaagtccttccagacttttgatcgtatccgcactctcataactgctcgtattgtaaacgacgggaagccgcagtccttccttttttgcacggcgcaatgcctccgtaatctgcggtgcaaaatgtcccggcgtcaccagattgatattattcgcccctttttcctgcagttccaggaatatttctgccagacgctccttggtaatctcctttcctgccgtcccgtttgcgatgctgcggttctggcagaacacacaatgcagggcacagccggagaaaaataccgcgccggagccgctttccccggagatgcagggttcctcccagtaatgaagcgccgcacgcgcaaccttcagctgttcggtctgtccgcagatgccgcgctctccgcccgcacggtccactgcgcagtttctaggacacaatgtacacattttcatctttccgtccgtctctttctatctaaattcaatcttgataatcccgcgtattttgggtatgataatgtttgatttccgaaatgaccattttcggaacaatctgacattgatatatttacacataaggagttcgttatgaatcagaaaaattgtatggtagcccagtccggcggtcctaccgttgcgatcaacgcaagtcttgccggtgtcattgacggcgtgtccgcctcttccatgtacgacaccgtttacggctcgctcaacggaatcaccggtattttaaacgatgaccttctcaacctcacggagcttatggacggtcatccggaatatctttcccgccttgcgcagacacctgcgatgtacttaggctcctgccgctacaaacttccccattatctggatgatgattcaccctatgtcttcatatttaagcagtttgaaacttaccacattgaagcgtttttctatatcggcggcaatgattccatggacaccgtgttaaagctgtccgagtacggaaaacgcatcggcagttccgtccgcattatcggcatcccgaagaccatcgacaatgatctctgcgagaccgatcacaccccgggctttggctctgccgcaaaatacattgcctcctcgctcttagagatcgcgcacgacacctttatctacgcggtcaaaagcgtgaccatcgttgagatcatgggacgcgacgcaggatggctgaccgctgccgcggcactcgcgcgcaacggatacaacaccgccccgcacttaatctatcttccggaagtcgctttcgacccggaggatttccttttagacgtcaagcgtctccttttcgagcgcaacaatgtcatcgtcgcagtgtccgagggcatccgcgacgcctccggcaattacatcagcgcgtccgagcagtccatcgacacgttcggtcacagtcagttaagcggcgccggcaagacacttgagttccttgtcaaggaaaagcttggtgtcaaggtgcgttccgtggaaatcaatgtcctgcagcgctgtgccgcacatctggcttcccagacagacttagacgaatctttcgcactcggcaaaaaagccgtcgcactctccgaggagggtgtgacagcttccatggtcaccatcgagcgcacttcaaacgcaccgtataccgtggattactcctatgcggaaatccgccagatcgccaacgaggcaaagagcgttccgagagagtggatcaacagtgccggcaacgacatcgaacagcctctgctcgactatcttgctccgctgattcttggcgaatcgcaggtctcctatcacaacggtctgcctgtatacatggatgtgagccacctgtctaagcactagacaggtgctccctattcccggagcagaatctcgataaatttaccgatctcgacccacgcttttctggattccggcagcatctttgctgccatctggaaaatgtggaacatcccgtcatagatacttaagcgcacttttacgccctgtcctctcgccttcgcggcgacatccacagaatccgacaacagcatctcatacgatcccacctgtatcagcatcggcggaaatcctctgaaatcgccaaacatcggtgatatatattcatccatcgggtcgtggtctcccacataatcccgattgtagatcaggctgtccctggtctttccaaacaggggatccctctcgtagttggtatcgtaagactccccgcttgccgtcagatccgtccacggcgacatggcaatgattccgcacggaagctgtctgccgtgattgatcagatagtggcagagtgccatcgcaagtccgccgcccgccgaatctcccgccacaatgatctgctccgaaaaccatccctgcgcaagtagccattcatacgcgcacacggcatcctcgagcgccgccggatacggatgctccggtgccacgcggtaatccggcgtgagcacgctcatgccgtggctgacctcattgtacaatccggcaaacatgcggtatgcattgcgcatcgccccgacatatccgccgccgtgcagctgcaaaatgattttgtcgcggttcgcattctccttcgactctaaaagctccatggtaaaatgttccatctcgatcgtctgcatggtaaagcattccggacacttccacggaggttccgccgttccgatctgtttgcggagttccccattttttatctttttcccaatcagcaaatcattcgtcgtatgcgcgatcagatccctcacgactctgccgcggatactcgcctcattttctctcattcactgtacctctgttctattttccgctgtcagaaaacagctgcgccgccggacagcaaaacagccgcgtcagcggacatgaaatcttcgccgcagttccgtccttgccctccggtctcctatgatcagcgtacccaaaaacagtgccgtagaaaatgcaaacgccagcaaggcaagaagcggcgccgtcacgatccccaccgcatacaagaccagcgggacaacgctgcagagaatcataaaaatctgccacatcatgtagctctgccagttgcgccggttgatgcacatcagaatgagaattcccgcatccactaaaagaatggcggatggaagcgcatagttgacagaccagccgcggtaccccaccacgaagtcaatcgccacaaccatcaggatggcgatcagcgtcaacacgatgatcttgcccttgtagccggattttcccaatatggcatagcgcagcaccagatagccgtacaacatcgccagccccggaatcgcactccagaacatctccgagtcgctgagtacattcagatagatcaaaagcgcctccacaagaatcgccacgaacagatagatgcggctaagcaacgccagacgcctcgtcatcgtccgcacattcggatacatgttttccacctcaaccgtcttctccagcaccgaatggcaaagcggacagcgctccgtctcgtctaatatttccacattacattgcttgcatctactcataatttactccattcgtctctatctcaaccgcaatcccgtctgccgcgatttttctgaaaaaacctctctgcaccgacgtgtcggtcagatcataactgaaactgaataccagcgtatccccgtaggaacagatcgttccctttaagtgctgccctttggacatggcaagaaacgcatggaacatctccacataaggacgatactcctcgcttacggagatattcccgatattggtcaccgtcgctgtgtttgcaagcgcagaggttgtgtatacatagcgcatcgccagatttttcaaaaacagcggtacgatacgcgctgcaagaagcttctcattggagacattgtaggaaaaaagcttctccagattctcccggctgatctggctgcgcaggctctcactgacactctttagcacttcctcaaatgtatagatctcctttgtcggatgaaattctgccgacaccatcacaaagaaattcttcgtcgtgatcgaattaaaataagggcgcagattgaccggcaccgcaacacgaaccggacgttcggaaggcatcccgtgcatgcactccgtgtagacgctccagacatataccgccaccagatactcattgatgctgactccgtacgcatggcagactttcttcaactccgggatcttcatgtagccgtgcatgacgccgaactctcccggcggcagcttttctccctttaaaagatatgcccgcttcgtctgataccccttctgggagctgtgcttgtaattcttgaggaagctgtcctcacggttcaacgaggtatcactgctcaaggaatctcccaccttttcgcgcagcttcggatgtgccagccgcagatactgataggtcagctccttgagaaaattgatgccacccataccgtcggtgagcacatgaaatacttcgagattgatgcggtatttataaaaggttacgcggaacatatagctgtggttcttattctgccggatatagcggcacggaaacgcactttcctcccgcacacgcggtgccggcttgccgttttcctcaaaataataccagaacacgccctggcgcagccgcagattaaacccatcaaacttcggcagcaccatatccagtgcctgctgcagcaattcacggtccaccagctccgtgagcgtcacgctgatgcggtatacattgctcatgctctccccggctatcaccggaaacaaatgcgccgtattgtccagacggtcccagcggatctccctctgtgcctctcttgcacggcgttttttcccttttacctggacagcttccttctgctcttcggccgctgttacctgatcctttttcttcatatattaaatgctcttttcctgtatagattctgttgcaattctgtcttacccgtagttccaatcttatcatacttcctattgtttgtccatgacacccacgcccgccattctttctaaaaatttcagactttatctcttgcattttattcgttttttttctaaaatatctgtgtggtatttggatataccagaaaagagaggctcacattatgttgtttaagaaattaagtgctccttctttaaaggagctttttgttgcagaattagagggaatgatattatccggaaagcttgagataggcgcaaaacttccgcctgagcgcgagcttgccgagtccatgcaggtatcgcgcgccgtcgtcaattccggtctggacgagatggagaaaaagggatttcttgtggtcaaaccacgaatcggcaccttcgttgccgactaccgcaaatacggtaccgcagacaccctggtctccatcatgcagtacaacggcggtatgctccgcgacaaggaagtgcgctccattctggaagtccgcatcatgttcatgaatcttgccgccacgctcgccatcgacaatgcggatgacgcgtccatcgccgggctcgagcagtatgtgaccgccttaaaggcatgcgaagatcctgaggaggctgcatcgctgatctttgacttcagccacgagctttccttcatcggcggcaattcgctgctcccgctgtttttcgcctccttcaaggatctggtgacaaacctgtgggtgcgcttcgccagcaagtacggcgcagcggcgctcgctgagagcgcggagcagattttcattcatgtgcgggatcgcgacaaagacgccgccatccgctatatcacggactccaccaacgaaagtattgacggctgccgccagatctatacgtaggcaccgcttccggtcggaagaaatgcacgcatttttttcaacgaatgttccatctgcatttccgcctgaaatcggttggatatgcctcttatcctattacttagcacgtcaaactaatctatgacgtctttgcaaactggctgttatacagcttcgcatagaatccgttcttttccagaagttcctcgtgatttccctgctcaatgatgcttccatccttcatgaccagaatgatgtccgcctcgcggatcgtcgagagacggtgtgccacgataaaactggtgcgtccctgcatcatctttgcaaacgcattctgaatcttgatctcagtacgcgtatcaatcgaggatgtcgcctcatcaagaatcagcatcggaggcaggcacagcatgactcttgcaatgcataacagctgcttctgtccctgtgacaggttgccgccatcctctgcgatcacggtgtcatatccctccggcagacgcttgataaagccgtgtgcatgggatgcctttgcggccgcaatgatctcctcgtccgtggcgtccggttttcccatcgcaatgttgtcccggatgcttccgctccgaagccaggtctcctgcagcaccataccgtagttgtccctgaggctcttgcgtgtcagctgctgcagcggaatatcgctgactttgatcgtgccgctgttcacatcataaaaacgcatcagcagattgatcagcgtcgtcttgccgcatccggtcggtcccacgatcgccacgcgctgtcccggcttcaccgacagattaaagtcctcaatcagcttctgctccggcacataggaaaaatagacgtgggaaagctcgaccttaccgtttgcatgctctaagtctaccgcatcctcggcatccggcacctcggcatcctcctcgatcagttcaatcactctgcccgcacacgcaagcgcgttctgaagttccgtgatgacgcccgaaatctcgttgaacggcttcgtatactggttcgcgtaggacagaagactcgacagctgtccgacactgatccctccggcaatcgccgaaaaagctccgacaactcctaccgttgcatagacaaggctgttgacaaaacgcgtcgacgggttggtaatgctcgaaaagaagatcgcccgcagagaatacttctgcagtctctcattgatctcatcaaacttctcgagtgcctcatcttcatgggaaaatgcctgcaccactttctggttgccgaccatctcctctataaacgcggtctgctctcctcttgtctccgactgcagcttgaacatggaaaatgtctttttcgcaatgaagcttgccacaaacagggagaccggcgtgatgaccacgaccgccaccgtgatccgcacgctgatcgtcagcatgaaaatcagtgttccgaagatggtcacgataccggtaaagaactgggtaaatcccatcagaagtccgtccgcgaactgatcgacatccgcaatgacacggctcacaatctctccgtaggaatgagcgtccagatatttcagaggaagcttttcaatcttctcgaacgcctccgtccggatatcccggatcacattgtaggtaattttattgttgcaggcattcatcatccactgtgccactgccgtcagtccgatgatgaccgccatctttctgagaatcacaaagatcccggcaaagtcaacggctccctttcccacaatccggtcgaccgcctgaccgatcagaatcggaagatacagggtaagcgccaccgtcaccgccgcgagaatgatcgatgctcccaggtatccccagtatcgtctgatgtatcgcagaaccttgcgcagcgttgatttttgattttcatttaccacttttttcatcttttcgcctctcccgcctgctgttcttctgtccgcttaaactgcgactcgtaaatctcgcggtatacctcgcagtccttaagcagatcctcgtgtgttccaagtcctacaatctctccatcgtccagcactacgatcttgtccgcctgcatgatggacgccgcacgctgcgatacgataaataccgtcatctgcccgtccatatgtgcgatggctttccgaagcgccgcgtccgtcgcgaaatcaagcgcggatgcgctgtcgtccataatgagaatctgcggcttcttcacgagcgcacgcgcaatcgtaaggcgctgtctctgtccgccagaaaggtttctgccgccctgctcgatctcataggaaagtccgccttccttggcatccacaaactcccttgcctgtgcagtctcaagcgcctcatacatctcctcgtccgtggcgtccgaattgccccagcttaagttctcacggatggttcccttaaagagaaccgccttctgcagaacaacaccaaccttcgccctgagttcctccaatgtataatcccgcacattcttcccgtcgacgagaacctctcctctggtcgcatcgtaaaaccgcggaatcagattcacgaccgaagattttccggaaccggttcctccgataataccgatggtctctccgcgtctgaccgtaaaatcaatgtcggagagcgcttcctccgatgcgcccgcataggtaagaccaaccctggaaaatacgacggcattctccgtcgggattgtctcttttccttccctgcctgctccatccgaagtgagacttcccgtctccgctgctggatgctccgtgatcgacgattccatgtctagcacagtctcgatacggttcatgcaggcaatggatttgttgatgttgataatcaggttggccagcttgattaactccactaagatctgggacatgtagctcaccagcgccacaacctgtccctgcgtaatgttgccattgtccacgcggatcgctcctacccataccagaacgacgatcgctccgttgatgataatataggtaagcggattcatgagcgccgagatcttgccgacatagagctggatctttgtcagcgcctcattgtcttcgtggaactgtgcaatctcatcctgctccttgttgaatgcacggatgactctgcttccggtcaggttctctcttgtgatgcccagcactttatcgagtgccgcctgtacttttttgtacagcggaatactgaccagcatgatgccaaacacaaccaccgacagcagcggaatagtcacaacgaacacgagcgccgctttcacatcaatcgtgaatgccatgaccatcgctccaaacacgataaacggcgaacgcaagaacaggcgcagaacgaggttcaccccgttctgcacctgattaacatcacttgtcattcttgtaattaacgtcgacgttccgacggtatccatctcggtaaatgacagcgtctcaatatgttcaaacagagcatgtcttaatcctgtcgcacagccaaccgccgctttcgccgcaaaatactgcgccgtgatggcacaggtcaatccgatcagcgccaggagaaacagtaccagactcatcttcataatatatggacgatcggcatttgccaccccggtatcgatgattgccgccatgacaagcgggacaatcaattcaaatgaagcttccaggagcttaaaaagcggtcctaaaatactttcttttttatagtttcccaaatactgcaataactttttcatgatactccttcgtgtcctatgcttttaaatctttcattttctgaagtccgataatcagcgcaccgccgatcacgaaaaacaggatgttaaaatcatgaagcgtcattgccggctgcggtacctccaacgtggtcggtcccatgacaaccgcgtagattgatcctaacatcagaccgatgatcagatagatcgtctgtgcccggaaatgatctaacgccttgcggatcagctttaccacaccaaaaataccgacgagaacgccgcatccgaaaataaacaccgtcggaaatgcagcaaaattcagatgaagaatatctttgatggcagtcaccaccggcagatacagtcccatgattaaaagaagcgtcgagcccgaaattcccggcagcaccatcgcacagatggcaatcattccggcaaggaatacaaacagggcaagccccggcgtcagatgctccaggctgacaccctctccgccgctgctcggattaaagtaagtaatcgcggtcacgattgcaacgccaatcagcacaaacggaatggcagattttttcgccgcaaggcagttcttttcttccctaaagataatcggaatggcaaaaataataaatccgataaacagggaactgattgcatagatatgagcgtcaaacacgctcgcaagaatcaggatggcgagaatcattccacagacccagccggttccaagcttaatcaggaagaacagagctgctttctttttctccctgcttccggttatcagatcgtcgatagaatcaataaactggtcataaaaacccaacaggaaagcgacggttccgccggatacgccaggtacactgtctgccagtgccatgcaaaatcctctgataaactgcactaaatacatcctttatacctcatttttctgttatttttctattttattcactacaggtcaaaatctgtccaattagtggatatactgctccagcttgtgcgactcgtctaacacactgtgaagcagatccttggtattttccgcattgccgagattcttaacactgagatccgccgcctgcacagaagaagctgtaacttcctccgtcgttgcggagagctgcatgatgttctccacgatctgattgttcgccttggagaggttgtttaacatagtgtcgatctcaccgatgtccgtcacaagctcattgacattctggttcatggcgccaaagctctcggatgcctgcgcaatcatctcatcctgcgcacccgccgccgtcacagaacgctccaccgcatccgccgccgtctgggcattttcagacagctgctctaaaatgttggcaatattctccgtctcctgcctggtcttctccgccagctgacggatctcgtctgcaaccaccgcaaaacctcgtcccgcctcgcctgctctcgcactctcgatcgatgcgttgagcgccagaaggttggtctgactggaaatagaaaaaatggtatctgcaatacttttgacagcgcttgtacgatcctggagttctctcatagaggaagccacctcggagtttgtctgtgcaataactgcggactgcttcttcagatcatccatgattctggaactcttctcattcagctctccggactgcttcgccacctgtaccatcttctccgaacgctctaacgtcgttccgatggagtcctgaatattctgcgtcatctcggtctgcgtctggatattctcggcggtactctgtgtactgtccgaaatatccttcatggcaccgttgactacctcggtggaactattcagttcattgacaatattcatcgcattctctgttcccttgcgcacctgatctgcaaccgcaatgatatcgtccaccatctggcgctgtgctgcttccttttctgtcaggctgccaatcgtatcgcggttgaactggtacgccacggatactgtcagataaaccactaccatcataagtataattgccagcgtcgcacaccactgatccagtgcattctcgccctggtatgtgtgaagcgccagcgtctttgacgccgtcacaagaagattcaccgccgatacagcaatcccggaaaaggcggcaaactttttatcgtaaaacagaatacatgcaaccaacggaattgcagccataaaacgcacataataattgtcaaacgcccatcccatcacaaacgtaatgacaagcagcccgaccgtcgcaatatagcggatcttcggatcatcttttctccgctggtacaacacgagtgttcccgctgttgccagaataatcaataccgcgatcataacggtatatccaactgtgcggattcctctgaggcaggcaattcctaccacacaaagcacacagagataaaacacgatatatccgatagccaggaaatgattggcacgtttattctgttccacagtatctgcatacaaatgcttctgttcctttttctccataactttcacctttcttctttcgataactccatataccatttcaatatatcatactttatccggcatgaataatattttttcaatttttatttcttttttgatgttttatctgtcccttttccacagtctgtggcaatttcgcctcgcagcatccacagacagagcagattcggcagagccatcagggaattcagcagatccgatatcccccacacaagctccatggaaagcaccgctcccagataagcgaaaaacatgtacgccacctggtagacacgcacccccgcctcgccccacaggtagcgcaccgcgcaggttccgtacacgttccagccgatgatcgtggcaaacgcgaacagcgtcagagagatcgagagcatccactcaccgccgacgggcaattcccggaatgccacaaaacacatattttccggtgccactccccggtattcctgcggatggcttaccatgctgccgaccgccgcaattcccgtgatcgcacataataccaccgtgtcccagaacggtcctgtcatggagattaacgcctgccgcacagccgcctccttcgggctgtcagaggaggatgctgccgtcgccgcgaccatcggaatcgagccaagccctgcttcattggtaaacaatccccgggagactcctgtctggatgccaagaagcagcgctccgccggtgcagccgcccgccaccgccttcgggcagacggcggatgagagaatcagcgctaacgtctccggcagcaccgccctgtttcttcctataatatagagacagccgcccacataaaaagcgctcatcagcgggacgagccacatacacacctttgcaatctggctgtttcccccgatgataataatccctgcaagcaccccgaccgccattccgaccagatgcggcgacacggtaatctgatgctggagcgccgtgcgtatggagtatgactgtacgctgcttccgataccaaacgatgccagcagcgtacatacagcaaacgccgctgccagttttctttttttcagacgccgatccaaaatatacatcggtccgccggcaaacgtattgtctgccctgcgcacccggtatcttatggagagataacattccgcatagcaggtcgctatcccgaataccccggtcagccagcaccagaataccgctcccggtccgccgatggcaatggctgtggaaattcccacaatgttacccgtaccgatcgtcgctgcaagcgccgtcgccaacgccgaatacggtgttacctgatccttttcctgattcttcgttccggtcagtgacaaccggattcccaacgggatttttttctggatgaagcccaggtgaaatgtgaaatatagatgtgttccgaataagagtgcaagcatgggaaatccccacagatattcccgcgccaccgccaccgcatgctgcaataatgccataaaaattccccatataccctgcatcacaaatatctgtaaagtatatggggaatctgtttttcccatgcattcgattgttctatgcttctaccagatgtgcgattgcatgtaccagctccttgatgtcatagttggaagtattgatacacagatcatagttgagacggtctccccaggtctgtccggtaaagaactgatagtaacgcgccctgcgcttatccacgtctaaaatatggcgctttaattccttgtccgtaaagtgctcgctctccggcgcgcgcttcttgcagcgttccatcttgtgctccatctccgcatagacaaacaggcggaacggatgcttctcgcgcaaaatataatcggcgcttcttccgacgatgacacagtcggacttctccgcaaattcctgaatcaggcggctctgctcacggtagatcgcattattctgctccatgattggatcaactcccatgtaaaagcttctcccgatcgtaatcggatacaacgtcgacggaccgttctccatcacatgctgcacatagccctccgccagcttcgtacggtctgcaatctgactgatgatctcattatcgtaataagcaattcccagctcatcggacaatctctttccgatctcacgtccgccgctgccaaattctcgtccaatcgttataatcctagacattggtatctcctttcccctgtgtggggtttgtttttctatctaaaactatagcatttcttcctgcggttcgcaactgcaaaagctgccgccgcagataatagccgatccctgccgcatcatctgcgtctgtttgcctccctgacgccttttcttcccggcacggctacttgttcagaaagcggtcccaggacgccgtattgtgtgtgccagacatcgcaagcacatactcttcctcatcgggcgcgtcgatctcaaatacatagttctccccgtcctgctttaacgcatagagcgtgccgtccgcaaaggagcggatcgtctcgttccacgccgcctgatcgatcacctcatccgcgcagtttttcatcagtgcgccgttggcgtcgtagaccttgtatccctcccgcaccagtgaccggatgaccggctcctcgatctttaacaccagattgttcgcgcgcatctcgcggatatcccggttgcaggaattctccggcaatatcgtcacattggagagcgtcatatggaaaaatccgtctgccagctgcacgtcggcaatgtaggcttccgcaaaagaaaaatgttccagttcatctgttgtcgtgtatttcatagtgttcctccgtatctcttccctgttatttctcctcccctattatacagagccgtccccgttttttccaccaaaaagagtaacattgtctatgtctccggcatggaaatcttatcgagaatccccgtcagatgcgcgatcgtcacgccgtagttcgtcatcggaacgccctgttctctggcgtgcccgatccgcgacatcacatatttgcggttaaacatgcacgcgccacactggatgatgagatcgtaaccggaaaggtctttcggaaagtcagtcccgctcacaatatccacagcaagcgactcgccgaagcgttttctcaacatccgcggaatcttttcccttccgatgtcctccttcagcggtgcatgggtacagcactccgcgatcagtatcctggaatgggcgttcagcgcgtcaatatgctccgccccctccacatagtacggcagatcgcccttatatgccgcaaacagcacggaaaaggacgtgagcatgctctccgccggtttgttttcgtagacatagccaaatacctgggagtccgtaatgataagcttcggtgcttttttcaataccgcaagcgccgggatgagctgatcggtcgtcacgctcatgaccaggcatttcttatcgagaagttcgcgcagggtctgcacctgcggcagaatcagccttcccttgggtgcctggatatcctgcggcatcacgagaagcaccagatcctcccggccgaccagtgtcccggtgatgaggcggctgccgtaattctccggcagtttgcggatcaatgcttcttttaatgcctccatgccctctcccgtcttggcgctgaccggatatgcctcctcaccggtcttcccccggatggcggctgccagtttatccacctgtgcgtccgaccggatgtccgttttccccacgacgaaaagtaccggcgtcccgtgctctttcaaaaagcggtaccagtgcatttcttcctcatcaagcgccgcgtcaccattccccgccacaaggagcagcgcaatatccgtcttttccgctgcgagacgtgtcttttccatgcggcttttgcccagttcgctctcgtcgccaaatcctgccgtatctatgataatgcacgggccgagcggatgtacctccatcgccttgtagaccgggtcggtcgtcgttcccgccacattggcgacaatggatacctcctgtccggtaaaagcgttgatgagtgcggatttcccgctgtttgtttttccaaatattcctatgtgcagacggctgctgcccggcgtctcattcaatgtcactgccataactttctttttccttcctgcatacgaatttccccttgtccgtattacatccatatccggcttccggctgctgcccgatcccagcatcgcttccggctatcagaagcggaagtctctctttccctctgcaatatcatgaatgtgctcgtaggcggtctgctttaccttcggattcggaatcttctcaagctcacggtcaatcagttccataccgatctttttcgtctcctcgcccgcataatcctcgaggtattcttttaaggtcatgagcgcgttcgggtgacagcagtttaagatctgcatatttttgcagagcgccataaaacggtcaccagttctaccctcgcggtagcatgcggtgcagaagctcggaatatagcccattttcatcagccagttcacgacctcatctaaggtacgctgatcgctgacgtcaaactgctcggaattctcctcctccggctccggctcggcataaccgccgacactcgttctcgatgcaccgctgatctgcgatacgccgagcggaagcactttctcacgcactgcctggctctcgcgtgtggagatgatcattcccgtatacggcaccgagatgcggatgagcgcacagatctttgcaaaaatatcatcgctgataccgttgtcaaaagcagtcggatcaatgtcatcggcatgtttgacacgcggcacgctgatcgtgtgcggtccgacaccgtgcacggcttccagatgctccgcatgcatcagaagtccggcaaattcatagcggtacatctccagtccgaacagcacgccgagtccgacatcatcgatgccgccttccatcgcacgatccattgcctccgtgtgatacgcgtaatcatgcttcggcccggtcggatgcagattctcatagctctccttgtggtaggtctcctgaaacaggatgtaggttccgatgccggcttcttttaacttgcggtagttctcgaccgtcgttgccgcaatgttgacgttaacacggcggatggctccgtttttgtgcttgatgctgtagatcgtctgaatacactccagaatatattcgatcggattgttcaccggatcttcgccggcctcgattgccagacgcttgtgtcccatgtcctgaagtgccgtgacttccctcacgatctcctcctgcgtcagcttctttctggcaatgtgcttgtttttcaggtgatacgggcagtatacacagccgtttacacagtagttggaaagatataacggtgcaaacagcacaatacggttgccgtaaaagtctttcttgatctgctgcgccagcgcatagacttcctcgattttttccgggatctgacaggcgagcagcaccgatgcctctctgtgatttaggcccttgcgctctcgcgcttttgcgatgatcgcgtcgatcagttccacattgtccttgttcgcatccgcgtaggcaagcgtctcccggatctcctcatcgttgataaattcctctgcttttaatgattttgcgtcatacttgtacataatttttcctttctttccggtcagttcatgcttcccggtcagtgtttttattgtaaaccgcaggccggtaatccccgcggtcggtaaccacttcataaccgatgttctccatccgcctctgcatgcagaaacgacattctgccgcctcatcccccgtacagatcttattgtcgtaaagcttatatttttcccgcacggaaaccggcgaaagattcggcatcaccacattggcgccggagagaattcccatttcccttccctgcgggtggatcgtgccgagcgccgtcgtcgccggaagcagcacatgcggattcatcagccgcaggatggaaagcagccgcagggtcatctccaacgtccccgcagtctccccgccaaacggcgtgtccttctgcggaatgaacggtccgattcccaccatggcaggcgcgagtttcttaataaacatcaggtcttcatacagcgtctccgtggtctgatacggcgagcccaccataaagccgcatccggtctgataaccgatctcctttagatcccgcagacagcgcatccggtttttaagagacatttcctccgggtgcagcttcccgtagtgtaccgcatccgccgtctcgtgcctgagcagataccggtctgcgccggcgtcaaaatatgcctgatagctcgctctttctttttccccgatcgagagtgtcactgcacagtccgggtatgcctgcttgatggcagacaccagaccgcagatcttctcatctgtaaaatagggatcttctccaccctgcagcacaaaggtgcggaatccaagttcataccctgtcgcgcagcaggagaggatctgctcctctgtgagacggtagcgctcggcacatgcattgcccctgcggatgccgcagtaatagcagtcatttttacagtagttggtgaactcgatcagcccgcggatatagatctgttttccgtataccgactgtgccgccattctcgcctcagccttaagcttctcgactgtctctgtatcttctgttgtaagcagacagtccagttcacccaccgacagcatcttctccgtcttcaggtgctctatgattttttcctcgtgtgtcatataaatctccattccgcagacgcttatacattggaatagacggtctttgccgtgattcccgccagccgtccgatctttcccgacaatgcattgatgacatcctgcggtgcatcgatggcaacgctgataatgtgaacatttttttcccggtaagggattcccattctgccgatgatatggctcccgtattcgtgtagcagatgattgagctgctccacggactcggtgctctccacaatgataccgataagtgcaattcttgtctccatattttctcctactgaaaaagaatcctgcctgcgggattctccgcctgcggcgggtcgcaaagcgatattttccttaccgcgaactgcgcatcctcgcggagcgttttttatttcattaggaaagttccactttcacacatgaatgtatcacggtatttcctatgaaaataaaaaaaccgtatctgaaatctcctctcagatacggcactcgctggaaatacacggcagaacctgccctacagggcatggaatattccgccggtatcctatctacagcatctgctccgcacgcgcagaccagatgcagacactttcatgaccgccatatcttccgccgcaagcactgcttttggcgtcagagacttttgttaaggcaagacagcaagaacgtatctcactgcaatgctgtttcagcgtatcatgaagtctgttcccgttcaagatcttttgttgtattttttgtgaaacaattcacaatcttttcttttccggtggatcagaaaccggttacacggataggtccagagcatcggaatcagcattccgatcaccttgattaccatgtcgcacaaattccccgtccagccgttttcccttgcccaggtcgtcatcgccgatccgatccagccgttcgcaaaaatcgtgaacagtaccatgaccgcatagagtgccatgctgaccgccggattggcgtccgccttaaaagtaatcttgcggttcaatataaaggcaatcgtataacccacggtcgtcgagatcatataggtatacagatatcccttcgacgtaatgccgatcaggttgagaaaatgcgcggttaccggttccgccgtaagcgcagcaaatgccgtatttaaaagcagcatatgcaccgctagctcaaccacattggaaccgcctcccgcaagcaggaatttcataaacttccacagttccgcatgtctgtcggttcacgccgcaaatccgcttttctcctgtcgtatctcacccattgttttccccttttctgcacggtatttttcttccctggttgctcttgttctgccgagtgctttccggctttccccatccctctacaacaacaagactgccagcgcaatcacaagcgccagaaacagcaccgcttttaaaatcatcggaatcgccgcctcaaatgtggcaggtgctttgctggtcagatagtcaaataccgggcgcgacacttttttcccgaccagttcctcatacgttctggtataagtatggtattcacacggctttttttcgttcagcacaatacagcgcacgccgcgcttcgtacggttgccgtagacattaaatcccgcggacggtgtaaatccaagcgcaatgttccggtaacgccccacgaagttgttcttatggtcgtgtccgacaaataccgccagcacttccccgcactccgaaagcgcctcaaattctccggtattgacatccggtaccgacggcggttccagaaaaatatccccggcgccgcaggtttctcccaacttataatattcgttcttatgtgtccgataggcgcgcaccgcacctttttccccgcggtcgacacgctttaacacctcataatattcgcgcatcgggatatgttgaaatacgaaggacggcacatacattccgtttttctcccgaaggtcttcccgctgcttgcggtaccacgcaatgatcttcggatcaaatgcctcgtagccgccctccctggcatccgttccgctgtcaaacagatacagttcaaacacatccctcccgcttccgtcggatgcctcgatgggaatggcacaggttccgcccccgtcaatcccttctgcctgctccccgatgcaattcggaagccttttgtaaatatgatagaactgatcctgattggaaattccaacctggcaatcatgattgccaaatgtcactgcaaacggaatgccacgctttgtcaccggctctaataattttccaatcgtctgtgctacctcccgctccagctcctctccttttcccttgtaagtcacaccatagcccttgatctgatcaccagtgtagacgacaagatccggctgctcctccagaatcgcccgctccatcagcgcgatcgtgtctttcgatattgcgggaatttcctgcatatctgtaatctgcatgattttaaaagtaccgtcttctcgaaatctcattttcatccttattctccgtgatgtaaaaaagggagactgcgcccctgcatgtctcccttgaccttttcttagttatcttccccaaaatgctgttccagatctgccgataatgatgaaatctcatcgatttcagccgaaatgctgcggatggaatcattctgcgacgtgattgtgtccgtgatattctggatggttgcagaattttcctctgaggttgccaccagcgtctcgatctcctgctggatatttccaaagtgttccttcacatgttcaatgatcttatattcttcatcgacaatctggctcgcctcatccgtcgcatcattgatgttactaaaataatccatcaatccgccgaccagctccacactcgcggaagcagcatcggtgcccgccgtgatttcttttgagatctgcccggtcgtatccgtcagccaggtcaaaatctcctgaatgttgttcgccgccttggcactctcctccgacagcgcgcggatctcatctgcaaccaccgcaaatcctcttccgtgttctcccgcacgcgccgcctcaatagatgcatttaacgacaacagattcgtctgggatgcaatggaattgatctctccgagaatcgatgtgatccggttcatctcggtaagcagcgagtcagtcgatttgcgcgcagaatcaacggtttcctccatggaaagaatggaactctttgccgtctgtatcgctccgtttcctttttctaccgcactctgcaccttctgaaatccctgatccagagaaactgccagttcatggttccggttaatctccgttgttgccgcattgattttatccatcacgctgacggttgcattggcggtatcctcaaccacctgccccatctgcgatgccgccgatttcacgctggagctgccgtccgcaagcgcatgcactgaactcatactcttgtggatcgtggtgttcagattcgctgaaatcgtattggcgactttcgcattgttctgaacgatggaaagcgtctcttccgttttcttcacaacacccgcaccgcgcttcgtcgcaaaataaagcaggatcgctgttacgataaacaaaaatatacgcgtcacgacccccgccatcgtgtattcaattcccgcgatggtctcggggctgaaagccatgaatacgaccgaaataacggcaaacggcactgcgaaatagatgataaccgactccataaaataggaagttgtcatcgctaaaagtacaaaattcgccagatacggaatcgaattgccaccatatacccacgaatacaacagcgtaccgatcgccggcggaaatacaagaatcagcacttttttcgcatcgtcaatcggaaggtaacatccaatcgtagaaataattcccgcaactaccagaattgcaattccacggattgcaagcacggtaaatccgtatcccatcaaagaaacaaggctaagtgcaataatcgagcaccagacaataaccaaattctgcctgtgcaatttttccatatcatgttcccttctaaagaaaacctatcatcatgtacgcgtctattatgtcatctttttgcgctgctttctgcgcacaatatgaactcgtcagagttcattataccgcaagatcagatcaagaacaatattgcaacttcaggctttttcggtaacttcaggctttttcggtaaatcctgaggttgacacgatgttttcggtaaattctgggacggacaacagtttctgcaaccccaaggcggcgtgatcttttcttctttttcgggtctaacgtggcgttttccttcttccagacccggctacgacttatttttcggcgttatgtaaacttctttctctcccgcaagggtctagcgcgcgaaaatcagtctctcggacccggcttgtctttcttcccgggtctggcgcggcattttctttctcccagacccgaccatgacttgtttttggcgttatgtaaacttcttttcctcccgcaagtgtctagcgcacgaaaaatgggctcccagacccggcttttcttccttcccaagtccagcgcacgaaaatcaggctcccagccccaacttttcttcctccccgcatccagcgcacgaaaatcagtcacacagcccgtccaaagctcgtttttcgtcattatgtaaaccttttttcacgcgccacgcattacaacgttccaaacgaatacccctgcgtctgcgccgcatcgatcagatctcccagcaccgccgcatttgttgccgactccgcatgcagcagatagatggctcccgggtgcatcttatttttcatcttctgcaggctttccgcctgatccggctggttgtccacatcgtaatccagataggcaaaactccagaacacgctctcgtatccgcagttatttacaacggcgagcgactgctcactgaactttcccgcaggatagcggaacagattcatctcatatccaaaggtatctttgatatactgatgatttcccatgacctcttcctgctgctgttccactgtcagcgaagggatgccagccgacgggtgcgtcacactgtgattgccgactacatgcccctcgtcaatcatgcgctgcaccagtgccggttccgcctttgcataaggctccgtgacaaaaaagacggcatgcacgcccttttccttaagcgtatccagaatggattccgtgtacccgtattcatatccctcatcaaaagtcagatagagggtctttgtattctctccaatgaaaagcgcatggtaatccccatacttctgctgcgcactgactgcatcgttcgggcggttgtccgcatcggtgtggcttcccagcccccagctctgcacggtggtatccagcccgtcaagcgcaatcgtctgcaccgccgcatttccacctgcagcactctgaccgtctccggtgctgcttcctgtttggtccgccctctgtccgtctccggtgtcatttcccgttccatccgtgccctgatcgtctccggcgccgtctcccgttccatccgtaccttgaccgtctccggtgccgcttcccgcttcgcctgcgccctgaccgtttccatccgtaaccttgttggcacggtatgtctccgccgttgcaagcactgcgtcaccgatggcggcagcgtacgcatccagcttttcatcgaaaagctggttatcggatgcatcgttgataaatcccatctcgacgatgcaggacggcatgtccgaatgtacattgatataataattggaggattctccagtctgggttccctttttcacgccgcggtttctctggattcccgccgtatccagcacttccataatgtggtttgcgagggcatccgtctcctccgaaccactcgccgagatccaggtctctacgccgttaccctcgccgtcattgcggtgcagcgacagcatataatccgcaccgctctgattggcaatcccgcaccgctctgacaggcgcaaaaacgtgtcatccgacctcgtcataaccacttttacatttttatcagccaaataagctgacacagcctgtgccagctttaaattatcatccttctcataacgccccttataatcggagccgttgtcttttccgccatgtccggcatccacgcacacgatcaggggattctcctctgttttcgtctcctccgaccagattacctctccctcaatctcctgcgttgcagactgcgttccctgcatcagggacagcccccgtcccaacagttcaaaccctgcgatcacgagcagcattttcacaatactgtactgtatacataccagattccgaattcgtcttttctgtctctttgttacattcacatcacttcactccttggattcctacgattctattttagtcctctttccgtgaaaacgcgaatgaatctttatgaagaatttcttaatatgaatccgtccggattcatcgttctaaagtaaaaactgtgccagagcgtaattgctcacatcctgcccgcgttccgtcaaataaatcctccccgcgcgtttttcgagcagtccttcctccgtaagatgcagcagcacctcctgatacactgcctcaatctgtgttccaaacgtctgtgcaaaacgttccctggaaattccctccatcatgcggagtcctaaaaacataaactcttccatctgcccttttcgtgtaatgcgctctgccgaagcatgcagattcgtggccggaagctgttccaccctgccggatgcgccgctcccctggctatccgttatctcattctcccagataccctcacgaatatgtctggtttcttccagatacacatacaattcccgcgtgttgctgtagcggatattctccatcagagacgacgcgccaagccccagtcccagataattctcccgctcccagtagccgatattgtgccggcacgcataacccggttttgcaaaattagaaacctcatagtgcacatatcccgcttccgcaagcacctgctcggtcagcttggtcatccggtacacttcatcctccgtcggcagcgccaccgtctgcattcccgcctgctgcttgaccgcgtcaaacttatacagatcgtaaaatggcgtccccttctcaatgatcagggaataggcggaaatatgctccggtttcagccacagaagctgctgcagggtgcgggcaaaactctctgccgtctgtcccggaagagaactcataatatccacattgacattgtcgaatccgtttttgcgcgccagctcgtaagtcttcaggaactggtcaaacgtgtgaatccgcccgagaatctttaattcctcatccacagccgactgcaggccgatgctgatccggttgattcccgcattccggtagccggcaaacttgtgatcggtgacggttcccggattgcactcaatggatatttccgcatccgacgccagacgaaacgaccggcgaaccgccgacataatctgtgccatccactcctctgtgagccacgatggcgtgccgccgccgatatataccgtcgataccaggtagtcgctgcaatgcggtccgtaatacgcaatctcccggagcagcgcctccacgtaggctgcctgcgttgcctcgtccgccgcaaaggaaaggaaatcacaatactggcattttttgacgcaaaacggaatatgaatgtacaattccattgttttctgactcactccacacgccgctcctttcccaaaaatattcctgacactgccatcactgacgctgcattttccgatctgttcctttaatcttcatccagcttcaagacgctcatgaatgcctcctgcggaatctctacatttccgacctgacgcatgcgcttcttgccttccttctgcttctctaaaagctttttcttacgcgaaatatcgccgccgtagcactttgcaagcacatccttgcgcagcgccttgactgtctcacgggcaatcaccttgccgccgactgccgcctggatcggaatctcaaacagatgtctcggaatctcttcctttaacttctcgcacatctttctgcccctgtcgtaagcactgtccttaaagacgatgaacgagagcgcgtccacctgctccttgttaatcagaatatccagcttcacaagctcggaacgctcatagcccttcagctcatagtcgaacgaagcgtatcctctcgagcgggactttaaggcgtcaaagaaatcgtagatgatctcattgagcggcagatcgtacttgatgagcgcacgggtctcctccagatactccataccgttgtatacaccgcgccgttcctggcaaagcgtcataatcgcgccgacatactcgctcgtcaccatgatctccgccgaaacgaccggttcctccatatactcgatctcggacggatccggcagattagacgggttcgtcagatcgatcacctctccgttcgtcttgtgcaccttatagataacgcccggtgccgtcgtcacgagatccagatgaaactctctctccagacgctcctgcacgatctccagatgaagcagtcctaagaaaccgcagcggaatccgaagcccagcgccagcgacgtctccggttcatactgcagcgacgcatcgttgatctgcagcttttccaacgcatcgcgcagatccggatatttggcactgtccgccggatacatgccgcagtataccatcggattgacttttttataacccggaagcggctcctcacacggatgtgcggcgttcgtcaccgtatcacccacgcgggtatcccgcacatttttgatgctcgcacagatgtagccgaccatgccggcagacagttcgtcacacggaatgaactgccctgctccaaagtaaccgacctcggtaacttcggactgcgccccggtcgccatcataaggatcggatcgccgacccgcaccgtgccctccttgatccggcagaacacgatgacacccttgtaggaatcatagagtgcgtcaaagatcagcgcctgaagcggcgcttttggatcgccggccggcgccggaatcttctgtacgatctgctctaacacctgatcgacattgagtcctgtctttgcggaaatgcgcggcgcatcctccgcctcgattccgatgacgtcctcgatctcctttacgacctcgtccggctgcgcgctcggcaggtcgaccttgttgatgaccggcattacatccagatcatggtctaacgcaagatacacattcgcaagggtctgtgcctccacgccctgcgccgcatccacgaccagaatcgcaccgtcgcatgccgcaaggcttctcgatacctcgtagttaaaatcgacatgtcccggggtatcgatcagattaaaaatatattcctcgccgtcgttcgccttgtagataatgcgaaccgcctgcgacttgatcgtaattccgcgctctctctccagatccatgttatctaacacctgcgcctgcatttccctgctggtcaaggttcctgttttttctataatacgatcggcaagtgtagatttaccgtgatcgatatgtgctatgatacaaaaatttctgattttactctggtcaatcgacattcatttcctcctgcccggtgcgcatcacttctgccctccggcagccacacgcatcacttatctgcaatattataagggataaaaccggaaaacgtcaagggaatcgcggttcgcaaaaaccacgcaatttatttgcaaaccgcgcatatatgagcaaaatttcacaattttacactggatttttccccagaatatgatatgatatcaacgtcgatatttatcggcatgggttttggtgaataaaccgagaaaacccccttcttaagcgaagaccccctgctacggtggctgcaaacaccataacaggggttcttcttattttatgtatcatatgataactcagatatcttttccaaagtcaagaccgctcttctcgcgcttctcttcctgcagtgcaaccagatccgccagtgtgatatgatccacgacatcgctgatcgcctggttcagccgcttccacacctccacggtaacgcaatccacttcgcgttcgcaacttccttcctcctccacgcaggcaaccggcgcgagcgatccctccgtcagacgcaaaatatcgccaaccgtgtattcctccggtgctttccgcagcgaataaccgccctgcggtcctctggtgctccgcacataacctgccttgttcaatacggatatgatctgctcaagatatttgtctgagatctgctgtctttccgcaatatctttaatgcgcacaacgttgttctcaccgttcatcgccagatccagcatcaggcgcagcgcatatctgccttttgtagaaattttcatattcgttcacactaacacctttcctgcttctgccagtccagaagatcctgcaatgtcacatgatcgaccacgtcccggatcgccttatcgactttttcccagagcatgatcgtcgcgcatttctgctgtttggggcagggattctcggcgttcgcaagacactcgaccggcgcgagcgatccctccgtcagacgcagaatatcaccgatcacatattcgtccaacggcttcgtcagacggtagccgccctgaaatccccggctgctggaaacatagcccgccttgttcagaatggaaatgatctgctctgtatatttgacggaaatctcctgtctcgttgccatctccttgaccgacaccggatgctccgtgccgttgaccgccagatcgtacagtatgtggatcgcatagcgtccctttgtcgtaattttcatgctatcgggcccctttcatcctgctggcttcaccgaacagctcttcaaaatcctcttttaagaagcggtgataaaacgcatgtccctcgtcgaacttgacgcagtacagataagaatccggattgccatcctcaaagtagcacacgtcatcaaattcatcgcttttgatctcaatgatacgagcactcttagaatagtgccggaacagctcccacacctgctctctcgtcacatcatgtctgccgaagcagtcaatcagatcctttaagaacggatgcgccacgccgtgcgcatgcacatactccgcacccgctgcaggaatgagaaaacagattctcccgccgctcgccccagatactgccacttcaccgagggtatccgccgcatatgcgccaaatccctccagcgccgcaagaaccgccggcttggagcggtcagacagctttaacacatgtccgattgacgacgatggtgaataaaaccggatcgtctcacgctcatagccgagctttagctgttcctctaagatcatgtcgcataaatattcttttaatgccgtatagtccgcttcatcctgccgattcattcttagtaatcttcctcttccagaccttcgctgatatcgttcttcggcttctcaagaccttcgatcttgatgttatgcttctctgcgtaatcccagagtgccgcatgaattgcctcctctgcgagaagagaacagtgtacctttacaggaggaagtccgtcaagcgcctccataactgccttgttcgtgatctgcagcgcctcgtaaatggtcttgccctttacaagctccgttgccatactgctggttgccacagcagcgccgcagccgaatgtcttgaacttgcagtcacggataacctggttctcatcaatatcgagatacatacgcatgatatcgccgcactttgcatttccgacggtgccgacaccgcttgcgtcctcaatctctcctacatttctcgggtgctgaaaatgatccataaccttttcactatacataacatatacctgctttcttttttatattatttgtttttcttgatgaaatcctcgtacagcggagacatctctcttaagtggttcacaatctcttttaagttgtcaacgacgtagtccgcatcctccatcgtgatctggtcgctgatggtcagacgcagagaaccgtgtgcaatctcatgcggcagtccgattgccagaagtacatgggacggatccagggaaccggatgtacatgcagaaccgcttgatgcgcagattcccttggaatccagaagaatcagcatggactctccctctacgaactggaagctgaagttcacgttgttcggcagacgcttcacacggtctccgtttaactttgcatacggaatctccttctcgatgcgctcgatcaaatgatctctgactttgatctcctccgcagtgcgctccttcatgttggccgtagcgatctctgctgcctttgcaagaccgatgataccggttacgttctcggtacctgctcttctgtggcgctcctgtgctccgccgtggataaaggatttgatcttcacaccttttctgatatataagaaaccgattcccttcggtccgttgatcttgtgaccgctggtgctcatcatatcgatattcattgcctcgacatcgatcggcacctgtgtgtatgcctgtactgcatctgtgtggaacagtacgccatgctcatgtgcgatcttaccgatctcagcaatcggctcgatggttccgatctcgttgttcgcgaacatcacggagattaagatggtgtccggacggatggctgcggtaagctcgtccagctttaccagaccgttctcatccacatccaggtaagtgatctcgaagcctttcgtctccagatactcacaggtgtgaagaatcgcatgatgctcgatcttcgtcgtgatgatgtgctttcctttggacgcataggcatctgccgttgcctttaatgcccagttgtcagactcggaaccgcctgcggtaaaatagatattctccggcgtggtgttgatggtcttcgcaatgacctctctggcatccgtgattgctttcttattctcagaagaaatgctgtatatgctggatggattaccgaacttctctgtaaagtacggaagcattgcatcaagcacttccggtttgaccggtgtggtagctgcgttatccatgtaaataagtttcttttccatattctcgtaccatttccttttttatttcatatcatacccatatgatatgatttatactagtatcattttttttatttgtcaactgcaaaatacctgcgggagatattgtacttcattatatacaaaaagaggacgttgcacagccgccccgacggtgtaacatcctctctttatgcatctttcctgcagtttctccgaaaaaatccagttttctcttcaccgcatacgattccttaaattaccttccgtatccccgtaggacttcacaggtctgtgcgatatcctccgccgtatgtgccgcagagacaaacattgcctcgaactgcgacggtgccagatatatctgatgatccagcatataattaaagtaatccgcatatctggaaatatcggaggacgttgcagtctcataatcctttactttctgggcagtaaagaaaatgctcatcagcgatccgatctgattcacgcagacgctttcgccaaaatgtcctcgcatgccctccgcaagcgtcctcgcacttgcttcgatctgtgtgtagatttccggcgtctcttttaagatagtaagcgtctctatgcctgccgtcgttgcgatcgggttgccggaaagcgttcccgcctggtataccggtccgaccggcgcaaccatatccatgatctcttttctgccgccgtatgcgccgaccggcatcccgccgccgatgatcttgccgagcgtcgtcagatccggcgtcacatgaaaatatccctgcgccccgccgattccaagacgaaaaccggtgattacctcatcaaaaatcagcagtgccccgtaatcttctgtgatttttcgcagaaattccagaaatcccggctccggcaaaacgactcccatattggcagccaccggctccacgatgatcgcagcgatctcttttccctgcgtctcaaagagcttctgcaccgaatccggctggttgtactccgccaccagcgtatttttcgtataatccgccggcacgcccttgctgtccggtacagactgtgtgagcgctcccgatccggcttttaccagaagtccgtccgaatgtccgtgatagcatcctctgaacttcacgaccttatcccgtcccgtaaatcctctcgccacacggatggcgctcatcgtcgcctccgttccggaacttaccagtctggacacttccatcgacgggatacaggaacggatcagctctgcaagctttagttcctttcctgtcggcgccccgtatgtcagcccgttctcgcacgccgcctgcacggcttttattacgcgcagataggcatgtcccagaatgcacggtccccaagaacacacatagtcaatatacgcgttgccgtccacatcatagatgtgggaaccgctcgcccgctccacaaagaccggcgtccggtgaaccgcctgataggcgcgcaccggactgttgacgccgcccggaatacatttttttgatgcctcaaataatcgttctgattctgtatactgcatatttctcctcatttccggcactgctgccattctcttccactactttctctcctcgtccagccactttgccacatccagcgcgtgataggtgatgatgattttcgcacccgcgcgtttgatgccggtcatgatctccatcacgatccgccgctcatcaatccagccgtttgccgctgccgcctttaccatcgcatactccccgctcacattgtacgccgccagcgggtaatccgtacggtccatgacctctcttacgacatccagatacgcaagcgcaggctttaccataatgatgtctgcgccctcctcaatatcggacagacattcccggatggcttccctgcggtttgccggatccatctggtaagttctgcggtcgccaaagctcggcacggaatgtgccgcctcgcggaacggtccgtaaaaaccggatgcaaactttgcgctgtacgccatcagcatggtatttttgcagtcgttctcatccagagcctcacggatcgccgccactcttccgtccatcatatcggatggagcaatcacgtccgcgcctgcctttacgagacttaccgacatttttgccaaaagcggcagtgtctcatcatttaaaatctcaccctcacacacaaggccacagtgtccgtgggacgtgtactcgcacagacacacatccgcgatcacgagaagctccggcatccgtttcttgatgtggcggatcgctcgctgcgtcacgccctcatcatttgtgaactacctcttcgcgtgctatgcgattccgcttgtgattttcgctacgcggctctggatggctgcgttgaaaaacagaatcacaaatgcagtaaacagcatcaccagtgcgatggacgttgcccacgcgtaatcaaattcctgcagcttcgacataatcattaacggcgcgatctccgtctcatacggcgtgttgcccgcaatgaacaccacgcttccgtattcgccgagccctctcgcaaaggacatcgtaaatcccgccagaagcaccggggcaatctcgggtaaaatcacccggaacacggtctgtctcgtattggctccgagcatgtgtgccgcctcctcatactggagatcgatcttctcaagcaccggctgtaccgaccgcaccacaaacggaatcccgatgaaaatcagcgccacagtaattcccagttttgtgtaggcgatctcaattccaaacttattgtaaaaaaaggcgcccaccaatccgttggttgttgtcagatgcgtcagcgcaatgcccgccaccgcggtcggaagcgcaaacggaagttctatgattccgttcatgatccgcttccccgaaaattcgtaccgcaccagcacccaggccaaaatcacgcccatgacggcgtccaccagcgccgcgaaaaatgcggtctaaaaactaaccagatagctggataccacacgccggttcgtgatcgtcgccacaaactcaggaaaagacatctgcgccgagaagataatcagtgaacagagcggaatcacgacaatcagtcccagcatcgttatggtgattccaaaggacagtccgactcccggaatcacacgttctgttttctgttttttccctctcatgcgacactcctcctattttcttacttttcctatctattttatatgaaatatactttactcctacttatccacactgtaaagtatgtttttgtaatttttagtaataaagtggtaaagtgacatatgatacagaggaattgccgcgataagcatagatcttgtttgggtgaataagtaatattatcagaaatagatacttaaaagttccagataaccatgcggcggtgaattttgcttcaaagaatttgccgccgtctgtttattctggaacttttttgttctctggtcttctgataatattacttattacccaaatgaggtctgtacttattgcaacaattccagctgtatttcaatgtgactaatccagcacggtcttccagccgctgctctcatatgccgcaaagcacatcccgatctgttccgccgtcactttttcttccgcaagcggagacggaagggcgtcctttgcaaaatacgcggtctccgtcgtctcaatgttttcctggaagcttccgccggtgacgctgcactgcacaaatatttttatcacgccgtagggcagattgtagcggttatgctttctccagtcgtgaaccgcgatcactttctccggcttcacgagaagacctgcttcctcatgggtctcttttaccgtgttggacgccaccgactgatccacgtcgcaccagccgcccggcagcgaccatgtcccgtttttttcatgcaccatcagtatttttccatcgacaaagacagccgcccgggtgtcaatcttgggcgtctggtatcctgtttcattgcagaaaaaccgttttaccgtatccaccggcacttccgtccccacacacagcatctctgccgctatgttccgcagctcctcgtagcgctccttgtcatattcggttccaccgtaggtaagtcccgcctgcgcaatgctctgcacgcgcatcgcaagctccatccactgatccatgcttcctccattccgcagacgccgtgcgtcgtgcatccgtgttatctctcctgtatttcctttccgctgagatgctcgatcgtaatctcgtatacgctcaccgcttttcccacgcgctccatctcctcctcgatcatcgcctcatccggataatattttgccgcctctgtgctgatttcttttgtctttcttctgattggttgaaacatgattgcctcctttttcccgtctctcttctaaaatgtcaatgtctgccggatgctgtatccatccttcttaaaatccgaaaacagcgcttcgatctttattatttttctcaagaccgatgaatttttcaccgccctcccacagataatcgataccattttttcatgtaggcatcctttaataattcgttatccgcattcactaatttcacaaacagacctgtcagtccatcatatttgtggaaatcgcctgcatcatataatatcacaaaatcattttgccacagaactttccgtttcacaattcgtatttggcaatcccacgcactttttccgatcttacaaccaaatagtaattttatattttatattgtatatacacgcaaaaacagacatgataccgattgcttatcggaacaccatgtctgcttttgaaaaacttccatccttctggaagccctttttatcttttctgaattttttccttaattctcggacttacaatctgaatcataattaccacaataaggataatgcctttgattgcgtcattgatgagagaatccatctttaacgccactataattttatcaatgactgtgtaggacatcgcaccaaagagaataccaagcatttttcctctgccgcctgacatgctgattccgccgagaaccactgccgcaatcgcatacatctcatagctgcttccggttgttgccgggtctgccgacgcattcatcgcaatccatacaaacgatgccagtccgacaagcgctcctgcaattacaaaaacagaaacctttaccttatcaacgtcaattcctgtcatgcgcgctgccttcgcattgcttccaaccgcatagatctgttttccgtattttgtttccgttgtcagatacacaaaaataattgtcactgcaatgaggaggattcccacgattggaaccgtaagcacttttccgtttcccatattatacattgcctgatacagcgtattcgcattcgccatgcggtaaacagaacttccgccgccgataaggttcttatcgatatgctggcaataatactgtgcaaatgagcggtaaataagcattgtcgcaagtgttgcaataaatgccggaatttttccatatccgaccagcataccgttgatcagaccgcacactgcgccaaaccctaccgcaaaaaggaacgtcaataggatgttatctgtcatgttaaatatcactaccgaaaaaccgcttacaagcgcaagcatggaacctacagaaaggtcgatatctccggtcaaacagatcagtcccatgccgaatccaatgattccaatgactgcagaatgccggaatatattcataaatccactcatcgtcaaaccgtgattggtaatcacatatacgattaaaatgataacataaacagcaatgtagctgtattcactcaggaatttcgttcgttttgatttctccttcattataaaacctcctctaactgtacagcatttgttgcataactcatcactgttgtttcatctatctggctatgcgcaagacttcctgcaattttcccgttataaaatacgatacagcggtctgcaactttttttatttccggtatctcaagtgtgttaagcagtatggtttttccttcggaagcaagcttcagaatcaaccggtagatttccgcttttgctccgatgtcaattccctgtgtaggattatccagaagcaggatatccgcatctgtgtcaagccatcttgccagaaataccttctgctggttgccaccgcttagcgacgtaataaaatccgcactatcggctgcttttatatttaatatatctttaaaattctgatattttttctcttcctgttttttagaaatacaaggtttctttttggaaagaacatgttccgccaggtacatattctccaaaatcgacatatcaggaacaaccgaattttctttcctgtttgccggaagcattgcaaccttgttcttcattgccgcctgaatcgaatgatgaggcacacaatttccatttacatacatatttccgccatatgcaggtgttgcaccgaacatgcactgaagaagttcactgctgcccgctccctgcagtcccgtcagcccgataatctctccctttttaacttcaaaactgacgtcacaaaatccttctccgctcagattctcaagttttaaaacagcttcgcctttttgtctcggttcataaatctcgccggaagaataattttctcccaccatcttctgtatgatggtatctgtatccgcctcgctgatttttccggaatcaataaattccccgttacggaaaatcgtatagctgtctgaaattctgaaaatttccggcattttatgagatataaagataaacgctgtcccgctttccttcagtcgctctataatatggaaaagatgttcgatctcactgttgttcaaagctgtcgtcggctcatcaagaatcagcaactttgccttaaaaaacaatgccttcgatatctccagaagctgcttctggcttgtcgtaagcccggacacctctatttccggatcaatttccacacccagttcctcgaaaagttccctcgactcttttatcattctctttgtatcgactttcccgaatttattggtatattctctgcaaagaaaaatattttcataaacctttaaatcattaaacaggttcaactcctgatgtacaaacgcaatccctgcgttttccgaagattttacggatatatttttcatttcttttccgtcaaacacaactgttccggcgtctttgtcatgtacacctgtgagaatattcataagcgtagattttccagctccattctctcccaaaagtgcatgaacctctcccgcttccacccgcagagaaacttctttcagcacctgtatgccattaaaggatttgcatattccgttcatctctaataaactcataaataactccattctaccgaaatgatcatcttttatcatgcatgttgtccaccatatcgggcagacaacatgcattggtttaccaaattagaatccttcgtactctgtcacattctcagatgtcacattttcacattcaatcacatgatcctgcggtaccgtttttccatcaagataatctaccatatcctgaattgctgtctgaatcatcgacggactatatgtaacagataccagacctccaaactgggctgtaagttctgtataattttcgccgcgaagcattccgtaaaattcatccagtccgccacaaccactgattaccggctgatttgcaagaaatgcctctttggttgtctcatcgattccaccgccgttgagcgcctcgataatacccattgcaagctcatcatcttccgcatagaaccactttgtatcagcgtttccagcatcactcatcaatgactcaaatgcggtcttggtatctgatctgctccagttcattgctcctgaatatgtgattgcactttccacctgctcttctgtccactttaaggaatcctcaatcgtagcgtcctcgaactctgcatttccaagcagatattctttaaatccctggtcacggagtgttgttaccgaagaggtatcgccctcatatacatatacctcatcccccggctgcattccgcaggatacgaaatatgctgccgcggcgacaccgattccttcattgtcgccttttacattcgatacagcgctcgatgcaacaccatcaatgatccggtcaaatgctacatatggtatttctgcatccacgatctgctggatcgccgactgcactgtgtcatcaattggctgaataacaatcgcgatatttttctcaccttttgagaggatatcctcaatatttctaatctgctctgaagcatccgctgaagtaatcagctcgcttgtgtatgttcctgctgcatttacttcctcgattttctcctttgcaaatgttgcaacagaacctgtccagccatggtcctccggtgctgtcaaaacatagatatgcgtgctatccccgttttcgctttctccggtgttctgtttttctgtagctgcctgtgatgtcgacgcgctttccgtcgcagcatccgatcctccgcatgctgttcctcccaataccattgctgttgtcattgccaatgccaaaattctctttctcatagttttttccttctttcttttatttattgaaacggtacttaccgtccaattacattggaaactgtctgatatactcttttgattttaaaagactctttaaaatctcttctctggagctctcaaacgctttgtcttctacctcaatacatacgtatccgtcatagccaatgtccgtaagcgcactcacaaactttccccaatttacatcccccaatcctgggagcttaggcgacataaacttcagtggataagccataacccctacctttgccagtttctccggatataactttatatccttaaaatgtacatgaaaaatcttatccttatattcatagatgggatggatgtagtccatcatctgccatacaaaatgcgacgggtcaaaattgattcccagatattcgctgtcaaggatctcaaaaatcttatcccagttctccggtgatgtcataagattctgtcccccaggccactggtcctcgccaaagagcatcggacagttttcaatggcgatcttcacctttcgttctttcgcatactccagaataggcggccagattttctctaccagctttaaattctcttccacgctttttgtctgatcccgcccgataaaagtcgtaaccatattgacgttcagcttcgcgctggcatcgatcacgctcttcagatgtcgaatattctcttcgcgtttttgttcgtccggatccatcgtgttcggataaaaagcaagagaagatatctctatttttcgctctttacagtagtttaagatgtactccgccttctgatcatcaagcgtctctgtatcaatatggcacacccccgcataccttctctctgtcttccctgcactaggccagcatgcgatctcgacacattcaaatccctgtgccgcagccgtatcgatcatttcttcaaaagaccatccatccagtatcgaacttacaaatccaagtttcatccgtgtatcctcctattgaatcatgattgtttttttctcttttgcagattccaggcttgcgaatattgctttcattgcattcagcacatcccttccgctcacttcaggttcatgattatttaccactgcttccacaaaagaatcaatgattccggacttcgtctgattatcgttggtttgaattttgtctatgtcgtatagaattttctcaccgccgcgtgtgatgactttaatagagtaaaccggatcatcatatattttcataattccttctgttccgtaaagaattgttgaattatcctcttccccgtaataagtccagcttgccgtcatggttccaaccactccgttctccatcttatagatgcagattgcattgtcatccacaccgatcagatttccctgcgcgtccttcttgtcaagcgttgttatatgcgctgttgtttcaatgactctcgaatcaagcagaaactgtatcagatccgtcttatgaaccccaaggtctgccattgctcccataacggaacgcgatttgtcaaaaaaccatgtgttcttcgcaccgtcaattccccatgtctccggaccgccatgtccgaatgtcgtcttaaaagtaattacgtctccgattactccctcagagattaactctttcgcctttacatgtgcttttgcaaatctctggttctgccctatcatcagatatttcccgttttcatccgcagcttttaccatgtccatgcattcctccagcgttactgccatcggtttctcacaaaggacatgctttccagcattcaacgccttgatcgtaacttttgcatgtgcgttatttgccacacagacactgacagcatccatctccttgtctgccagaagttcatcctccgtgctatatgccttgccgccaaattgcgctgccagttctgctgcccggtcagcattccagtcataatatccaacaatttctacatccggattttccaggtattccggaatatgtctaacctgtgcaatttttccacacccgattattccaaccttcatgttatctcctttcatattttctttcattctttcattctcttgaaacaaaagtaacatatttttttcagcaattcaatcattctatcgtcatttcaagcattttcagcgctttgtttctttattttcgtttattttgtcaataatcgccaaagtatttcttatatagctgaaaacttttcacattttgtttcattttatatttacaaaataaacaaaactggtgtatcattattatattgatacacaggaggctcacagagatatgaaaaaggataaaattacggtcgcagacatcgcaaaaaaagcaggggtctcccctgccactgtttcccgagtgttgcgtcatagagaacttgtaaaatccgaaaccatccagcaagtcgaaaatgccatgtccgcactgggatgtcttctcgaaaagggtactatagctgcggctaccgaacagcctcttattattttgaatgttccggaactcgataacgttttctacctgaaagtcatcgacggcgcccttgtatccgccaaggcacacggttatcgtctgctgatcaacgactccccgcttgaccggagttctatttactcttttatcaatctgttaaaacaggtacatgccgccggagtcattttattgaatcatgtctccaaggaacagctggatatgatccactctgtcgtaccgttagttcaatgcagcgaatataacgagcacgcggattacccttatgtcagcatagacgactatagtgccgcaacaagcgctgcagaatatattgtttcctgtaattgtaataaaatcgcaatgataaacggtcccatgtcctttaaatatgctgtgaagcgtcaggaaggttttcttgatacgctccgcaaaaaagatatttccgttcgtccggactggattgtcagcctgcctgaagtaaattaccagatggcatactccgcagtctgccgtctgttgaataatgaaattcgtccaaatgcttttttcgttatctcagacgtttttgccgccgctgtcattcgtgccgctaaacgctttgatcttcgtattccggaggatattattgtcgtcggatttgataacctggacatctccatcatgacctgtccgacgattaccactgtaaaccagccgagttttcagctgggctattcggcatgcgaacttcttcttgattccatcaaccatcctgatatgtttcccaaatctctgattctggatacagaacttatcatccgggaatccagcgcaaaaatttaacgcccggcagattgctctgccgggcgttccctataaatttcctaatcactgttcatgaattgcttcaaacactccgccgtccgcgaaatgcttcgccgacgcctcactccatccaccaaagtgcgcaatatccgtgagtgcaatgtcatccacgatccattttccgtctgccggcagttccgtgatgacgcgctcccccgatgtactgatataatcggaaaaaacatccggatccgacgggcggtagaagttctccgcaaacgtggtcgtcgcaccgcgcgcacccgaatccagcaccagcacattgtgatagagtgtcttcatattctctgtgatctcttccccgctctgtccctgactttcaaaatagtaccatgccgccagataattccagcgcgctccgccggacgtcttcgggttcggggtgatgacgcccacgtcctcccggagcagatcatcccagtccgcaatgttcttcggattgtccttgcgcaccagaaaaacaatcgtcgatgtgtacggggaactttcctgatcaaattcatcctcaaaaccatcctcaatcattcccgcatccgcaaccacctgcacatccccctccagtgccagcgtcaccacatccgcctccaggccgtttgccacctcaagtgcctgcttgccggaacctccgtgcgactggatcaccgtcacatcctgccctgcctgctccttccagtgttccgcaaacagtgcattgtacgattcatacagtcccctgtgctttgaaccttccgttatacggtcagttcttactttgtctcgccgccctctaccacaagcgtatcctcgtagtcactgccgtaagtgtcagccagtgttgcctcgtaatctgcgtggaagaaattctcctcgccgagtgccttgatctcctcattgatccagtctaatacggtcgtgttgcccttgctgactgccggcgcaattgtatctgtgcttccaagctccggtatacctacggtatagcccgggttctgaagagcaaatgcaataacctctgtgttatcgtttgcccatgcaacaccgtttccgttctcaagcgctgtctttgctgccgcataggaatcatatttctgtaaggtcagatccggatagttctcggtcaggtaggtctctgctgttgtaccggaaatcacgatcaccggatcatccgctgtcagatcatccagactctcaaccactgcagaatccggagaaatcacaccgagggatacgttcatgtacgggagtgcaaaatcaacttcctccgcgcgctccggtgtcacggtaaagttagccagaatgacatctacttttccggtctgtaaatactcaatacggcttgcggcctcggtggaaacgaagttcacatccacgccgagatcctctgccagacggtttgcaaagtagacatcatatccctgatactctccgttctcatccacatagccaaatggattcttgtcggaaaatacaccgatgttgattgtgccgctctccttgatctcgtctaaggtgcggtataccacatctgcggatgcatcgcctgcggctgcctgtgtatctgcggtaactcctgtctgcgcatcactgctgctctccgctgcatctgtattgccacagcctgccagcattgctccagttaatgtcagtgctgtaaacagtgccagtctcttcgttaatctttcttttttcataatattgtcctctctttctattccaaacttccatcgaagcttcagaatcaaccttttgtgccgctctctagtcgcggactgcctcaaattcaaatgtgtgcagaaactttttcgcacgctctgtcgtcggatgggtaaaaaattcatccggctttccttcttccacaatctctccctggtcaataaagaccacacggtctgcaaccgcccttgcaaaggacatctcgtgtgtgacgatcaccatagtgcttcctgtcttagcaagctctaacatcgtatccagtacctcgcgcaccatctccggatcaagcgctgcggtcacctcatcgaacagcataatctcggggtgcatcatcagtgcacgcacgatcgcaacacgctgcttctgaccgccggaaagctgtctcggaaaactgtcacacttgtcgagaagccctactttttccagaagctgttttgcctcggaaacggcatcctccctgcttctcttctgcaccttaagcggcgccaggatcacattttccaggatcgtcttgtgtggaaaaagctcgtagctctgaaataccatcccgaccttctggcggatcccggcgatattcttcgcctttccgtcgatggtctcgcctcggagtgtaatgcttccctcctgtatcggctctaaggcgttgatacatcgaagcagtgtgctcttaccgcatccggatggtccgatgataaccacaacctctcctttgtggatggtcaggcttagatcctttaagatctcatttccctcgtaggactttttgatatgttcaatttttaacaattcttctgcttctgccttcatatcagttactccatttcttttccagatgtcccgccagcatactgatcggccagcatgccaggaaatacagtacaaacacggttccgtacagtccgaacgccgcattcggcgatgccatacggtttgcctcgatgatctgctgtgtcacctttaacacctccaccacaccgatcatcatcacaaggcttgtcgtcttaatcatacgggtgaccaggttgatcgacagcgggatcagacgccgcagggtctgcgggataataatgtaaaaataaatctgacttctcgtcattccaagcgctgcaccactctcatactggtgcttcgggatactgattaacgcgccgcgcaccagatctcccatctctgcggttccccagaatgtaaatacgattaccgatgcaaactccgccgataaattccagccaaacatccgcgtcgttccgaaaaacacgagaaacagcagtaccatctgcggcatgatgcggacaatctccagatacactcttgtcactgcttttgtcaccggattcttccatgtcatgacgatgccgagcagaatgccgagcggaatactgatgaccacggagatcaggctgatcctaagggcgacccacagaccgcccagaagtcttatcatgttcttgcccttaaacaggacactaattcccaaatccggcatagcgcagcctcctctctaacaacgttccaaggatggataccggaagtaaaataatcagataaaataccaccagtaagaacaggcactccgctgtcttatagtaaagcccgatcaggtcttttgctgtaaacatcagatccatcagactgattgctgaaaacacactcgtctcttttaacaggaagatcacattcgccacaaatgccggtacgctaatggataccgcctgcggcaggatgacatagagcactgcctgcttcttcgtcatgccaaggcttaacgcgctctccatctggatcggctcgatcgcctcgagtccgctgcggaacgcctccgccatatagcttcctcccaaaagtgccagacccgccacgccgcagacatccgcggagatggaaagtcccaccttcggcagtccgaaatagataaaaaagagctgcaccagaagcggtgtgttgcggaacaattcgatatatatttttacaatctgtctcgccaccggtatcttataatgtacaatcagcgcacatataagaccaatgatgattgaaaatgcaattcccatccagccgatccgaagtgtcagccacatggctttctgatacagcggcaggtattgcgagatgacttcccagttcacattttcacatcctatcttatttcttattattcctagctgttttatatgatataagaaatatactcctactttatatatatgtcaagtaggaaattaaataatttctttttgttctaaaaaagaaacagaagcattctgtgtcagagaatccttctgttttgttctgttactctatttctatattctatgcagttttaatattatgctttccggatgccgtcgttcatgcttcccatccggtatccgccgagatcgagtgtcacataggtaaaaccgatctccttgcatgccgcattgaccttctggtaaaaatcgtctgcaaacatttttgcaaaatcctccgtgccgatctcgatacgggcaatcgtgttcgttccgctctcgtgaatccgcacgcgcacctgatgaaatccggcatccagcagaagctgctccgcgcggtccaccatgccaaggcgctcctcggtgatctcctccccgtagacaaagcgggaagaaagacatgcaaacgactgcttattccatgtcggaagccccagcccgtgggagagttcgcggatcatgctcttgttcatccccgcctcgcgcagcggactaagcacggaaagctcggcaaccgccatcagtcccgggcggtaatcgccgttgtcgtccagattggacgcctccgccacgtaggggatgtcgtactcctttgcaatatcccagatctttgtgaaaagctccttcttgcagaggtagcagcggttggtcggattatgggaaaatccctcaatctgcaattcctccgactccaccacgatatgttttatgtgctccttctcacagaatgcttttgcctctcttaattctctctccggaaaggaacaggagcgagccgtcactgcgaccgccccatctcccagcacgtcatgtgccacttttaataagaatgtcgaatccacaccgccggaaaatgcaacaaccatcttccctttttcccggatcgactgttttaatgcttccatttgttccatcgtattctaaacccgctttcttccattttaattacacaaacggattgtaaaaacggcttccgttgctgaaggtaatcatcagtgccaccgcggaaaatgccgccgtcacaatcagcaccgcatagtctgccgccgccaacggctttcccatataccaggtgcgcttcttgtgctttccgaacccacggagctccatcgcattgctgaccacgtcgatgcgatccatgctggagaataccagcgggaaaatgatcgccgccacgttcttgatgcggtcgccgagcttcgccttgccagacatctcaattcccctcgcctcctgggcgtgcttgatttttgcaaaatcatcctgcacatccggaatataccggagcgcaatcgccacggagtaaccgatcttgtagctgacaccaacacggtttaaagaagcggccagttcgctcggattcgttgccacgataaacatgaacaccgctggaatgaccgtcaggtattttaccatcacgttgaactcataaaacagctgctcttttgtcaacgtgtaatgtccaaacagatgcactatcggcgtctccgttccgtaaatcttcgtcccctgtcccggagaaaagaagaaaatggcgatgagattgatcaccagaaaaaacatgatgaacttgaataccgtaccgacctgcttccacttcgtcttcgacatggcaaaaataatcaggctgcacacaagcatgaccaagagcacccgcgtatcgtaggagatcatgctggtgatcgaccacaggaggaaaaacaaaagctttgtcaccccgctcagacggtgaatccatgtgtctttttcttcatatgataatacgcgcgacattatgcttcctcctctctttccgccgctctcatctgccgctcgtagccgataaagcgctccacgaactgtgtcggctctgcaatgccgcagcgcaccgccagatcgtagagagatgttttcttcagataggcacgatccgccaccgcgtcatccgtgagtaccgccgccggagcggtatctgccagaagcctgccgtcagcaatcacgaccgcgcggttcgtatactctaacatgagatgcatgtcatgtgtgatcatgatgatcgtaatgccgtactcctcattcagcttctttaaaaactccatgatctccgtataatgtctgtagtcctgtcccgccgtcggctcgtccaaaatcagcacctgcggatgcagcacgaggatcgaagcgatcgtcacgcgcttcttctgaccgaagcttaacgcggagaccggccagttacggaactggtagaggccgcagatctttaaggttgcatagacccgctccttaatctcctcctcgggcacgccgcgcaccgcaagtcccagcgccacctcatcatagatcatcggtttgctgatcatctgattcggattctgcatgacaagtccgatcttctcgccgcgctccttgatcgaccagtctgcaatgtcctcgccgccaaacagaatccgcccctgaccgggctttaaaaagccgcagatgagattcgagagcgtcgactttccggcaccgttcttgccaacaatcgccagcatctcgcccttttgtacctgcatatggatgtcggttagaatcggcgttcttccgtcataggaaaaagcaagattctccaccgagaggatgacgtcatcccccggttttttctccggcagtgcaaccttctcgttccagcggcacagcgcctccttataaccggacaattccatcgtctccacatgcgcgggatgcgtctcgggacggatctcgcatcccgcatgcttaagcgccgtgatgtagagtggctcgcggattccctcctccgccagtacattggctgccagaagttcatccggcgtcgtatccgccacgatctttccctcaccgacgacaatgatgcggtccacatcccggtacagtgcatcttccagacgatgctcaataatcaggatcgttgccccttttgccttctgtagctcatcgatcaaagcgatcgtgcgctttcccgtcgccgggtccagattggcaagcggctcgtcaaaaagcagaatttccacatcgcagaccagcacgcccgccatggatacgcgctgcttctgtccaccagacagcgcccccggcgcgtgatcgagcaggtcttttacatccacagcgtccgccgctttgtccacgcgcccgcgcatctcgtgatattccactctgtcattctccagcgcaaatgcgatatcctccgccaccgtaagcccgatgaactgaccgtccgtgtcctgcaaaaccgtacccacagacttcgacagtccaaaaataccaagctttgcgggatcctcgcccttaatgcggtaagtccccgtgatgtctccggcataggaaaacggcacaagcccgttgatgcagtgcgctaatgtcgactttccggaaccggacggtccgacgatcagtaccttctcccccggataaattgcgagattgatgtcctttagcgtcggttccttctgggaacgatatttaaaagaaaaattctgaaattctatgatcggttccattccgaaatcctcgtcttcctctcttgtggtacttcccgactattatacttgataataattccaaatggaagaaaaagtgcgcggaaccggtcacattttgcaccccgtctccgcgcactctgtctgcttctgtctttctgctgctgccggaatccgcctagtcctccttggagagactggacgattttgctccgatcttggagtatcctgctgcgatcaaagtaccaagaataccaataataatcacgtttccaaggcatgcccatgcaccctgtgcaaataccttgttggcaggctctgcgtagatcacaatgtcaagtaccggcgcaacgatcacccatgcaacgaggttggcaacaacctgcacaacgttgaacagcacgatctgtttcttctcgaatccgccgtccttgatcgcatattttgcagcgaaaagtccgaccagaataccgaataccgcatctgggaatacccagctccaccatacgcttccataaaacagtgcatcaccgattgcatgtcccagaagaccgacaataccgccgactaccggaccgaatacggctgcaaggaatgcgagcaatgccgctctcggctgtaatgcggtgttcgggataaatcccagagggatctgtacctctgtcagcgcaacgaacagcgcggtgccaataccggttgcaacaacttccttaataccaaacttcattttcataacaaagtcctcctctcatttgtatctgcactgtagtataacacacacttttccgatttaccagatagaatttattcctgtcatacctttttaccagagcttcagcacgccgattgccgtcttcatgaacttgtacttcaccgtctcgagttctcccgccgccgcttttaactccctgcggatctcaatatgctgcggacagtgctgctcgcatttgccgcagcccacacactgtgaggcgcttgccggattcttgcggaatgccgtacactgcagataatccctgcggccggacttttttccttcggagtacatcgcattgtagcagcggaatgtcccggggatatccaccccgcgtgggcacggcatacagtaaccgcagccggtgcatcccaccttgacgtgctttgtgatctcctgccgcaccgcttccaccagcgcgcgatctgactccgtcatgcacccgacgccgtattccgaagctgtgcgcacattctgttcgaccatctccatggaattcatgccggaaagcacgcaggtcacctccggctggtcgtacagccacttgagtgccagttctgccggggtgcggtgctcctcatcctgtgcgaacagctccttcgccgactccggcagcagattgaccagcctgccgccgcgcagcggctccataataatcaccggaatccccctcgcgtgcgcgtagcgcagcccctccacgcccgcctgcgaatgttcgtccatataattatactggatctggcagaaatcccagtcataggcgtcgatcagctgcatgaacatatccgatctgccgtgataggaaaatccgatgttgcggatctctccggacgcctttttctcccggatccagtcctccatgccaagcttttttaacttttcccaggtcggaagatccgtcagcatatgcatcagatagtaatcaatataatctgtctgtaagcggcgcagctcctcctcgaacatcttctgggcgccctccaccgacttgatcaggtagtgcggcagcttggtcgccagatagatgcgctccctgcaatgattgcgcgcgaggatctccccgaccgccgcctcatttccggcatagacatatgcggtatcgagatagttcacaccggcatctattgccgccatgacctccttttccgccttatcgatatcggcatgcccgccctccttggtaaaacgcatacacccgtagccgagcaccgaaatctcatttccgtttttatccttgcgatactgcatgatcatccgatctcctccaactgctgcagccagacagccgcacacgcgtccgacggcatccgcagatccccgcgcggagagaccgccacactaccgactttcggtccgtccggcagacaggaacgtttgaactgctgtgcaaaaaagcgccggtaaaaggttttcagccattttaagatcgtctcatcgtcgtagacgccgtcaaacgccacttttgcgagacggtacacctttttcggtgcaaatccaagacgcagcatgtggtacaggtaaaaatcatgaagctcgtacggtcccacaagatcttccgtcttctgcgagatctttccgtcctccggcggcagaagctccggagataccggcgtgtccagcacatccgtcaataccgcgccaagcttctcatccccgcaggtatccgcgtagtagcgcaccaggtggcgcaccagcgtcttcggaacggaggcattgaccgcatacatggacatatggtcgccgttatatgtcgcccagccgagtgcaagctccgagagatcgccggttccgatgaccatgccgccctccttgttggcaatgtccatcagaatctgcgtccgctctcttgcctggccgttctcataggtcacatcatgaacggccggatcctgtccgatatcacggaaatgcacattcaccgcttccttgatgtcgacttccgtaaaatccgcgccgaggcaccggatcagggacaccgcgttgtcataggtccggtccgtcgtcccgaagcccggcatcgtgactgccttgatccggtcgtgcgggatgccgagcagatcgaacgcgcgcacggtgacaagcagtgccagcgtggaatccagaccgcccgaaatgcccacaaccgccgtcttacagtgcgtatgctccagacgcttttttaatcccgctgcctgaatggcaaggatctcatcacagcgtctgatacggtccgcctcatttcccggcacaaacggcatcgggtcgatgaagcgggtcagagccgtctcctccgtttcaagagaaaaacgcacctccacatagctgtcatccgccatctcaaacgtcgtcatccggcggcgctccgcctcgatccgcttaacatcgatctccgtgcagatcacaccgcttccgaaccgctccgattcctttagaatatgaccgttctcggcaatcacattgtgtccggagtagacgacgtcctgcgtggactccccgtctcccgcactcgcatagatatagccgcacagaagtctcgccgactgtccgtttaccagctcccgccggtagatgtcctttccggtggtctcatctgatgcagacagattcacaagcagcgtcgcaccatttctggcatgacggatactcggcggctccggcgtccacagatcctcgcaaagctccgcgccgatctttaattctggcagagacgtacacacaaataaaagccgcgtgcccatcggcacgcactctccctcgaaatcgacctcgaccggatctgccattcctctggcaaaatgtcttgcctcgtaaaattcattgtagttcggaagataggttttgggcacaaacccgagcacttccccgcggcagagcaccgctgccacattataaagttttccgttgtacgcaagcggtagaccgacaaaaaggatggcgtccacctctgctgtctcctccgcgatcgttccgagcgcccgcttcgcctgctctaaaagatattcctgcaaaaacagatcactgcaggtatatcccgtgatgacaagctccggcagcacgatcaccttcgcgcctgccgccgccgcttcccggattccttccacgatcacgccggcgttgtattttgtgtccgccacacggatcttcggtgtgacggcggcaacttttacaaatccatctctcattttctcatttcctttaactcgtcgatgtcaaaatggtacgctttgttacagaactggcattttacctcaatcgactctccgtcgcttacgatgtcgtccagatcctttctgctcagtgtcgcaatcgcacgggagacgcgctccttggagcagtcgcactggaatgcggcatccaccgtatcgttgatctcaagcccgaactcgccgagaatcagctccaagatctcctccggtgtcttcccatcttccagcatctccgtgacggaggcaatctccgtgatcttcttctcgagacgatccaccacgtcgtccggtgtaaacggcatcagctggatgataaatcctcccgcctgtctgaccgaccggtccggattcacgagaacaccgagtcctaccgcggacggcacctgctcggaggtggcaaaatagtacgtcagatcctccgcaatctcaccggtctgcagcgcgatctgtcccacgtacggctcctttaatcccatgtccttgatgacgctcatcacgccaagccccagcgcaccgccgacgtccagctttccctgtgcatttaacggcagttccacatccggaacattcgggaatcccttgacatgtccgtttgcatccgcggtcaccgtaaagcccttcgccggaccgccgcactggatctgtatcgtcagaagatccttctcccccttcatcatcgttcccatcatcgccgcaccggagagaagtctgccgagcgctgccgtaatcaccgggctggtgtcatgatccactctcgcctcctccaccagatggcgcgatgtgatcgcaaatgcgcggatgcttccctccgccgcggtagctcttacaatataatctctatcctgactcatttcgttctccttttctattgttgctgtatttcggatttgctacatcttcttttcctgctccgttttcatgcacggtatcttttctttctgctccgttttcatatactgtatctttttctactcagttcggattcgttgttcctgtatcttctcaaagccttctacctgcgtgggcgcgccaccacatagatccgctccgagttgtccctgaccggttcctttgtgaatgcgtcgtaggctgccgtaagctccattcccgcatccgcaagcagtctgtcaatcgtctttaaatcataggcccgctgataatgcacttcctcaaaccggcggtaggtttcaccgtcctcgcggatataaagcgtcagatcgtattcgtttacggcactctcctcatcaaaataattctcccagatgaagctgccctcctcgcggttttccgcaatcgtcgtctctcccagaagatcccggtacttgtataccgtattcaggtcaaaaataaagatgccatcctcctccagatactcgtgcacacgcgaaaacacctcgcgcagatccgcttcctccaaaatataattcatggaatcgcagaccgacaccaccgcgcacacgcttccgtacagttccagttcacgcatatcctctagcagatagagaattcccccattgggcagctcgtccggttcatccggctcgcccagttctgcatattcttccggctcatcggtttcgtcagcttcgtcccatgcttctgccgcactccacgcatccgcctcatactctgcctcgcgtgcgatctcaagcatctcctcggaattgtccacgccgatcatatcgtaccctgccgccgccagcagcctggtcatttttccggtgccgcaacccagttccgcaaccgttccgctgcagatgccgtattcccggagcagccccgtaagataggacccccattcctcataggggacattatccataaacagatcatacactctcgcaaagctctcgtatgcacccatatcgttctcactttctcttccgccagcatgcggaacatttctatgtaatactaccaagtttccaatgtgaaatcaaggtttgccgacagattcccccgcacaaatcttcttgattatttttccggtaaaccgtatacttattccataaaatgccgttttttccgatgtttctggaaacacagcaaaatacagcaaaggatcttacacctatgcccgatcagtttgaacactatattaccaaaaatataaaggcattctacaagcgcagactgctgacaccgatcctgtatctgatttttcttctggtactgtggttcgttctctcgctgtcagcgccgctttttccggacacgctcgatgccccggataccctcgagagcacctacagacggcatgaagaatacatatccgccaccttatccgatctgaagttcaccggttacacccagtcctttctagggcacatcagcggttactactattacacgatgcggaatgacgagtgcatcatcgtactgctctccccgaataccagtgaacagggacttccggagattccgcaggtgtccgtccgtgccaagattcttcacggttccgagaattttgatgagctgttaaatcatctcgcttcggatctgaactggaccgaaaacggcattcacaacaaagtctcccagtatgtactgagtgagcctgattacaatctgctcggaaacacgctgctctacgtcgtattttttgcgaccggcggctatgccctgatctgcattgtatttttcatcctctatatctgctttccaattctctcgcccgcgtgccaggatctcgcgctgttcggcaatccgaaaaagcttttggagcaggcagaggatgaacttgcgacgctgccgcagcttgcaacggaggatatgtttatcacagaacatttcttcatcgagacctcggtgtacggcaatgccattgtaccgatcgatgagatcatctggatctacaaatactcgacgctccacaagtttttctggtaccacttcagcatctcctacacgctgcatatcagtgcgaaccggcatctctacatccagtgcccgaagaacatcaagtcggacatcgacggtatcatagattacctcgccgaggcgaaccacaatattttagtcggattctccgaagcgaaccgtctgaaggtgcaggagatccagggaacgccgatgcattttgaaaaatttattgccatcctgaaaaagcgcgtctaaatcctgcgccaacacagaacggatcttttgcaatcagctctgagtgtcctttgagcgacaggtaatagttggagaagtacatcttacagatttcagatggaaatgcatatggaagattctttgtgaaaaaatgagagcatttcttcctgacggatatttgcatcagattccgtgtctcttccacgtttggacaatccagcggggacatgtccgacacaccggagacaatgggcggactttctagccgccctaactgtactccctcatagacaatataaaaccgcgcgaaccgaaactcgctgccatctgctattgaaaatatggcagatggcaactcagacatcggcttcgcgcggttatgttatattgcgggagtacaggtaagggcggcacaaaagtcctacaaattgtcttcggagtgcggacatggcccgtggagtgttccaaacttggaaagacacggatcatcgcggatgcaaatatccggctggttagaaatgccgcatttttgaacagaattttcatatgcattccatctgaaattgaaagatgtaatctttttatatattacctatcactcaaaggacactctgtgccgattgcaacagttcctttctgacgctagcggcaggaggtactgatcgactcaatcgccacagcaccgcctcttaccacttcgattctcttgaattttgagcggagcagggcaatcagctcgttgttgcgccgctctgtcagcttgcactccagcagcacgctgtcgtttccgacatccgacacctccacatggaacacctgcgcaatctggaatacctcaagcttttccgctgcattgatgccaagcaccttcgcaaacagaatctctttcatatggatcggcacatcggtgagatcaatgaccttgatgacctctaccatacggtttagctgctttttgatctgctcaaaggtaatgtcgtcactcgtcacgcagatcgtcatgcgggaaacggtctcgtcctccgtcgtgccgacggtcagactctgtaagttatacgatttaccggaaaacagaccggacaccttagccagaacaccgacctgattttccacatataatgcaatccagcgattcttcatagtaagtctccattcctatttcaagatcatttcactcatcggattcccgctcttcaccatcggaagcacgatctcatcggtggcgatcataaattcgatgatagtcggcgcatctttgtatgtgcgcgcatcatctaacgccgcctggatatcatcctcgcgctccacacggattccgtgtgccccgtagctttttgcaagtgcgataaaatccggcgtgtacggcgggcaggatgcattcggtcccttgcagttcgccgggcacccctttcttctgcgcagacaggttgcctcgtagcgcttgccgtagaataactgctgcatctgccgcaccattcccagataataattgttaaacaggcagatgatgaccggcgcctcctgcacgaccgccgtcgccatctcctgaatgttcatctgcagaccgccgtccccggaaaagcagaccacttccttgtccggattgccgatctttgcaccgattgccgccggaagcccgaatcccatcgtgccgagtcctcccgaggtaatcagctgatgccaggaatccagttccagatactgtgttgcccacatctgatgctgtcccacatccgtcacatagaccgcctctccgaacgtccggttcacatgctcaaaaatcatctgcggcgtcatgccgtgatccctgcgcatctcaagcggatttttctcatcccacccggcaatctgcgcctgccatgctgcggtgtctttggactccgcccactcgagcagcttctctaacgccaggtttgcatcggaaacaatcgggacgtccacgaccacattccgggagatcgccgccgtatccacgtcgatatgtacaatcttcgccttcggtgcaaattcatttaaatcgccggtgatacggtcattgaatctggtgccgatggaaaacagcacgtcgcatttactgaccgccatatttgcggcatattttccgtgcataccgctgttccccacatagagcggatgcccggtcgggatcgctccttttcccatgatcgtcgtcacaaccggaatctgcattttttccgcaaactgaagcagcttgtcgttggcatgtgcaatgttaatgcctccgcccgccagtataagcggcttcttcgccgcacgcagcagcttataagcttttttcagctgtcccacatgcacgctctcattcggtttgtaaccgcggatctgcacactggaaggatactctgcaggtcctggcgccgtctggatgtccttcgggatatcgatgagcaccggtccgggcttccccgtggaggcaatgtagaacgccatcttgatgatgcgccccagatcctctcttttccgcaccgtcacgccgtacttggtgatgctccgcgtcatgcccacaatatctacctcctgaaacgcatcgtttccaatgagggataacggcacctgtccggtaaaacagaccagggggatgctgtcatagtgcgcgtctgcaagccccgtcatgatattggtggctcccggtccactcgtgaccagacacactcccacttttcccgtcgaccgggcatatccttccgcctcatggatcagcccctgctcatgacgcggtaagacgacttcgataccatcctgcttatatagttcatcaaaaagatccgtcaccgttccgcccggataaccgaacagggtggtaacgccttcttcctgcaaagctttcacaaataactttctgcctgtaatatccatgccgtcctccttaccttctctctgccgtccgtttcctgcagaaaggattattgtaaaaaactatagcccatctttttcacaaatgcaatcctatccaaagataaatcaagaatattaaaatacatcaagaacctttaccctatcaatcctactgtcttcaaaataaagatccatccggtcagggtaaatgccgccagaagcgtcgtcatcacgatcacgctcgcggtgagtacaccgtcgttgtccatgttcttcgccatgatgtagcagctcggcgtcgtcggagatgccagcatgatcagaattgcgatcatctgctccccgcgaaatcccatccacgcagcgaccggcagaaaaatgagcggctggatgaccagcttgatcatggatgccgcaatcgtcgggcggatcttcgccagtgcttttctcccctcaaatcccgctccgatcgtgatgagtgccagaggcgttgccatctgcgccacgctgttcaccgtcttatccacgatcaccggaaaatcgatgccaagaagtcccacgacaagtccagctaaaattcccagaatgatcggattctttgcaatgttgatgcaggcatccttaaccttctgcttcggatccacctccccggaatgtgccccttcaaacgtcagcacaatcacagaaaaaatattgtagagcggcactgcgctcacgatcatcagcggtcccatcgccgagcttccgtacatgttctggatgaacgccagtcccatcaccgctgcgctgctgcggaacgacgcctgcacaaaagctccccgcatgctctgatccttcaaaaacagcttcacaccgccccagatgatccagaagcacgccgtgctcacgagcgcgcagaacagcacataccggatgtcgaagaccgcccggatatccacgccggaaatatcgcggaacagcataaacggcagtgtcaccttaaagttgaaccggtttgccaccgtgacgaaattgtcgtttaacatcccgatctgttttaggatataaccgatcaccatgactaaaaagatcggaaatgttgcatccacactgtaaataaaattctccatctctacgccatcccgcctattttaccctctcgtaccggtaaaaataatactccagatcaaagtacgtctgctcctcgctgtccgccgtaatcttccactccggtctctcatccagattcgggaaatacgcatctgcatcgtatgcgtagtcaatcttcgtgatgtgcgccacgtcgcactcatccagaagctgcctgtagatcgtctctccgccgatcacatagatatcctcactgtcgtatttttttaattcttcatgaagctcatccatgtcatgaacgacaaccgcgcccggaaccttataggtatgatcgtgtgtcagcacgatatttgtgcggttcttgagcggaagcccgttcggaaaactctccagcgtttttcttcccatgaccaccaccttgccggttgtcgtctcgcggaaaaacttctgatccgccggaattctcaccagcaactcatttttattgccgattgcccaattttgatccactgctgctattaaattcattttttacgcctttctattcgtgcttacaccgcgatcgggatatttttgatctgcggtcccgtcacgtaatcctcgatcgtgatatcctttgtcgtgaactggtaaaaatctttgacatccggattgagggtaaacttcggtgccggatgctgctctctctcgatcagttccctgataatcggcacatgccggtcataaatatgcgcatccgcgatgacatgtaccagttccccaaccttcatatcgcatacctgcgccagcatatgcatcagcaccgcatactggcagacgttccagttgttggcggcaagcacatcctgcgagcgctggtttaggatcgcgttgagtgtcagcttctcatctcccggctgatgcgtcacattgaacgtcatactgtatgcgcacggatacagattcatctcatgcagatccgcatgcacatagatattcgtcatgatgcgcctgctgaatggattgtttctcagatcgtagatcacacggtcaacctgatccatcatgccttccttatactggtgcttcacgccgagctggtaaccgtatgcttttccgatggagccgtccgcatccgcccactcatcccagaccgtgctgtttaaatcatgaatgttattggacttgcgctgccagatccagagcatctcctcggtgcaggtcctgatcgccgtcttgcggagcgtgatcgcagggaactcttttgagagatcataacggttcaccacgccaaatttcttgatcgtataggcgctcgtcccatcctcccagtgcggtcttactttttccccctccgtgctggttccgttttccagtatatccttacacatatccacaaaaatcttatctgcgagactcattccgttcctcccgtttttcttccattctattctgctaattcttaattgtactcaattttccgtgaaatgacaaggtgcatttctgttgcatttttcccgcaaatgggttatattatttcttggaattttactttattttgcagagaataaagattgaacacataaaggagacagattatgagtcaggctaaagtagaccgctataaagaagagaaaaagaaccgcaagaagactatggcaaaggagaagcgcctgcatctgctcgctgttgtctgcggctggctggttgtcatcgcgctcgcaggctgggctggtgtgtccggttaccgcatctatgagagcaagaagccggttgagaccatttacgccaatgtcgatgccatcaccgattacatgaattccttaagcacagaagaataacgcaaaagaacccggggcgacttttccgcacccgggtatttttctgccatcctgcaatttttctatgtacgctcttctactctcccgtctctgcgccagagagttccgccttcgccagtgcattctcaatcgcgttcaacaataccactgatgtatactggtaatccgcattgtatgtaattccttccgtggtctgtttttccaccacctgatccgcaatgttttccaatgccggctccatcagcggatacattgtctccaccgtctcatcgagattgaccatggagacggactgaatccggttttcatccacaatcacctgcatatccaccgcatgctctccaaactggatcgatgacgtgtacactcccgccacatacctcattgtctctaccgactctccgtcctcttttccgggcaggaacatgaacagcagtaaaaaaatcagcagaattccaagtcctgcgaaaatcagtgtataaatcagttctttcatatgaagaaccacgatctttgtctttgcactcatcttaagcctccgcatactgattattacattatatgtggtgtactctttcccatgactgctttactctcaaaaacgctttaaaatcacaaattgttcaagtttttcaaaaaatataaaaaaaggcgttgacaaatgctcgtctacgctgtatgatatcaaatgtgtccggcagacataaccgacacaacaacttatgcgcgagtggctcagttggtggagcacgaccttgccaaggtcggggccgcgggttcgagtcccgtctcgcgctctgggaaaagagatacatcgcatgatgtatctctttttttcgtacttcttcgctccgctccggtcggcgcagagcagaggctaaaataatatttccaccagaagaattgatcatatctgtattgcattcctgtttctcttttatcagcagctaaaaaggctcaccaaaaagcacctaattgtactttttagtgaacctttttataataagctcaaatccagttcaatgcatgcatctccccagtaaaaacctccaacgatttttgttctatgtctgatagtgtacattttctctttcttcatgtcaatactaaattataggaaatttgtgtgtttcggattatgattctttttatctatatactctattatactgcttacaaaaaagtacgcatcttttatataagaatttttctcaaagaactccttatttcttttcattcttcccttatcatcacaaaatagtgtccttatctcttgcatttttttatttcttacattttttgtagctgataccttcataacatcgttatatacaaaaagcaatgtcacaaaatcatgtataacaggatttttcatcatgccttctctattcaaatgtctcagttccggtgcttttcccaacacatttgctaattcttttgttttactaaatttctttacactattaggttttttcaatgaactcaaaaggcaattattatgtgccgcagcattcctaataaatttaatcgacttcaaatatggaatgtaattaaatgatttgtatgtttggtaataaaccgtatacaattccataaaattcccaaatgacaacaactccacaatattccacaccgcaagtttttctggttcattatattgatttaaatgtttctctgctaaatcagagcaaaatgaatacgtacttgcttttctttttatgtcttcctgcgccgatggattatattgcaaaaacacctcaactatattatatccatcctcaagaggattattacttaagtcattcatcaaacgtacttttaaataatgttcaacatccaatgacatttctaaaattatttttctaatatgcatatctagttttgaaagttcaaccaaatatgcaaaatccagattataatatttcttagtctgtggatttacaacatagtttctggcatatgattttaatttaaagtaataattattatacttcaaaaattttttggcatcttcaatggaacatatttcaaattgcacatttttggttctcatatccgtaatttgttcatccactgtcagcttaactttatcatctgtctgattttccatattactccattccgttcgacttataacgcgccataattaattacgaaagtgattgatatttctattctcttttataatgatactgtattatacattatactacgcaagtaatctttttaaaacatatttttgattacaatttgattccattgcccctcctcctttcatgcgggtttgcgcgtcgtgttttcgaccaagtttctttgctccgctccggtcgttgccagcgtccaccagatgctggcaacgtctcgcactccgggtactggtttcttcgtaccgctttaatctgtataaatatttcaaatttagtgttgacaaattgtaactcatgttgtatgatatcaaatgtgtctggcagatataaccgacacagcaacctatgcgcgagtggctcagttggtggagcacgaccttgccaaggtcggggccgcgggttcgagtcccgtctcgcgctctgggaaaagagatacatcgcatgatgtatctctttttttcgagtcctgccggaccaggtcgttcgagtttcttcgctccgctccagtccgcgtagagcagataaattctatttgcccttgtctaatggcataatgatatttcgttaaaagttaaatcaaaaaagacatcaaattctacctgtcaaagtagattgatgtctatttttacctataaaaaatgggcactgccatatcagcggctgccacacaggcagcttatgttacatatattcacacactaatatgggcttacatacccctcaaatttctattggtgtcctaacatatagtatatgaaaatacaagcgtttattcccgttctgctccgtattttataccaatattttcaacactatatgtcttattttccgaactttttataatgacattcggcttccgatggatgtcatttttccataccgagtccttctcctttacttgcaggatttacaatacagctccgcccacatcggcacaaatcccgccccaagtgctactctctgcgatgctatatgtgacattgaggtaccataaaacggaagcttcccgcgctttaaaatctcgtttttcaggaccgcaacaagcatggaacctattccaagtccttctgcctccggcatcacattaattccaatctgccacatgctgtcgctgtcgcttgtagcgcccgccatgccaagaaggacgccatctctgtaagctcctaccccaatttcatccttgggcagctcatgaaagagaaatgcttctccaaagcgttcatctcctctgaatggctccagttcttctccctcaaagattcggatctcataatctttcgtgtctacctcggacatttcggtcgcaatataaaatggatgagcctgtgcaatctggcagtggaacatttttaaacctgcttccagctcatgtaaagcttccacgtccatgaaccaggcgccgcttctgtctttaaatgtttccctcacccatacaataatatccttcttaccggatgcaagaatcttgccattgatgcaggcaatcttcagaaaacattccccttcttcaaaaatcctgcgtccctgcagcggggtatacacagtgaagatattttccctgctggtaactgctccttcctctgtacagaaatcaatcgccagctgctttaccaatatctcgttcatacttttccacaattcttttctctctccgccatccagactttcctctcttgaccgatgcggcggccatcctgcaatcggaccaacctccgggtcttttgcatattcaaataaactgtccgcgtcttcctctgtccactttctcaatagcagccgttctgtttctaacatatcgtattcctttccactccctgccacgtaaacctgcccgctttccaaacagaaacagttctactccgcgcactgttcttttgcttcggcatcgggtcctaacattcccagcttaaaatgtcttctgcagagcgccacatagctgtcgtttgctcctaacatgacctgcgggccagagcgcacaatgccatgctcgttgtatctcgtattacaggtagcttttctgccgcaccagcacaccgtctttaactcctggatcacatccgcaatcgcaatcaggcgctcgctccccgggaacagcaggttgcggaaatctgcgcgcagtccgtaacagaccaccggcacatccataaaatccacaatatcagacagaaaatccacctgctgcggcgtggcaaactgcacctcgtctacaatgatgcagtcatatccgcgaatctcctcctccttcatctgctgcagttcttctaacagaatgcagtcatgttgaagcccgatccttgaatataccgtccgctcgccatctctggcatcgatcgccggtttacataacagcgctttctgtcccacttcctcatagttaaaatgcgtcatcagcgcatttgccgtcttagaacttcccattgcaccatagtaataatataattttgccatcaatccaccctctgtcgctgcctgccgcccacttcctgcatacagtcattttcttattaaaaagcgctgtgcgccacttctatccattatacctgtacttttctgcaccggcaagtacctttccattctcccgtgtccacattccatttctcccgtgtccacattccattcttcttgcacaccacccattttttcgctataatatcttgtgcacgatttacgaaaggcatgggatgatatatgaataaaaaagatatcttggagttaaaaagacgttttaaaaaggatgcctgcaccttcaccagactctgcggatgctacgtagacgcagaccgcaacaaggtcacaaccttcggggagaccttcttaaatctggaggatgaggaattctataaatacctggaaattgcaaaaaaagtcatgtccggcacgatcggcaacaacattctggagctggagtttccgaccgccgaggaggcacccggcggaagacagcagtttttgatggggctgcgcgagagcgccttaaaaaacgacgatctgatggacacattctatgatcttgtcattgagaattacagttatgtcgggaattatctgattctggttttccacgacgcttacgatgtcatgaccaaaacctccgacaataataagctcgacgaatccgaggaagtctacgagtatctgctgtgtgcgatctgtccggtcactctgaccaagccggggcttggctaccgcgaggacgagaaccgtatcggaccgcgcatccgcgactgggtggtcggcgttccggacacaggttttgtttttccggcgtttaccgagcgcagcagcgatattcactccgtgatgttctacaccagggataccaagacaccgcacgcggaattcatggaatccggtctcggctgtggcaccaagctgaccgccaccgagaaaaagctgacattccagagcatcatcaaagaagtcatcggtgaggatgaggaagagagcgacgctgtcttcggggatatccaggaaaatctgaacaatatgattccggtcacggaggacgagacggtggaaccggaaccggtcatcgtcaccagatccgccattgcagatgtccttgcagaaagcggtgttaccgaagaacaggctgccgtcattgaaaagacctacgaaaatgtatttggcgaggaacttccggaagccggtcaactggtcgatccgaagcttgtggaagccaacggaaagcgcaaggaaaagctggagctggtaaaacaggtcgaaaacttaaagcagcagcttgaggagacgcgctccgttccggtctcggagggagatgccgatggcgaagatgtccctgccgtcaagacctacgatgtcatcctgcgcgtcaagccggaaaaagtcggacagattcactcccaggtcatcgacggacagaaatgtctggtcattccgatggatgaagatgagcacgccgctgtcaacggtgtcaataccaccgtataatacggatcgatgcaatcgatgacgtatggaatatgttccataccggcagaagccagcagtgacggcattcatgccaccgtatcctattttgcataaaacccgtcatgaaatgatttcctttctcatttcatgacgggtttttcataacaatcctgtttcagacgcaggcacagcgtttattgcgtcagccgctctctgatatactgctccatctcatccttcggtatgccgagtgtgagcgagagttcactgtacagttcattctccgctgtccgcatgtagcgctcgtccagcgccgtgatcttcttcccctgtgccgtgcgctcctgttttctgatgtatagtgtctttacaatgctgacccacgcacgataatcgcaggtgttcattgcctccttgtatctcgcctctctctgcctgtcatccggcacccagagctgctcgatcttaggcatatcctcaatcagctgatccgcttcctccctggaaatcactttgcgcatcgtaatcttctgattgtccgtcggtgcatagatccttccactgccatcgccaaccggggcaagaacataatacaaacggtctttgtccgccccggaaatgtcaatgtgggtaatatcctcaatccggcatacacccttcactccatacacaatatactcaccgatctcaaacatcttccccgattctcctttcatcacagttttaaagcatccatttctattttaacacgaaaaatcccgatttaatcaatattttccgcttttttccaattttcgtaactattgccagaaaacaggcggcgtatgattgtacatatttgccaaaataggaagtaaaaaagactcctgtcacagaatttttgcgccgggcgcggtcatgcggcatgcttcccattcgcgcggtcacgcatcttcacaacatatttttgtgtgacagggatgaattctcccaatcgagtaggaggcggtgtattgttcacgtctgtccaaaatctctgcatccgctttttcaaattgcttgaaactgttgttctgtttcgagctgcacaacagtttcaagcaatttgtctttgtctgtgccgtttaatatacgctgcactatttttttagcatgggcatctttatacgatcttaatacagtaaaccagatcattacaccttttttttatatttcacgttatactctttgtaagcaagcagaaaaaggagaaatatatatgcttgaaattatacatagaaaaaaacggctgtcatcctttaagctgattgctctgggttttgccggagtcattgtacttggagcacttatcttgatgctaccattttcatcaaacaccggatctgttacaccatttcatgaggcactgttcacttcaacctccgctgtttgcgttacggggcttgttgtgcaggatacaggcagctattggtccgctttcgggcaggcggtgattttgctgcttattcagataggcggacttggcgttgtgacggttgctgcaacatttgccatgctttccggcagaaaaatatcgctgatgcaacgcagcaccatgcaggatgccatttcagccccaaaagtcggcggcatcgttcgcctgactcgctttattgtacgtgggacttttctgatcgaacttatcggaatgtttgccatgctaccggtattttgcagagatcacggtttcaaaggaatttggatggcggcgtttcattcggtctccgctttttgcaatgcaggattcgacatactcggcaccaccgaaaacaaatatccatctcttacgggatacgtcggagagccgacaataaacattgtaattatgattttaattatcgtgggcggcattggctttttgacttgggatgatatctgtacaaacaggtggcatttcaaaaaataccgtatgcaaagcaaggtaatattagtaacatcggtgattcttattatcgtccccgcaatattttttttcctcttcgatttcacaggactgccgcccggtgagaagatccttgcctcgctttttcagtctgtcacaccgagaaccgccggattcaacaccgccgaccttaccgccatgactgaatcttccaaagcaattatgatcctgctgatgcttgtcggcggctcacccggttccaccgccggcggtataaaaacgactacgcttgccgttctgatcttgaacgcattttccgtctgccgtaaaaaaaacgatactgaagtctatggcagacggcttgaatgctcggcggtaaaaagcgcctcaaccatcgccgtaatatatttcctgttattttttatcggcggcattattatcagcacggcagaaagtatgccgcttagcgcctgcctttacgaaacggcatccgccgtcggaacggtcggccttacactcggcgtaacgccgcagctcagtgttttttctcagtttattttgatcgtcttaatgtatctgggaagagtcggtggacttaccctgatctatgcggcgatctctaataaaaatcagagcggtgcaaaactgccgctcgaaaagatcacagtcggataaaggagttactgttatgaaaaacatattattgataggtctcggcagattcggtaagcatattgctttgcaactgaacaaactcgggcatgaggtgatggcagtagacagcaacgaagaaagaataaatgaaatcctgccgatcgtcaccaatgcacagatcggcgacagcacaaatacggagtttttaaagtcgctcggtatcggcaactttgatgtatgcatcgtcaccatcggaggtaattttcaaaactcacttgaaactacttctttgctgaaagaactcggtgcaaaattagttgtgtcccgcgccgagcgtgatgtacaggcaaaattccttctgcgcaacggagcggacgaggtcgtttacccggaaaaacaggtggcaaaatgggcttctattcggtataccgccgaccacattcgggattacatcgaggttgatgattctcatgccatttttgaagtagaggtaccagaggaatggatcggcaaaaccgtcggagagctcgacatccgcaggaaatacagcatcaatattatggcgactaaggagaacagaaaaatcaatatggcagtttcgccggaaactgttcttacagacaagatcacacttttggttctcggtgcttataaagagctgcaaaagtgttttcgcatttaacagaggtgaacggcattggctgaactattgctgattatcagcttgcttggcgtatttgctttcggcttttatcttatgagcaggctggaccgatttcttgagaaaaacaggaaggcgctgttaaaaggaaacgaaccccgtgagttttccgaaattttgctgccgcaaggactgtccgacagtgagatattaagcgagatccgccattttcgggaaacacacggaaaagtcgatattatcctttctgacggaaaagaggatgcgttttagtttacggtagaagattttacgattttgttgtataatgaaaccaaaaaggcggtgaaaccgatgcaaatacaaaccgaacagccaaaaaacggtgcggacgagcatatccttgtctgcctttcctcttcaccgtccaatgcacggatcatacataccgccgcaaagatggctaaggttcttcatgcaaaatttaccgccatctatgtgcaaaccgattcggttgaaagcgaaaaaaatcggctgcggcttgaacaaaacattcagcttgcgcaagggcttggcgctgagatcattatgacgcacggcgaggatgtgccgctacagatttcggaatatgtccggctttcagatgtgaccaaaatcgtgatcggacaaagcagcgcccgccgcagaggactgtttggaaaacccaccctaactgaaaaactgatttcggtcgctcccaatgtggatattcatatcattccagacgcactgaactatgtaagaccgcaccggcgccgtttgcttttcggtgcagaaacaccttcgttgcgggatattggcgtgaccgttctgtcacttgccgtatgcacggcgatcggttttttgttcgatcatctcgatttccccgacacaaatatcgttacggtctacattctcggcgtactgatgatctccgttttgaccaaaggatatctttgcagtatggcaggctcgcttttaagtgttgtattgttcggatttttccttaccgaaccacagctatcattcaaaacctatgctgtaggctatcccgttacctttgccgtcatgctggtagcttccgttctcaccggcacgcttgcctcgaagcttaaggatcatgcgagactttcagctcgttctgcgttccgcacgcaggtgctgttcgacaccgaccgtctgctgcaaaaagcgaaaagcaacgatgatatcttaagtgtgacctgtatgcagctctctcggctgcttgaccgcagtattgttgcttatacaaaaagtgaaaatggaatgtcgaccggacggcttttcgccgaaaaaaagtacacatactctgaaaatctgctgaacgctgcagaacagaaagccgcagaatgggcatttcaaaacggtcgccgtacaggagcaacaacagcacagttcggaaaatccgaatgtctttatcttgcgatccgtgcaggggacagagtctatggagtgatcggaataccgatgagacctgaaaagcccgattcatttgaaaacagcatcgtgctgtcagttgtaaacgaatgtgctctggcaatggataatacacacaacgctgctgaaaaagaacgtgcagcagatcttgcaaaaagcgagcagctgcgcgccgaccttttgaggtcgatctcacacgatctacgcacgcctctttgctcgatttcaggcaatgcggacacacttttgcataacggaaactgcttggacgaaacgacaaagcaacagatatataaagatatatatgacgattccgagtggctgattgacgtagtggaaaatctgctgtatgttacacggctgaatgacggacgcctgaagctggagcttaccaaccagcttgtagacgaagtgatcagtgaagccgtttcacatttgaagcagaagtctgtcgggcacacggtaacggtgaagtgtgacgatttgattcttgcacgcatggacgcacaacttatcgtacaggtcatcgtcaatcttatcgacaacgctttgaaatataccgaacaaggctcggagatctgcgtaagtgcagaaaagcaacgaaaatacgccgtgatccgtgttgcagataacggtagcggaatccccgacgatatgaaatcgcatatttttgaaatgttttatactggaaaaagtacagttgccgacagccgcagaagctttgggatcggtcttaccttatgcaaatcgatcgtagaactgcacggcggaacgctgacgcttagggataatgtgccgtgcggctgtgtatttacctttactttaccgcttagcgaggtgactctgaatgaataaaccgcttatacttgttgtggaagacgaccgcccagtccgcaatctgatcgtaacaacattaaagtcgcacgattaccgttacctgactgcggagaacggacatggtgcgattatggaggcgacctcccataaccctgatatcgttctgctggatctgggtctaccggatattgacggcacacaggtgatcgaaagcatccgctcatggtcgaatatgcccattattgtgatcagtgcgcgtagcgaggatcgtgataaaattatggcacttgacgccggggcggatgactatttgacaaagccattttccgtagaagagcttttggcacggcttcgtgtcacacaaagaaggctgttgctcctgcaagcaagtggcgatgccgacaccccaatttttgaaaacggcgagcttaaaattgattatgccgctggctgcgcttacttaaaaggggaagaattgcatcttaccccgattgaatacaagcttttatgtctgctctcccataatgtcggaaaggttctgacgcacacctatatcacacagcagatctggggcagcagctgggaaaacgatattgcctcgctgcgggtgtttatggcgacactgcgtaaaaaactggagctgcaaaaggacagtccgcaatacattcagacgcatatcggcgttggttatcggatgctgcgggtagactgagaaaagcgagaaaacaagaaattgaaccgatatgcaatagaaaatcctttcggaattcaagagcgcaatatccgcttggtacggaatcatcatcacctacggtatggtgcttggttttgctgtggcaatataccgtttgattttcgaatgggataataacaaaaacgacctgctttctgttttagtagtcaatcctggcggccttgccatttacggcggagtacttggcggtgtcgtagttgcattgatttaccgtaaagaaaaacggatttccccttttgggcgcttcactcaccgttaatatcacaggtgctgtccggctacctgattattttcggtatcgttacaatttttattatctgtaaaagaaaggcgatgcggcaatgagaaaagaatggactttattttttacctttcttaaaatcggcgcttttaccttcggcggcggatatgctatgattgcgttgcttgaaaacgaatttgtagaacgcaagaagtggatcaaaaaggacgactttctgaatatggtagccattgccgagtctacacccggaccggttgcaatcaacagcgccacatatatcggctacaaaattgcaggcttgttcggtgctgcggcggctaccgtggcggtttgtattccttcgtttaccgtaattttttgcatctcactgttttttgatcaattcttaagccttacatgggtttcccgtgctttccgcggaatacaggtatgtgtgatctatctgatttcctctgccgggctgaaaatgctgaaaaccattgaaagaaatgccttcaacacggtcattttgctgtcggtcattgctgcaatgctggcgtgcactgttttcgccgtttctttttcttccgtttactatattctgatttgcggtacagcaggacttgcgattttcttcctgaaaaaactgcggaaaggaaacggcaattaacaatgatctacctgaaattattcctgaattttttaatgatcggtgccctttccttcggcggcggatacggaatggtttcccttgtaagagaaacagtcatttcaaacggctggctaacggaaagcgaattcttaaatttcattgccgtttcggaatcgacgcccggtccgcttgccgttaatatggcgacatttataggttccacgcaaggtggcattctcggctcgtttcttgctacgctcggcgttgttcttccgtctttcattattatacttttaattgcggcggtactcaaaaacctgatgaaatatgccggtgtcaacgcttttctctccggcgtccgcccctgcgttatcgcaatgattctcgctacggcaatcggtatgaccatatcaacattgcttggttttacggatatttattcggcgcttgctccggatcctaaatccattttggtctttgccattctgtggctgacacatttcggatataaaagaatcaaaaaaactgcaccgtcgccgattataatgatactcttttctgccgcactcggcatactgctttggggagtataaaatgcatcctatgccaatttgccgtccgggaatcgggcggctttgctaattgtttgggaatgcactgttcgtcacctgtctgaacgattatctggagtaaacctcagagataaacgtcgcggaaacctttgaggtttatgcagaaaatgaatttaagtatggaacatacaacgaagaacaaaactcacgtttagcatcaggacataatctaaagcctgttacaaccaatttcacaggacgcaaaccagatgaaatatatgcggattttgtttttatagatgatggtaaatatctcatcaaatgtaagaataattgtgtacctgaagaacgtatttttctaaaaacatgggtgcgaaagagagtattttggaaatccgttggttgtacaaagcaattacatacatgcaaacagaagaattctctgaatactcataatttagaaatagagttgaggcaatttcatctcttctccgccaaaggtatcatgtgaataggaaagatattagattataccaatagcttagattcgtatgcttcaaataagaaaacagcataaaatcaatgaaccacagtttcaaaatatcaataaattataggatcaaaaattatatctttcacaaattcgtgttaaattttcaaggtacaagcaaaatcaaatattaaaatgagcttttgacaccctaattctataagttaaaaaagcgccccgcaacgcgggacgctctccgtgtgcacagctcaaatgggtaaaatttgctgtgcgaagactgcggcagggaaaccacagccttttggtatattaaattagggaaaggaattatcaattacaaaagcgataatacgtcaatattatctctgtacacgtccggaagcatcgccgccagccagtttcttgacctcgtcaacgcttaccatgttgaagtcaccctcaacagaatgctttaagcagcttgctgctactgcaaactcgatcgtagactgcggatcgtagtcgtttaagcaagcgtagatcagtccgccgccgaaggaatcgccgccgccgacacggtcaacgatatgcattaagtactccttggagaagtagctctgtccatcctcgtaaagcattgctgcccaacggttatcgtttgcggagatggaagttcttaatgtgattgcaaccttcttgaatccaaaacggtctgttaacttctgtgcaacctctttgtagccttccttgttcagttcgcctgcggtaacctctgtaccctcagacttgatgccgaatacgtcgtttgcatcttcctcgttggagatacatacgtctacatacttgcaaagctcgcccatcacctgtccggctttctccttggaccacagcttgttgcggtagtttaagtcgcagcttacagtaatgcccttagcctttgcagccttgcatgcctctaagcagattgctgcaacgttgtcaccaagtgcaggagtgattcctgtgaagtggaaccagtcagcaccgtcaaaaatcttatcccagtcaaaatcagcagtcgttgctgttgcaatggaagaacctgcgcggtcataaataaccttggacggtctctggcttgcacccttctcaaggaagtagatacctacacggtcaccgccgcgaacgatatcagaagtgtctacaccgtactgtcttaacgcattcacaccagcctgtccgatctcatgagccggaagctttgtaacaaagcttgcatccattccgtagtttgcaagagatactgcaacgtttgcctcaccgccgccgtaagtagcgccgtaggtaccagcctgtacaaaacgatagtatccttccggtgcaagacgaagcataatctcaccaaatgtaacgactttctttgccattattgaatcctcctaaatgtatgtttcactatgtgaaaccgtgtttcattttctataataaaattataacatctaataccagaatgtcaaatatgtttttatttaagtccaaaaaaattccaaattatttccgattttcacttttctattttagcaggatgatatataataaaaacagattggttcacattacagaactatgtttcgcaatgtggaacatacatatcgtatccatagacacagtgtgctgcattttctcataaagcattctttttgagatgccgtgacgtgtcggaatttttactttcttatttattcttacatcatcaggaggagattatttatggaccgtaaatacgatgtcatcactttgggggagattttactccggctttccacgccgatcaacggacgtcttgcacagggcgacacgctgatgaagcacctcggcggtgccgagctcaacattgcttccgagatcggacagctcggccttaagacagcaatcatttcaaagattccgaacaacctgctggccgctttcatcaagaaccagctcaacgcttcccgtgtcagcgagaattatctgatcgaggatcactcggacgacagccgcgtcggcatctactactatgagtacggctcctacccgagaaagccgcgtgtggtctatgacagaaaacattcatccatcaacaatattgacatcaaggacgttccggctaccatgttctacaataccaggctgttccacaccagcggtatcactttaggactcggcggcaacgcacagaagttcgcgatcgaatgtatccgcaagttcaaggagaacggcaccctgatctccttcgatgtcaactaccgcgcaaacctctggagcggcgaggaggcaagaaaatgcatcgaatccatccttccgtatgtcgacatctttttctgctccgccgacactgcccggctgaccttcggcaagaccggcacgattgaggagatccagaagtccttctgtgaagaatatccgatctccgtggttgcctcgacagagcgcaccgtcatcacgccgaagaagcatgactttacttccatcatctactctgcgaaggaagaccgctactacagcgaatctccttacaacagcatcgatgtggtcgaccggatcggaagcggtgacgcctatgtctccggcgcgctctacggttacctgagacaccacgactgccagaaaatgttagagtacggcaacgccatggccgccatcaagcacagtgtgatcggcgatatggtctttaccgatctcgaggagatcgacggcatcatcgcccagcacaaggatacctccggcttccagcttgagatgaaccgctaagtatcattttcctgcgaaggaatgaagcgtgcgcctgccgcacactttgcgcggcagataaaaaaatgatggcggcagtcccgcggatactctccgccggactgccgccgtttttattctgaatcttctctatggttccgccgccggctcctttcatcagagccggctcttttccggaatcacgatccttttctcttctgtcgaaggagaatgttcctcatccacctccggagcatttccggtgcggtgtctcttcacattttcgcaaccagtgcatccggcacggtgatgcgatccagatgccagatctcatccacgtactcctgaattgtgcggtcagaagagaatttgcctgcatgggccgtatttaaaatagcgctcttcgcccatgcctgcttatcctgatagtactccacaatccgcttctgcgcatccacataggaacggaaatccttgaggataaaatacgtgtctgcatactgcgtgcactgcgtgttgagcagtgaattgtagagatcgcggaacaaccccggatcgttcggcgaaaatgtgccgtccacaagctgatttaccaccttgcggataccctcgtcgctgttgtagatctgcatcggatcataatcgcggttgcgctcatgcgcaatgacttcctcggagctcatgccgaaaatgaaaatattctccattccgacttcctctgccatctccacgttcgcgccgtccatggtaccgagtgtcagcgcaccgtttaacatgaacttcatattgccggtaccggatgcctccttgctggcagtcgaaatctgctcgctgacatccgccgctgcgaagatccactccgcattggacacgcggtaatcctcgatgaatacgaccttgatctttcctttaatgtccgcatcgttgttgatgacgtccgccacactgttgatgagcttgatcgtaagcttggcgttccgatagcctgccgccgctttcgcgccgaaaataaaggttctcggatagaaatccatctgcggattcgcttttaactcattgtacaggtacatcacatgcagaatattcaagaactgtctcttatactcatgcagacgctttacctgcacatcgaaaatggaatccggatcaacctcgatgccgttgtgctccttgatgtactctgccaggcgcactttgttcctgcgcttgatctccatgaactccttctgggcttttgcgtccgatgcatacggaaccagacgtgcaagctgcatcagctctgtgatccagccgtcaccgatatgctttgtcacccagtcggcaagcagcggattgccgtgcatcaggaaacgtctctgcgtgatgccgttggtcttgttgttgaacttctccgggaacatctcataaaaatcatgaagctgctcgttctttaagatctccgtgtgcagtcttgccacaccgttgacggaataaccggctgcaatggcgagatgcgccatcttcacctgaccgtcgtaaaggattgccatgcgggcaaccttgccgtcatcccccgggtagcgttcctggatctgcagtacaaaacggcggttgatctcatccacgatctggtagattctcggaagcagccgctgaaaaatctcaatcggccatttttccagtgcttccgccatgatcgtatggttggtgtaggcacaggtcttcgtggtaatctcccacgcctcgtcccagccgagaccttcctcatccacaagaatacgcatcagctctgccaccgtcaccgtcgggtgtgtgtcgttcaactggaacgtcaccttctccggcagtctgcggatgtcatcatgattcttcttgtaacgcgccagcgcacgctgtacactcgcggatacgaagaaatactgctgctttaagcggagctccttgcccgcaacatgattgtcgttcgggtaaagcacttccaccagatttcttgcaagattctgctgctcgaccgccttctgataatctcccttatcaaatgaatccagctcaaaataatcctttgccgccgcatcccagatcattaacgtattgaccacattgttgccgtatccgaccaccggcatgtcatacgggatcgccagcaccgactgataatcctcctgcacaaaacgcaggcttccatcctccctgctctccgtgcgtacatgtccgccaaacttgatctcgtaagtgtactccggtctgtgcagttcaaacggataaccatttttcagccagttatcaggcacttcgacctgaaagccgtcctgaatcttctgcttgaacataccgtagcgataacggatcccgcagccgtaagccgcgtatccgagtgtggagagggaatccataaagcaggcagccagtcttcccagaccaccgttgccgagtgccggatccggctcctgatcttcgatcacatcgagattcagaccgatctcatccagcgcttccctcacttctttatattccttcagattgatcagattattgccgagcgcgcgtcccatcagaaattccatcgacatgtagtacacgatctttggatcttccttgtcaaatacctgctgtgttgcaagccatctgtcattgatgacatccttgaccgcgaaggagaccgcctggaaaatttcctgctgatccgcctcctccaatgtcttgcggtataaattcttcagattatcgcgcacactctgaataaaggctttcttgtcaaaaacacctgatttcatctagtttcctccttttttcactcccagaagaacatgttcgccgttaatattccattccttgctgtaaacttccggctcatccgcaaatgctccggctgtatccgccacgacattcacgccgagaacgtccgatttaattgtatcaccatactgctcaaaaataccagatactttttcatctgacttgtgatagatcgtgatctgatccatcacctcgaatccggcttccttacgcatggtctggatcttgctgatgatctcacgcacaaagccctcctcgataagttccggtgtcaggttcgtatcgagcaccactgtcacggtgttatctccctcggtcacataaccttccatctgcgtcatggtgatcaggagatcctcctctgccagcttgacagactcgtcaacggacggaagtgcaagcacgccgtttgcctttaattctgccatcgccgcattgccgtcaagcgctgcgagtgctttctggatctgtcctaagaacttgccgtacttcggtccgacggtgcgcagctgcggcttgaacgtgtagcttgtgtaagcgctcacgtcgtctgtaaatgtcacttttttcacattcagctcatcctcgatgatctccacgaagaactccggcagtgcagacggagcttttacgaacatgtttccgatcggctgacggttcttgatgttcgcggaattacggcatgcacggcccatgacaacgatctttaagacctcatccatatttttctcaagctctgcatcgatgtacacctcgtttgccaccggaaaatcgcacagatgaatgctctccggagccgtctgatccacggagcgcaccagattctgatagatatcctctgtcataaacggaatcatcggcgccgcacacttgcagatcgtcacaagcgctgtgtagagtgtcatgtacgcgttgatcttatcctgctccatgccctttgcccagaaacgctcacggcttcttctgacgtaccagttgctcatgtcatcgacgaaatcatccagcgctcttgcagcctccggaatgcggtaattggaaaggttgttgtccacttccttaatcaccgtattcagcttggagagcagccatttgtccatcacggaaagcttctcataggcaagcacatattttgatgcatcaaaattgtcaatgttcgcatacagcacgaaaaacgcgtaggtattccagagcgtacccatgaacttgcgctgtccctcctgcacgagcttgccgttaaaccgcttcggaatccacggcgcactgctcgtgtagaaataccagcggatcgcgtctgcaccgtaagcagagagcgcctcaaacgggtctaccgcatttcctttggatttgctcatcttctgtccgttctcgtcctgcacatgtcccatgacgataacattctcaaacggagccttgttaaataacagtgtactctccgccatcagggaatagaaccatccacgggtctgatccacaccctcggaaatgaatttggcagggaactgctgcgcaaacagatcctgattctcgaacggatagtgatgctgtgcaaacggcatcgcaccggaatcaaaccagcagtcgataacttccggcacacgcttcatggtcttgccgcagtccgggcaggtaaaggtcacttcatcgatatacgggcggtgaagttcgacctccgcagccttcggatcgccgcttttctctgcaagctccgcgcggctgccgatggactcctgatgtccgcagccctcgcactcccagatatttaacggagttccccagtaacggttacgggaaataccccagtcctgaatattctcaagccagtcgccgaaacgtccttttccgatggattccggaatccagttgaccgtattgttgttgcggatcatatcgtccttcacagcggtcatcttgatgaaccaggactctctcgcatagtagatgagcggggtatcgcatctccagcagtgcggatactcatgctcgaacttcggcgcgtcgaaaagcttgccctgtgcctccagatccttcaacacctccgggtctgcttttttcacgaaaatgccggcatacggcgtctccttggtcagttcaccctttccgtctacaaactgcacgaacggcaggtcatattttctgccgacattcgcatcgtcctcaccgaatgcaggagcgatgtgaacgattccggtaccgtctgacatcgtaacgtaggtgtcgcaggtcacgaaaaatcccttcttgtgctgtctgtccgccacttcttttgcgcaggcgtacagcggctcatactccttgtgctcaagctcgcttcccttataggtctcaagcatctcgtaagcctttacctccggcgtatccggctcgccgtccctgcccttttcggctggtgttccaagccgtccgagcactttatcgagcagtgcctccgccatataataggtataaccgtcggctgcctttaccttgcagtaggtatcctccgggttcacgcagagtgccacgtttgacggaagtgtccacggcgtcgtggtccatgcgaggaagtaggcatcctctccaacaaccttgaaacgaaccacagcggaacgctccttgaccgccttatatccctgcgccacctcctgtgaggaaagcggagttccgcagcgcgggcagtacggaacaatcttaaagcccttgtatagaagcttcttgtcccagatctgctttaacgcccaccactcggactcgatgaaattgttgtcataggtaatatatgggttctccatatccgcccagaaaccgacgatgtcggagaaatcctcccacatgcccttgtactcccacacggattccttacattttttgatgaacggctcgattccgtactcctcaatctgctccttgccgtttaagccgagcatcttctccacgccgagctctaccggcagtccgtgtgtatcccatccggctttacgcggcacatattttcccttcattgcctgaaatctcgggatcatatccttgatcgtacgcgtctccacatgaccgatatgcggcttgccgttggccgtcggcggtccgtcatagaacgtgtaagtctcgccctgcttgcgctgctccatactcttcttgaagatgtcgttgtctttccagaactctcttacctgcttttctctgtccacaaaattcaggttcgtgtctactttgttatacattttttcctccaaaataaaacatttaaggctcccgtcctgtaaataggacgagagcctttatcgttataccacctaattacattgtacacagactactccccgcacagaaaccctgggtgtgcttctgcagcttgaaaaaatctcatccggagaaaatctggatacccgttccctttaacgcaggaaaagcgtcagcgcctaccgtgctgccttcctgtctgacacaggctctgctgtgccacatctgcggctgcatttcgggctgcggcttggaagggatcttcgtctgcggcttactcgcaccggctctcaccgccccggctcgctttgcctttcatccacagcttactgtcttcgtcactgcctttgtcaactatgtgtaagtataagccttgcaagcccgcattgtcaaggtctgaaatgccgtttcccgtctcatccggcgcgcctttcgtgcaccgtctgtgctatctccgctttgcaatcgtcgaaaaaaaacgctccttgatctggtcgatcaaaatgaccgccttgccgtccgaaccggtaaacggtacaaagccacctgccatcgcagcatgcccgccgccgtttccgatcccctgcagcgcctccgccgtgatcttgccggcgtcgagagaagatttttcactccggacggacagtttgatgccatcccctctccttgagtacaccacggaaaaagaaacctccaccagcgccagcataaagtcagagacactcgcgatcaatgcctccgggcagtcctcccccgtatcggcaaagctgatattatcgtacacctcaatgctggaaatcgccttggaatacgccaccagatcctcaaaacacaggttgctgttctccagtgtgtggatctcctcataatcacagtcatcgtacatccgatagagcatctcgatatcgagctttgacacgccgcgtgaaagattgtgcgtgtcaatgcggatgccgtatgtcagtgctgttgcgatctttttatccatcgcaatgtcattttccataaaatactgcgcgatcatcgttgcgcacgccccgacctcggggcggatgtcctgaaaccggtactgacacttatcattgtaaggatgatggtcgatgcagatgatctcatctcccgtaatattgatgatgttggaattgcccttctgggaatccaccagtatcacttcgtcctcatccgtcagcacttcggtcagatcctccacattcaacagttcaatgtcaagaatctcacacagacggccggtaccgtaccggtcgatcttgcccttatagcagatgctcgcctcgatacccctggttgcaagcagccgcttcagaccatatgcacttgcaatcgcatccggatccgggaaattatgggtctgtatatagacatgctgtctgttgatctgctgtagtaattcttcaaactttgtcatgctttctctctcctgcatgcggctgccggctcacatggttccggcgctctgttctctggctgcccggtgctgccggctcacatggtccaagcgctctgcgttttgctcgccgatgaaatatcaaaggtttttaggtctgcaaaggttttcagttccgggaccggctccgcaatctctccgaatccatatgcggcgtggataaacccgactcctgccgcccggctcgcatcataatctccttgaatgtctccgacatagaccgcctcatccagccggttccgctctacgaccagccggatattttctcccttctgccgcagattattgccataacactctatgtcctccaccagttcccacaaatcgtagtggtcaaggaatgcctcgatataccccttctggcagttgctgacaatcgaaagatgatagccgtcccgcttcaacgccgcgagcgtctgcggcacctgatcgtagagtatgcccccatgctcccgcagataatcattttccacctgacagcattcctttaggagcagtctccgtttttcttcggggaattccgcaaagaggatatcggcgattacgtccatcgtttttcccattaccccctgaatgtcctgcgttgtcagttctttctccctgaccccgtactgccggattgccacattccaggacttcgccacattctctgcggaatcccacagggttccgtccatgtcaaatatgattccacgtttcatgacatcatctcccgttctctctcttttgtctaggcttcctcggaaagtccatacagtctcgtgtattttttcttcatgtagcgcacgagcggctgcgcggacacttctttcccgcacactgccgcaattacctctttcggtgtccgcgtgcttccataccagtgaatcttctcattgagccattttgtgatctcaccgattctgccgtctgccaggatctcatccacggagccgagttcctcctccatcttctcgaggtacatgccgtcatagatgctgcccagcagataggacggaaaatacccaaacgagccgtccgaccaatgtacatcctgcaagatgccttcggcgtcattttccggagtgatatgcaagtattcctgcattttctgattccagagctccggaagtttttccaccggcacatgatcgtagaaaatcgctttttccatctcataacgcaatataatatggaagcaatacgttacctcatccgcctcggtgcgcaccatactgttctccacgcggttgatttcacgctcaaacgcttcgagtgtcacattcttaaactgtggaagcaattctcccagtttttcatagatcggcttccagaaattgatatttcttccgagaatattctcataaaagcgcgactggctctcatgcacccccatatagcagcagctgcccgccaccgtattgtcgtattccgggttgacattctgttcaaaaatcgcatgtccgccctcatgaatcgcagaaaacatggcgctgagcggctccgtctcatagtagtggttcgtcacacgcacatcctttgaagaaaaattcgtcgtaaacggatgctccgtctccccgaccgctcccgcatccctgcggaatccgatgtaatcaagcagcagccactgtaccctgcgctgtgcgtccggatcagcataggcatgaaatgtcggattttccggcattttctttgcagtaatctgctctactaacggtatcagttccgtcttcacttcctcaaacagccggtcgatcgttgcctgatccatgccctcctcacactgttccagaagtgcgtcatacacatcctttcccggatctgtatagccgattacctgcttcgtcatctcaatcatattccggaggtgcggtgcataaatggaaaagtccgatgcattttttgcttcttcccatgcatttccggattccgccgctgcccgcacaaacgcctcatataaatccgccggtattcttttattgcggtcgtaatcgcgcttcatgcgttttacaatgaatctccatgtgtcatctaacgcatcatattccgcaggctgcgccagtttctccagaaattctcccagtttctccgatgtccccatctcaaagctcttcgtggaaaaataggtcagcgcatccacatgcgccgcctgcccaagcttcggcactgtcgtctgcatatcccactgcaataatcctgtcacatgatcatactggttcatttcttttaaatattctttaaattcttctaataatctactcatcttatctcctgattttttctttattccgccggcataccgtcaatgatttatcgcggattccttctcctgaccgttgctttcccatacaccttcagccgctctttgacgcatactttccatgtctgcgggtcttaccctgcgaacctgccagcactcgttttgtcacgctgattttgagttccggcaaaagtccataaacagctgctttctgcgcatccatatctcggcgatgctcttctgcacatccgatattccgtggaacttccgggaggcatccgctaggattcattttcccttgtttctgcactgctttctgtgcatccaatgttccgtggaacttccgggaggcatctgtcagcattcattttatcatatcttacatagactgtcacgaattatgtcgggtgacgaaaagccaggggagatgagactggcggggatggaaatctgatagaatcctgagcctcacaggtctggagtatatttttttctctccagacccgtttttcttccttaagcgggtctgggcgcgtatttttctttccctagacccgttttccggacttgactgttcaaaatgattgacataatttcaatccccgggtctaattgcttgttttcacattccctagacctggttttcttccttgggcgggtctggaagcgtatttttctctccccagaccctgtttccgggcttgactatccaaaatggttgacataatttccatttcccgggtctagctgcttattttcacatctacagacccggtgtcgcacaaaaacatttcaaataagttaacataattccaactcatgggtctgagcgcaccttttctccactccagacccgcaaaacatctttagcactgtttctaaagcatatcccacaaaaatatagctttcttctaatattatagcttccttctaacccgcaaaaatgatacgataagagcgcaacccattgatttttctgacatttagcacaggtctgccgcactaccgcaccggcagccagaaaggcggttccattgaaacattttctccgattgaccgactataccaaagctgacatttacgaaatcttccatatcaccgatgagatcctggaggggcactatcagaatctgctgcagggcaaaagcgtcgttttatttttcccggaatccagcatccgcacaagggtcacgtttgagaagggcatcgcgcttttgggcggtcagccgattttgtttccaagttccgctctcgacaaaaaggaagatttgcaagacgtcatcggctacctcaacaactgggccaatctgcttgtcgtccgccaccgggatatggccgctttggaaaaaatcgctgcatctgcattcgtacctgtcatcaatgcgctgaccgacgcaaatcatccctgcgaaatggctgcagatctgtatgcgctctcaaaaatacggaatgattttaccatggaccactttctgttctgcggtgtcacaggaaatatcgggctggcttggaaggaagcctccgaagtgatgggcttttcgctggagcagtgctgtattccgggatatgagatgaatggcgtgccctcacatcactgcatccgcgacgccatccgtggaaaagacatcatctgcaccgactcactgccggccgaccttctttccgcctcccgcggctgcaccgtcgatcttgctgccatgaagctggcaaacgagggtgccatcttaaatccctgcccgcctttttaccgcggcgaggaagtctcaaacgacgtcatcgactccgactattttgtcggatatgaatttaaaaagcacctgctcaccgtccagcaggcaatcatggtgtactgcttaacacactaaacttttcatataatgcattaagcttttcattttttgacataacacaatatttcctgcaagaaagaatcctgttttgcaggattctccgcctgcggcgggttgctctagcgacataattccactccaacgcagtgcaatcctgcccggagaactttttcattcataggacgtaatttcctatgaatcaaaaaaactcccgtgcgcgtgatacctctcttttccacagcactctgtagaaaataccggcatcccacgaacggaagcttcctgtttctttctattctactttacctcgtcgatcgcacgtccgatgtcatggcgcatgtacttattcgcaaaatcaacccactctgtcgcctcgtatgcttttgcgcgcgcctcctttaaatcttttccggtcgccgtaatgccgagcacacgcccgccgttcgtgacgatcgtgccgttctcatcgaacttcgttccggcatggaagcagaaataatcgtcctttccgtcgaacttttcaagtcctgtgatcggaaatcccttctcataggacaccggataaccgtcggatgcaagcaccacacataccgccgcattgtcttcaaactgaaggtcgatcgtatccagctttccatcgacgcatgcctccatcacatcaatgatgtcattcttcatgcgtgggagcaccacctgtgcctccggatcaccaaaacgcgcattgtactcaagcaccttcggtccgtcctccgtcagcatcagaccgaagaaaataacgccggtaaacggtcttccctccgccgccatcgcatccacagtcgcctgatagatgtgcttttggcagaactcgtccacttcctttgtgtagaacgggctcggggaaaaattgcccatgccgccggtgttgagaccctgatcgccgtcctttgcacgcttgtgatcctgcgcagaggacataatcttgatcgtctttccgtccacgtaggaaagcaccgatacctcgcgtccggtcatgaactcctccacaaccatcgtgtttcccgcggagccgaacttcttgtcctccatgatctccttaacacccgcctttgcctcctcgagcgtattgcagatcaaaacaccctttccgagcgccagtccgtccgccttcaatacgatcggcatcttcaccgtctccagataagtaagcgcatcctctgcagatgtgaaattctcgtaggcagccgtcggaatgtgatattttttcatcagatccttggaaaatgccttggagccttcaaggatcgccgcattcttccgcggtccgaatacctttaagccctccgcctcaaacacatccacaattccgccaacgagcggatcatccatgccgacaattgtaaaatcaactgcatgctccttcgcgaacgccaccagtttgtcgaactccatcgctccgatcgcaacacactctgcaagcgatgcaattcctgcgtttcccggcgcacagtagatcttatccacgcgcgggctctttgccacactcgtcacgatcgcatgctcacgtccgccgcttccaactaccaataccttcatatccgcttcctcctgcactctgtaactcatacgcttatttctcaactgtcacatgtccgtttgcaacagacactctgccgtttgcaatcagatcgatcgcctgcggaagaatgatccactctgcctgctccatcacacggcgctgtaaaatctccggggtatctccctcttcgaccgccaccggcttctgcaaaatgatcggtcctgtatccgttccctcatccacaaaatgaaccgttgcacccgtaactttcacgccgcgcgcaagcgctccctcatgtactttcaagccgtaaaagcctttgccgcagaaagacgggatcagtgacggatgaatattgatgatccggttgcggtactgcgcgatcatctgctccggaattacaacgagaaatcctgccaacaccaccagatccacctgatagctgtcaagcatcgccagaaacgcttcattgaatgcctcacggctctcataatccttcggtgaaatgcaaagcgcctcaatgccgtgccctttcgcacgctccaacgcatacgcccctggattgttgctgatcacaacgtctacccgggcgttcgtgattctgccctcatcgatggcgtctaagattgcctgcagattcgtgccgcctccggacaccagtaccgctacttttagcataaggttactcctttttcaccatccttgatctcgccgacaatatacggtgtgtctcctgctgccttcattgccgcgatcgtcttgtccacgtccgccggatccactgccacgatcatgccgatacccatattgtaggtattgtacatcatctgctcctcgactttgccctcgcgcgccatcatctgaaagatcgccggaacttcatagctgtccttccggataaccgcatgctttccttccggaagcatacgcgggatattctcatagaaaccaccgcctgtgatatggctgcatgcttttacgcggacgcccgcttccttcacctcacggagtgccttcacgtaaattctggtcggagctaaaagcgcctcgccaagtgttttgccaagctcctcatgataggtatttaacgtatccgcatccatggagaaaatctttctcaccagagagaatccgttggaatgaacgccggagcttgccataccgatcaaaacatcgcccgccgcaagatcagctcccgtaataatgtccttttcatccacgataccaacggaaaaaccggccagatcgtactcattctccggcatcagccccggatgttctgccgtctcaccgccgatcaacgcacagcctgcctgcttgcagccctccgccacaccggacacgatcgtcgcaatcttctccggatagttcttgccacaggcaatatagtcaaggaaaaacagcggctcgccgccggcacatgcgatatcgtttacacacatggcaacacagtcaataccgatcgtgtcatgcttgtccagtaaaaatgccagttttaccttcgttccgcagccgtctgtgccggatactaacgtaggcttctccatattcttaaagctctccatggagaacgcaccggaaaatccgccaagtccgccaagcacctccgggcgcatggttcccttcacatactttttcatgagttctacagacttgtatcctgcctcgatatccacaccggaattcttgtaatccatcctattttcctcctatatgcttgtctgttgtctatccaacgcaacacgggcgactttttgcaaaatcatccgttcctgttcctagtaattctgatatcccacttcctgcagtctggcatccttcgcctgcacctgctcttttaattctttggaatattcttttaatttttgcaaaattgcatcatctgatgttgccagaatctttgctgcaagtaatcctgcatttgcaccaccgttgatcgccactgtggcaaccggaatgccggacggcatctgtacgatggagtacagggagtcgcgtccgccgagggacgtggtgtgcatcgggataccgatgaccggcatcgggaagatcgccgcgcacattcccggaagatgcgccgccatgcccgcgcctgcgataatgaccttaaagcccttcacctctgcgctctttgcatactcgaaaaatacatccggctcacggtgtgccgagataatcgtcatctcatagtcaattccaagcttctctaaaatgtcggcagcctttgccattaccggcatatcggaatcactgcccatcacaatacctacttttgccatattgctcctcatttctgcgcacattctgccataccgggttcgtgccgggtgcgccggggcacgaatcctgcgcgcggaaccgaatccttcccatgcgccagtttctcaatctgctcttagtatagcgtccacgcatttagaagtccaattaacactttttatgtgatttataaatacagctaatataagtatctatcccgcccggctcaccttcctacctgtccagcggtccgttcaacgcctccgttccggcaagcacaaaacgtccgtccgcgatgatatcctctgtcgtaccgtccttccggatcacagtgatcttatccagctcgtcgtacggaatcgtaatatcggtgtggcagtttaaatatgccttttccggattctcgcggcgctgcgccgataccgtattctcccgcgctacaatcgcttttccatccggattgtaagagaggttgtcctcctcatggctgtagcaggtgtcccccaccgcaaagtgcgggccggtcttctccgcaatcagaatcggcagtttgtccgcaatgtcatagtcgcgcgccatccggtatgccgtcgtgttcgtgccgattgcaaattctcccatcggcagcgtctcatggtgcatcagcacattgtcgcggatatagtttttgttctccgcctcatcctcgaaattggtgcaggtgtatttttccaccatgccgtccttaaaatcgatctccagattcttgtaattcagaccgttcagatatacctgtccgacatgcagctttccgttcgttccctcaagcaccggcgatgtaaacacctcgcccaccggaatattcacgtccgccacacagttctcaaatgcggtctccccttcgggattccgaagcttccagatgttgacatataagtcggtcttattggctccttttccggtgatgtgcacacggtccgcctgatcgagcacgtcgatcatcttctgctgcatgttgcggtagagcatgtaatccagcgtattgatcttcaccgtctccgcgaaaatctcctcaaagcgggcgccgatcgacggaagcgggtaggcaatgatcgtaaaactgcgctcctcccccttgatgtactggttcgtgatctgtccgcgctggctcatctcatacacacagagctgctgctgtttttcaccgtaacggaatgcctctttttttgtctccggagaaaaaggttcttctccgaacacctcaatcaccgccggccccgccatgccgttcgcatgtactttttcttcctcaaatgcgtttttccacgtctcgagtccgcgctccacgtacgccttgtcaagatagtacgcgcgatcctccctgtgatcgtagtcatactgcttgttggctgccgttcccgaagccagcatggtcacttcgagtcccattttttcaaaattgcacactgctgcacgcaccatacgctcgaagccaatcggataccgtacctgcgccgccgtctttttggacagatccttgcccgtcgtctcaaaaccgatccggtagccttccgtgtatgtgtccgccatcgcctggatatccgcctccggcagtgtatttaagtaagcggcaatctgtctctcattctccccgatataagcgccgtagcggtaaagataacgcagatccgacagatccgcctgcatcacgatctccttttcaaaatcctccgcaggattcacaagacgccgcaccgaccgctcgtcaaaaatctcccgataatcatgaaaataccagtacaaaatctgctgcacttctttttcctgcggcagggcatctgctgctgcgccttcaaagcagttgtagacctccacaaacagctccatcgcgatcgtaagctgcatcagatttccgcggaaaacctccccgcatgccgtccgaagatgtgccgcaagaagcgagagcgctccgccgaacgtctctcccagacgtgcagcggcgtaggccggattcgcatagctgtgcccgtaggcttccggcaggatctccccgtagagcgcctcattgtccgcctcacattcctccatgctccgcgccgcaagactgccgctttttcctttttcatacagtgcacgaaggctctgtaaatatccggcatttgtccggaaatactccgcaaacggctccggcgcctgcgccgcctctgcaatctctgcaatccgttccgctaccagttcatagcgctccgccgccagttcatttgtctccttgtaacattcctgatatcccaaatcaattcctcctcacaaacaataaatcccgcgccattgcgggatttgtattaccttatgaaaacgtcagccatgcctgaacacaaatccatccggattacggctgaagacgtcctttttttacattttcctcaatgagcgactttgcatacgcccacagttcctcggatccctcatgtgttctgctgttgcgcgcaagcacctgagactccctgacgccgtgttccacccaggatttgccgtccgaagcattgttcagaagaagcggctgtaccttgtccagcatattggcaaacttcgcctccgccgtctccatcgcctcaaactcatcccacagaccgcggtactccatgcgctgtgcatccggaagcagcccgaaaatacggtccgccgccttcaactcgcgctctcgcttggtcttattgccctcggtatcgtatgcgtaggtatccccggcgtcgatctcgatcacatcgtgaagcagcaccatcttcatcgtctttagcacatcaatcttctcgttcgcataatctgcaaacacaaacgccatcagcgccagatgccaggaatgttccgcatcattttccttgcggcttccatccgacagataggtctgtcttgttatcttttttatcttatccaactccatgataaaagccatctgtttctcaaaatccgtcatattcttctcctatgccaaaaagccgatcacatacagcgccacccagattccggtaatcagaagcgagcagagcgtcgaaagatacgggaacagcttaaacgaattctcctccccaaggctcttcaccgccagaacgagcgcacagatgccgatcagcatcgatgtcactcccgcacttcccagatacatgctcccgttgccgcggctgtcaaaagaactgaccaccgccgccaccagtatcccgatggaaataatcgacaaaaaaagtgctgccacacccctctttgagtgtgtcttctctgtaaatctgtatccgtttctatgtcgtctcgccactttcttttcctctctgatttctctgatgataataacgcacaaacaggcgatataggccgtaacccgccataccgcccagcgtatttaacaggagatcgtccacatcaaagcttccgacccgaaagacaagctgcagcagttctaccagaagactcagttcaaaactgtaaaatgccgtccgccagaattttttacacctgcctgaaaaaacgggcagaaaaaatccaaacggcagaaacgccgccacatttcccaaaatattgagcagtacggctttcatgccgaggactctccagtattttacaaaacgcgcgatctcctttaacggaacgagattgtaatgatatgcccgctcgctgtaggtgcgccccatcttctccgaaaagaacagaaaataaaacagcaccacaaaataaatcaggaataaaattcctgctgcaagacgatgttttcttctagttgcagccatactgcttatagtagtcgtcaatggcagctttgatggtatcgtcaatcacaacacgtccctggcatgtgcggttgtacagatgctctaccacctcttccatggtaacgatcgcattcgtctcaaatccatacttttcgcggatctcctccaatgcgctcttctcgccgccaagccccttttccatacggtttaaggataccatcagccccacgatcgtgacgtctgccgctcctctcaccttcggaaccgtctcctccatggatttgccggaagtcgtgacgtcctcaatcatgaccacgcggtcgccgtcttttaacttactgccgaggaagcttcccttatctgctccgtgatccttctcctccttgcggtcagagcagtagcgtacctccttgccatacagattgtgaaacgccaccgcagtcacaacgctgatcggaattcccttgtatgccggtccaaacagcacatcaaaatcatccccataggtctcatgaatcgctctggcataatactctcccagacgcatcagctgggatccggtcacataagcccccgcattcataaaaaacggggatttcctgccgctttttaaggtaaactccccgaacttgagcacatcgctctccaccataaattcaataaactcctgcttgtactgctccattctatctatatcctcctgttatcctaagccgtcttttgttttcgttctattctactctaccataaaaaaaggagaaccgcaatgcgtcccggtagctttcggccttcctgttggcgtaaaaatattagcagactccatcataatgtgtccacattctaattattttcacggttccatcatacctcatccctttccattccactggctcactatacacctgataaaccagcctgtgctgaatattgattcttcgcgaataaactccctgcaaatttccaaccagcgcttcatagggtggtggattttgaaaaggggtttcccggatgacctctatcagctttttcgccttatcatcaagtctggcactcttcaaattcttaatatcttttactgcctgcttatcatatacaattctgtacatagatctaccattctacatcttcctctggcacacaatcttctaaccgcgtatccatcccgcttcttatagattcagccatacctggaattgcgttcaaatatactgtttcctgaattgcattccaatcactttcggaaacaagaactgcatttccttttttgcttacaattaaagccggttcgctgtagcgattaacgtcttctaccagactgtagagttcctttcttgcatttgttatattgattgccgacataataaatctcccttttgcttgtagtgtaatttctatattttttttgttattttgtcatttgaaaatctcttgttccattctcgtacattcttgttcttcattttagttacatcaaatccgatgtagttgccttatgttcttttatgcttatgaatgtcgagatttttatgtcatagttattatagcgtacgtcattacgtacgtcaagttgctattttattctatacacaagtcacacaaatttttcccaaaagcaaataaaatatccagaatcccaaagtcagacttgtcttttccaactccggtttctggatatcttctgttcctccgatatacgcttataacttctccgcttctcttccgtatacttcaatctgcgtcagcgcagggaacggcgacgggtcgtccgcttttttcagcttttccaaggtcagttctgtgataacccgctcctcgaatacgatctcgtgcggcttttcgcttttttccagctctgccacgacctcgcttccatccgagaaccggatcgtcacctgcttccaccagttatcgtgcgggaaatccgcccttgtgtacagacggatgcggctgaccgccacctttctgccgaattccagcctcatattcgcatcctcgcgtcggttgattccccacgattcatacggccattctccgtgcgcatcattcaccgtgacgccgtcgatcgcgtttctggcggcgaacaccgcctccccgcgcgtctccacattcgccgacgcatgcggataacagttggtctccccatgctggtccatcacattttttgcaagattcctgcaggagccgaagcatgtcatatccgcaagctttgcggtgattaaatgccggttcccggaaaatgtcttgggcgagtaggaaatctttctctccccgaacggaatcctgtagtggacgtccccggtcacatagacggttgccgccccgagcgcatcgtccgccatcagttcgtagaaggcatttttcggggagatctcaaagatgatctcatcccccttctcgtattctttcgtgtagaccagtgccgcctcatcctctcctctggcaacacttagggtcatgccgtccttattctgtatcttaatcgttatcactgccatctttcccctcatctctccattcatactgtgaaaaaacaaacgtcaggatcttcgcgtgtacatatgcgattccgccggccgacacaaaaagcagcggccagaacacaaacagcgccgccgtgataaacagtgccgcggatgtcagcatcagaagcgtccagccgaagttcttaaacgccatcacaaacgcaagcgcaagcgccttctttaaatccgcgtccgtccatgccagcagcgggaacacatacagggcaacgaagacaaaaatcaccgacagcaccagaaaaatccagaaaaacaccgttccgacgccgcctgcgagatgataataaaaatataaatccgctccgaaaaagattccgagcgccagcattccgatccaggcgatcgtcgcagatttaaaattctccttaaacgcccgcacaaaatcttcccggatgtagccctccttgttggacgctaacgtcatggagcaatagcagagtgcgcacgtcgacgccccgattgttacgaccggcagtgaaaaaagcagccacagacatgtcagaaaaaacatatccgtcacctttcccataaaacgccagaccggattgtccatatcaaacatttttcccatcgtctttcctccctgtctcttcctgcgaaatcatcgctttgtattcctctgccgaaaacgcggctgccaccccgacgttctcctcaaagatccaccggagcatcccgactgcctgctccttcctctctgatccgctcacaatcccgatcaccgggtctaagagcgtaatcccgtactgcttcacaaacgcggtatctgtcagtgtgatgccgcatgccacaccgtttttttcatagatgcgcgcccccagcgcttcacatgccccagcgcccagcagttccctaagatcagcaaacgcattcaggttacagtaatagtcaaacacatctttttccagaatcatgaagtcgagctcgtgcgcatacacgtacgtcgtgatcgttgcgagggaatcctgcgtattggcatcggcgatcggcgtctgccccagcgcggctgtatccatggtaagcgctgtgtccacgacgacctcctccacgttcgtatcgccgccgatcccggcgaggatcgcctcctccatccgggttgtcaccgcatcatcctgcacattattgaccacttctcccatgagaacctgtgtcttttcttttttccccatggtgtccgcaacatagaggaccgctgccgcgagaaccactgcaaaaattacgacacctttataataagtccaccaatgctccagtttctttcgcaccgcgcatcctcctttttgcttctctcctaccagttcagaacgtcgcccaccagcacatcctcggccttgtcaaagacaatcacatttccgtagcccatacagccgtctgcctccacgaggtcggtcggcgaattgacctcctgatggcagaggatcaccacatattccttttcgcctgtggtgatctttaatgcctccgccatcgtctccggatagtctgtctgctttaatgccgagcgcaccggaagcttctcaatcgaaagcgggcgtcccggatgtgcatcgatgaccgtgataaggctggtaaaaccgtcccccggctttgtcaccttacacaccgtattttcctcttccacattgtaatgtcttgcaatgtggccgcgcttaagctctgctttcacctgcgccgacacaaaataaaaatccgcttctgccattttaccacgataggccacgcatgggaacttcttttctcccggcgcagtcaacgtcaccgcaccatgattgttaaaatgaaaatactgctggtaggtgtgacagtccccggtgtacatctcatccaccagaatatacaggtcaggctttatgtaaaccaccttccggttcacatagacgccgcccggaagatccatgtagccgagctgccccgcctgtgcaaattccgccagctccatgcaccggaaattctctttgaccggctgggaaagcttcgagcactcccaggaatccttgcagacggtaaacggcagatcatccaccgtgatcgtattgtgtcctgacggatccttgtacgaaaaacgctttggtcctgaaacgtaggtatatctaccaccgtccatcagcacatcctcgccgtttacaaccaggtcgatgtgcagcttatcggaatgtccgtgccccgctcccatcgtcccggaatgcagatgcaggaaattggcgcgttctgaccagtccgaccggaaataagtgttcccgctgtgttccagaaacagcgatgtaaagtccggttttctgcgctccatcaccgcatattcttccccggctttcatgccgagatcccagatactttcataatcaagacggtcgaatccgccaaaccgcagcaccggatttaaaaacagatacgccgccacgctgatgcggtcccgcacatccacgtcgtcgctgtcccccatcatcacgatgtggtgatccggctttaaccacgcgacatccgccattgccatcttctccgtctggcgcaggatcacgtccggcagtgcaatgccgttccgctttgccagaaggatcacgtctaacaggcagtgcagcacctcgttgtgatacatcggcgactgctcccagtgcacgccgtccggcatgatctgcatccgcacctgcacctcaagattcttcacggcaaacgcgataaactgctttgtcttctcgctctgcgggagacacacgccgatctcaaacagcccgtgattctcaatgacgccccagttactcatatagcggtaagcggaatgacattccatgatgtattccgcctgcaggatcatgctgtcataatatttctgtaaaaacgcttccgtgagcgtcgggctgtcatgaaacagccagatcgccttgctccagtattccccgcgaaagccggtgtctagacttctccacggtcccgccgcatacttctcgttcagcgggacatgatcgatccagtcctccgcaatctccataaacgctctcgcatatttctcatccccggtcatctgatacgcctgaccgagcgtcatgaaaaagcggtgtctgttgaactgccagacaaattccggatcgtctgccggcatatacgtccagtcgatcgctccgtcaaactgtaccggctcgtcggtctgctccagatcccacttggagttgaacagaaaatatttccggcacacaccgtccgccaccgcaagcgtctgcgcgacatcttctggaaattgctccctgcagtacgccccgaccgcttttccatcctcacagtaatagtgtgatgcatccctgtcaaaaaatgcttctcttttcatcctgccataccttcctttttcccttgttaccaatacggattccagtcttttttcagccgcatgagcgcttccatgtaaaaatagtctccccagatattgcactcgtccaccccgtaatgattgcaggtattatacggagagtggttggaataggtgctgtgtaacaccaacccgttcgactcttttggatctttcaccgcgtatccgtcgtacaacgccttcatcaaccgttttgccgttgcacggtaagcttctgcctcgtccggctttagatattttgccatctcaagcattccgcatgctgcgatcgacgccgaggaggaatctctcggctgatcgtccccgtccgtgaactccagatcccagaacggcaccatatccttgggcagatgcgccaggaaaaagtccgtgacatcccggaacttctgaatgtattcttccctttccgtgtacttgtaggcgagcgccatcccgtagatgccccatgcctggcctctcgcccacgccgaaccgtcgcggtatccctgacaggtggctccgtgatccggtgcccccgtcttcatatcgaagaaaaaggtgtgccaggtggaatgatcctcacggatcacattggcgaccgccgtgtgaatatgcttctccgcaatgtcccgatacttcggatcgccggtctcctccgacgcccagtagagcagcggcagatttaaaagacagtcgatgatcagccggtagttttccggtgcatccatcgcaccccacgcctgtataaaattgcccaccgggtgaaatctgcggatgagctgatcggctgccagtatggctgcctttcttcccgtctcattcccggtcagtttatagcccgccacgcaggacggcgaatacaaaaatcccatatcgtggtgatcgacttcgatcttgttttcaatgcggttcaaaaagctgtcaatctggatttcaccggcttttttatagatgtctttcccggtatcctcgtaggacagccagatctcgcccgtccagaatcccgtcgtccagtccacattgtccgtcggcgcgtaaaacccgttctcgctgtaagccttctggaacttcgtcgtgaactccggcagattgcgctttacctgcgccgtggagaaatccatcgcctctctgatctcctgctctgtgatctgcggtttttcttcgtatcgcatacccttcttctccttttccgttttcaaatcatgttatgtttatccaacacgttattcctgtagagtaaaacaaagccgtcacacaaacgatctctttttgtgtgacagctttgttacataccttcggccttagccctttaaaccggtagatgcaattccctctacaaagtatctctgcagacagataaatacgatgagtaccggaatcagggaaagtaccgaccctgccataatcagtccgtactgggaggaatactgaccgatgaacattttgagacctaactgaatggtcttcttctcctgggattttaagtaaatcaatggtccgaggtagtcattccacgttgccacgaaggtgaagattgtcagcgtggacagcgccggttttgacagcggaagcatgatgtgcgaataaattttgtattcgctcatgccgtcgactctcgccgcctcacacagttcgttcggaataccgtcatagaactgtctcatcatgaacacaccgaatgcggaaaatgcctgcagacagatcattgcgagcagcttatcattcaatcccatcttacgcatcatgataaactgcggaaccatgtatacctgccacggcatagcgatggtcgcaatgtatgccatgaacagtgcattcttatgcttgaactccagttttgcaaaagagtatgctgcaaagctgcttgtcaaaagctgtaaggcggtcaccacgattgtgaggaacacggtgttcttcacgaacgtgccaaacggaatcttcgtccagatatccacgtaattgctccagcgcggtgtctccggaatcagaacaaacggcgtcatctggaatacttcacggtctgtcttaatggaagcggacagcatccagataaacgggatcaacattgccgccgtgataatcagtaaaatcagatacaggaagaacttcttgatcagattgtttcgtttcatcgatgtttcttttttctgctttgtcattatctctctcatctctgttctccccctttctagtcctctaacttcttctcatatgcaaactgtataatcgttacagcaagtaccagtacaaacagtaccattgcgaccgcactcgcataaccgagtttccagtagtcgaatgcattttcgtaaatgtagtaaacaagtacggatgcggagttgcttaacttgccctggcttccgcctgccagcatgatggcgatgtcgtacaccttaaagcagttgatcgtcagcatcacgacaacgaaaaaggtggtggatcgcagctgcggccaggtgatatatttaaatttctgccaggtcgtcgccccgtcgaggcttcccgcctcgtataattccgacgagattccctgcagtcccgcaaggtagattaccatgtagtaacccatatatttccagacactgaataaaataagtgtcagcataatcagatttccgctaaaccagttcggcagattcttctgctcgatcccgcagattgtcatcaaaagataattcaccggtcccttggtcggatgaaaaatcatggaccataccgttgtgatggcaacgagggatgctacatacgggaagaacgataccgttctaaaaaaacctcttcccttcaccttctggtttaagacaattgccagtgccagcgacacaaccatggtaagcggtaccgtgccgacacagtagataatcgtgttttttaaggatgccgtgaaaaaagtatccgacggcagtttcaagaaattggaaagtccgacaaactgaatcgggttgtttccatcccattccgtaaatgccagaataaaggcaaatatgatcgggatcaatgtaaatacggcgaatccgatgaagttcggcgcaatgaaagaataggcaaccagatcgtctctggtctgctttgacagtttgcggccgcttcgcattgcagcagccttccactgcagtttgtttctgttttgaatcagtttctgttttttcttgttatcagtttcgttctgactttgttcccacagtcttgccatttcggcttccatctgctctaattttgctgctttcttcttatccataaccatgcccaaaagccagatacggcttatttcctttctcctttaagctgtttcatttttaagggccggctgttttcagccagcccttttatcagcagtcgtggttatgcttccgttccattactggttcagaatctttccaacctgctcattcatggatgctacaccctcttctacggtcacttcacggttcatgatggaagtgtggtaggtgtcgaggatactgttgatctctgatacgttctcagcatacggtacctcaaggtatgcatttgtgatatttaatgcttccttgctgccctcgtctgtcgggaatcctgccatgccggcgattgtgttgatgacatcgtccgtcataattgccgggaagttaccggtggaagccattacctttgcgccctctgtaccggatacccagtttacgaaatcaaatgctgcgtccttgtttgcggaagcgcttgtcactgcaagacctgtgatcgtagcgatcgtgctgcctgcctctgctccgtccggatgcggatagcttgcgataccccagttgccgcagagagagctgtcgtactcaccgctgtcaagattggagatcaatgtggagatgaaccaggaacccatgttcatcatagcaacatttccgttggagaatgctgcggagtagtgaagaccttctgtgcttaagtctgtgtaggtctggcatacaccgtcatcctcttcacttaagatcatgtcatagtacggaatcatccagtcgtaattgccgtccaggatagagtgttttccatccaggattccgaacagttcgactgcggatctccatgtgtgataatggcatccgtatacctgggaaccgtaggtggtatctgtcagctgtcttgccagtgcatcgtaatcttccatcgtcatatcgttggacggataagcaatgcctgctgcatcaaatacatctttgttgtagtagatcagccagtaatcgcttctgaacggaagttcatataagcttccatctactgttacctgatctgtgattccgttgaagtctgcgaggttaattcctgcatctgtgatgtaatcatccagggactccagcgtgttcttctgaaccagcgttgcgtaacccggtacatccttgatcgtaaccacatcgaagtccgatccgcttccggataactccgttgcaaggacagtcatgtaatcggttgatccaaggtctaccatctcaatggtgacgtttggatttgcagcctcatatgcctccttgagtgcgttccagtaaggagtggtctcctgatcccagattgcccatttgagagtgactgcctctccatctgtcgcagccgcatctgctgctgtctcagtgcctgccgcagcggtgtttgtgtctgctgccgcatctgctgatgcatccgttgaagctgtttccccagagccacaacctgcaagtaacgcccctgtcatgcttgctacaagaagcatgctcaatactctttttttcatctgaatcctccttttcgtatctctatcgttctccgataagatgattttattatattggctttgccatacaatggacatagatttttttacgtttaaattcacatttttttcctctttctgttttcgtctgcattttttcttcccaaacctgtcttttttctcaaaacctgtctttttttcttcactttgcttttcgctctcccaaaatggatttttttctttccgaattttctttttgtgtctataatataaggtatgaagaaaaaatttacgacgattcgatcccgaattacactgactacgattacactctgtattttcttaagtatcgctgtgtcctatatcagctattctttctattataaaagtgtaaaacaaaatatgatccgcaccgcggagtcctctctgacactgctcggctcctccattgacagcaacatccaggatgcttattctttcgtccgcaactgtcaggcgaactcttttatcctgaattatctgtcgtcacagggttcccagagtgcgcgtatcaccgcctctacttatctgaagggaagctacaacagttacgatggccgctactatatcaagcgcatttttattgcctcctacaagaaccgggattttatccaggctcttgcttccaccaacaaccagcccttccactcggcagatgatatccgggatctctatttttttgacagctactacagcagcccttcctattcttatagcgaaggtatcctgacaaccgacggcggttcacagtatcttccgatcatccggccgctttacagccagtataattccgacgagctcggttttatctacatcgaaatgtcgccgaacgtcgtcaccataccgcttaagaccgccggaacctaccagaacaacgacttttacctgacgttggaagatcacagctatgtgtacagcaattacaccctgacggacgccaacccttcctatgagattacgggagatctctcctccattgcatctttctccgatacgatcgtaaaggagatttcaaatgccaacggaaagttcgtctccatctcggttccgctcgccgcggaacactgctatatcacgcagctgatcacggtcaatacgttttacggacagcttgcatccatcattttcgtcatcgtggcgtgcgccgtcattaccggtatcattcttcacacgatttttaatcatatgatcaatcatccggtacaggaactgcaggtccgaatgaagcacatttccgagggaaatttcgagcgcgactcctcgatcgagtggcagcatgagctcggcgacatcggcagaagcatcaacgatctcgccgaagatgtgaaaacactgatggatcaacggatccgcgatgaaaatgagaagcgtgagtacgagtacaaaatgctgcagagccagatcaatccgcattttctctacaacacgctcaattccatcaaatggatggcaacgatccagaatgcgcctggcatcgcggagatgacgacggcactctccagacttttaaaaaacatcgcaaagggaacagagaaggcggttccgctctctgcagaactctcccttctggatgattattttacgattcagaaataccgttatggaggaaccatctccttagaatacaggatcgatgacgaggcggcattaagctgtctgattccgcgcttcaccttacagccggtcgtggaaaattctatctttcatggcattgagccaaagggaacacccggaacgatcactattcacattttccggaaaaatgacgcgattcttcagatcgacattaccgacgacggcgtcggcatgacggaagaacaggcaagacagcttttgtccgagaacaagaacgaaaagactgaatttttcagggaaatcggcgtcagcaacgtgcacaagcggctgcagtatgaattcggcgaagattacggcctgcgtgtggaaagccggctttccgaatttaccactgtgtccgtcctgcttccgtttgcgccgcaggaagacatcggctaaatgcagacagatatttttacaacaaagaaatggggttacagttatggtacagcttcttatcgtggatgacgaaccgctggttcagatcggcatccgctccatgttaaactgggagagcatgggaattgaaattgcaggcactgccacaaacggcaggcaggcatatgatatcattctggaaaagcatccggaaattgtaattacagacatcaaaatgccgattatggacggcatgcagctgatcgagaaatgtcagtcccaagagcatccgcctctttttattctcttaaccagctatgaggaatttgctctggtaaaacaggcgatctcctaccaggtgctggattatctggtaaagctcgagctgacggaagatgtgttaaacgctgccatccagaaggcgctcggcattctggaaaaagagagaaaacaggcagccatcccggaaaccggttccgatctctccttattgcaggataatttttatatccggctgcttctaaatctattcgagacagaggaacaatttgcgacacagtgcgatcttctgtccgtccgcttcactgccgccggctacacggtggcgtatctggaaatgcagaataccaggcagagtgcgtccgctgtcgcatcgtcggacatcacactctaccgcagcagctaccagatgatccggaatctgatcgtcaaatatgtgccatgccggattctgttccttgacacgacacaccttgcgattattttttccctgaccaaagaacagacgggcagctatcatcagcttctgaccgatgcactcacacagacaggcgacatgctctacaattattacagcataaggattcttgcatcggtcggctctctcgtcgaaaatccgagagatctgtccgcctcctattcggacgccagacagattttcccggacgtccgccagagtgattctgccgttatctttgccgacgaggacaatcccgcccgcgaggagcacaacgtcttcaacattgccatctttaaggatgagctgcagaaagcgttcaacgaatacgatccggaagcactctccgcagtcttccacgacatcattgacctgttttccaatgataagagacattactcccaggccttatccgccgcgagcaacgtgctgcacttaaccctctcctgcctgagcaacggggaagaacagttaaaccagatctttggtgaatccgccaacgggtacaactgcctctacgaggcggaaacggtgccgcaggtgctctcctggatgaccgtgctgtgcgacggtctgtgccgcctgttttccgagcacaacaaggattacaagaaccgaaccatctccgcggtcaagaaatatatcaatgaacacgtcgatgagaagatcacgctgaatcagctctccgacgtcttcaacatcagcccgaattatctgtcgatcctgttttccaagtacaacgatatgggatttatagattatgtaaaccacgcaaagattgaatgtgccaaggaaatgctggatgagggaacgctcaagatctatgagatctccgacaaactggggtacgagagcgcgttctatttcagccgggtattcaaaaaggtggagggcgtgtcgccgcgcgactatatcaaccggacttgaggcacttctttcttttgcccgtgttaaatgttataccatttaatctcgtttgcctccatctccagaggaaaactgctgccatcaccacgataaaccacagttttctggcgggcatatgtattgttgaccacgcagaacctgccatttttcacataggcatgtacttccacattgaagttggaactgaaccactgatgcagatccttctctccgtgggtactccacagaatactgcggtacagaatacggctgttctcaaagctgtaaggcagaccgctgatataaacacagcgcccctttccaaactcatggacagccatctgcacttccttctcccgctgtaccagaatttccgtgtcctcgtaagcgaagatgttctttttaccctcaccaaagtccactggcttcgtggtatctgccagaatgaagtgatcgggatgctcctcccagttatatttatcgtagtttaaagtaaatccggtttctttttccacgccgagcatatctgcaagctgcaggtaatgcccctgaaactgatgaccagacggctcaccgacaccgataaaacctccgccgttatatacaaactcacggatagctgcggaaatggcaggattctcccagatgccgccaccggtatgagcagtatccccatctcccacattgataatcacatccagatctttaagaatttccggatttgccagaatatcatcaaaggaaataaatcgcacatcgaaaggggcaccacttaatgcttcaataattcccgcatagctgtaattctgtttctggtatagggcatggtgtaccatatggcatccccagcttctaattttaccccagctgttcaacacagctactttcctcacgcaataaggaatcgttccctttgcgttctcatacagctcgcggaactcgttgcacacattctctacataatccagaaattccggaaaatccagagtcagcttcagatatccaccatagccgatccggtcaataggttttctcagaatggcacgtcttgcggtaatccagttctcctttgcctccttcaccgggtctccgccgtcacaaaaagtatcggggaaaaagtacggtaaaaatctgccctctgtgtattttacaccttcaatatcggagatgagacgaagagtactaccatttcctacactgcctaccaccgcatcaagaccaatggtggaaaattcctccataaacggctcggttccaatccagtgatcgccaagaaacatcattgcctctttgccgtactcatgggtaatgtctaccatttctttggcaattttggcaacctccctgcgctggaatgcctggaaatctttgaactccctgctaggcacacggtactggttgttgtaataaccctggtcaatgatgtactcaggccggaacctgtaaccggcctccttttcaaactgctctaagatataagggctgacagaggcagaatagccataccagtccacatatttttctctctttaactcatcaaacatcaaggtaaactgatggaaaaaggttgtgtagcgaatcacattcacgtagggatgatccgcgcagtatttgcgaagacgctccagggaatatttgtgggtcttaggctgtctcacgtcgaaagtaatctgatgttcaaagtttttccagtcgttggtaaccgcattgtacatatgtaccggatcccagataatgtaagccagaaagctgaccgtgtattcatggaaaggaatggcatcatgaatgaccacacagcccttttcctcctcatattcccaatgatctgcggacacaacattaccggtagaacggtcgacaacctcccaccaccgttttttgtcgtctctggtattgaccatcatcagttcctgggatatacctttcataaggggaatctctaagtcagtatccacagcagtgtaaaaggatgtcatcacatagcactgctgtacttcatccgggtttgcctttgcccactcgttgtccttccgggtagtataataggtggcataaatttttgccccggttctgaccagttcctctggaaactctgtaccgtcgcagtcacgaatggcatcagcaccccagcgtttcatcaattctatggtttccggcaccacatccaggttggtaggaatggttacacgtccctcttttaaagtcattggtctcttttcctcctgcaaaagttaagtcgttgtaacagcgttttacaacggaataatcgtattatcctcctcggtataagttccaccgcccatcttgttacggacaaaaggcacaccctccctcacataaaaagtgttatgggcgagcaaagcatccgggttctccgacgggcttaccgtaccccccagatcgtcatagctcacattatggcaaaaactgttgtgaattgcttctgactggcagaacataatgcatccgccctcattttgtctgctgtaattatattcgtaaatggttccatcaccagaatccgcatcgtaagccatcccgtcctgatttaatcttgtatctgccacttcattgcagcggaacagggcatccttgcacttccatggccagatgcctgctgccacttttccggcacggttctccggccggcggtaaatcctgtcattgatttcgcatgcaacggaatctgccgtattgtgttctactaatgggcgcaaagcatacatcgcagtgatgccatcgcccccagcggcttttacataattgtcccggatgaccatattttcatgtccgtatttcaaaaaggtatcctcgggcagttccgccccctggaatttgtcatgtgcataggtgtatccaacagcgattccccaacggcttgtcttgtatacaaagcagccttccacagtgatatctttaaagcgcgccacaccggtagctttttcatcggcaggctttaaagctgtcatataaatgccgccgttgttcatatgtttgtcatagacattgccattcacatcatggatagaaaggttgcgcagggtaatgccgctgcgcactcccttatcctttgccaccacagccacgccagtgcggttcattttatgaggagcactgtaatcttcacccagaatttccactgcctgattgctaatctcaatatcatggatgaccacatgctctacatcatataaaagtacggcagaggatacataaccttgataaacatgcgcaggtgaatccaatgttgtaccgtaatcctgataccagatgccctgtcccccggctgctatcaggggattttttccctccccctcttcttccggtgaataagagccaatttcaatgggatgctccctggttccactgtcttttatctgcagaaactgatctgtaaaaacggaatcccgggccagcagcaccttatcgccagggtacagtctcaatctgtttacctgaaaaaggctggcaaacggggaatccatggtcagtccgtcgttactatcacgcccggttttctgattgacataatatgtcctgtatgagcctgtcataggcatcctccctcagtcttttttcgataatctgccggacatcctcatagtcaaacaaatctccatggtaacgcccgaacaaatcctggttattttcataaaatgcccgcttttcttcctccgtaaaaccgggacagacccccagcttttttatctgctccgagggctgaacgaaatccagcttaaatcgtgtgagttcgtactgaagatacatggctggagaataaaaacggacaccataaagagaattttccttatttttctttgcccgccttttttccaaagcctcgataccggcatcttcaatgagcccgaactgttttgcaagaagaagggctgcctgcgcctcctcccattcttttttatccagacaatatttccgattcattatttcactgctcctgcaattccattggcaaaactcttttgtaagcacagaaagataattgcggtaggaagggtacaaatcaatacccccagcattaacatgccatagtctacgctgtaaccactttttaagtttgcaaccaacatgggcatggtaatctggttgctgtcctgcaaaataatcgttggccagagatagttattccatgcattcatgaaagttactgtcatggctgcaccgtaggtagacttcataattggcaggaacatggtaaaaaaaatcctgatctcactaagtccttccagacgggctgcctggataatatcatgagggaaagaacgggctgcctgccggaacatcataatgagaaatggtgtagaaagagaaggcagtgccagtgcaatccaggtattaaccagtttccatgaagaaaacattttaaacaaaggaatcataatagcaacaaagggaagcatcatggcaagaagcaggatgttcatcagaaggtctttgcccttgtcatgataaatctcaaagccgtagcctgcgatggaacagattaacagtgcaatcacagtaatcacaattgcattgcggaaagagttaaacatggctcgtcccagattctggtttgcaatgagactctggtaattttccatcagataaatacctgggaacagttttccacggacaatatcaatgctggagttggttgctccacaaatcatatagtacagtggaaacgctgacaggaaactggcaatgattaaaataatataagcgatagttgtctttactttagtcacgtttgtcacctactttcatctggattgcagaaagaactgccacactcacaaggataaatacggaaattgccgccgcatagttaaatttgggtgtttccacaaaggagatattataaacataatgcgccagtgtcatggtggacttaccaggaccgccggaagtcaggttaacagactcatcaaacaactgtaacgtacctgaagttgacataatagccgtcaacaggatggtaggcttcaataagggaatggtaatcttcataaactgctgaaaaggggtcgctccatcaatataacttgcttcgtatacggaatcatcaatattctgtaagcccgcaagatagaaaaccatattgtatccggtccatctccagatcagtgcaatgatgatgacaaaacgggctgcccatgcattctggaaccagtccactctgtcaaagccaagggtcgtaataatattatttaccagaccgtcctgggcaaataaggatttgaaaatcatggaataggataccagtgatgtcgcacatggaagaaagataagagtacggaaaatactctttcctttaatcttcggactgttcaaaagatgtgccagccccagtgccagaagtaacatgacaggcacctggattataaagtaaaatacagtgttaaacagacactgctggaacgtcttatcctttaatattctctggtaatttgccagccctgcaaatcctgatccttttttggtaaaggacaggataattgcctgtatcataggataaaagcaaaagataaagataagaagtgcagccggaattaaaaatgcccatccggtcaggttgtgttttttttccaaactcatttttgctttcttctgtttcatataaattctcctgattaaaaagaatatcgtttcgcgatattctgcgccgcttttacgccgctttgggcgacatatatttctgtaaaaacctgtgcatcctcgcctgtgaaaaaataccgggaacgcaatacgctgatcccggtactggctcatttttcacttacttattcactaatgttaaattcaacagcatcctgtgcattctgaatttcttcatcaatatcagcaccattctgtactacgttagtgattgcatcggtcagtgcacttctaatatcattataatatgcaccatagttaattgcgggaactttgcctgcaaactcaacaatgtctttgtatactgcctgtccaccatagaaatcagaagtctgattgtaaacatccgactgtgctgcaggcagatagctggaaattgcgccggcgttagggagtaaatcatcgtataattcaacgctgccaccaaaggttgtctttaggaaatcaaatgccagttcagtgttcttgcaattagaagatactgcccagcttgcaccaccacagtttgcgtaattggtggcaccatcaatgccgtctaaagcaggcatgtttacaatagcccacttaccagactggtcttctgccgactgaatggatgacataatccagcagccctggataacaccagcagcctcacccttgttcatggatgcaatgtactgatcccagtcggtgtagtcaaccataatcccctcatcgattaactgcttgtaaacctcgattgcttttttcaaagctgcgttgtctgccagatgaacttcaccattaacgataggagatgcgcctgcagactgcagcatctcgataacaatttcagaaccgccggaacttgtcagcatgggaacaccgtttgcatcgacaacttttttcgccagctccatgaactcagaccaggttgtgtccttgaaatcttcaacggtaagaccggcagcctctaccatatcggaacggattgccataatagatgctccattatcaaaaggaataccgtagtgttttccttctgcggtagaatctcctaatttaccaccggagaaatcgtcaaaattaataccggaatctgataattctgtgaacacctcgggatagtttgcaatatttttctggaaagaattatcctgcatcaggaaaatgtccggcagtgtgtcataattatcggcctcagcagcggtaatgatgttctgctcaatatcggtgtaaaccttctcctgaatgtccagtttaaaattgggatgatctttctggtaaattgcctcagcctgtttcattgcatatacattgaaggttggatcccagcaccatacagtaagaacttcttcgccatctgctgcatctgtgccttcagcttctgttgcagactctgccgggctggtttcagctgcaccgccggatgcagaagtgcctgctgtgctgttactgcttccgcagcctgcaagtgtggaagcggtcatcgctgctataagcagtgtgcctactaatttctttctcatattaaatcctcctttgaaacaatacatcatttgttgatggtttcattatagctttccatatcctactattcaatttctatgttgtcctattctatcaatatcttgctgtttttactaaaaatatgagtattttgacagccttttcattttcagcattattattttccgtcattttaacgtagtattttttatcacaccaatttcaatgtgcaaaatgacgattcactgctcttatattttattatattgttcagcaagatattgatattcagcaacaatttaacacaatacaccgctgtcttttcgtgatataatgaatcctgacggattcatattagaagttcctgcggaacttcagatgcgcagaaaacagcgcagaaacaacgcaaaaatgatattcatgaaaataagtttttggggaggtttttatgggaaatgaacgtttcgacatctccattccaaaagaatatttaacaagagataaagcaagacttttatatgtttcctctgcaacctacggtggtgactggatcagtacgccccacacccattactgttctgagcttttctatgtaattgacggtgtgggacaattccaggtagaagataatatcttcccggtttctgccaacgatctggtggtcatcaatcccaatgtgtcccatacggaacttggtttcaatgccaatccattaaaatatatcgttttgggcattgaagggctggaactttccgttgaaaataacaacgccaacttctgcattgtaaatttcagggaaatcaaagataccgttaacttctatttaaaagtaatgctccgtgaaatcgaaacccgctctgccggctatgaaacagtctgtcaggatttgatggaaatccttatcgttcttttcggacgccagaccaatttttctacgattctcagtcccgcaaacaaaagagcatcccacctctgcgattccgttcggcgctatattgatcagaactgcggggatgatctctccttggagcatctggcaaaattttcgcatgtaaacaaatattatctggtacatgcctttactgatgagtatgggatttctcccatcaactatctcatgcatgcccgcgtaaaaaaagctgaaaagctgctggcaaccacagattactctctttctgtcatcagccatacctgtggtttttcctcctccagctatttttcccagacctttaaaaaagtagcaggagtttctcccagcagctaccgcaagacggtcaaatctgaccatggagaaatggaagacctttcccactgacatacaggcaggaggtcatttatttgtactcaaaattcgggatctgtccccagcgctccttaaaatagtgtgccgccatcttcggccgccggtctctggtaaagagaccttttttatttccgtcggcgcgcatgcagccctggattgtggcgaaatccgcaaagttccagacctgctcgccgatgaagaagctgcgcttgtcaaattccgcattctgtctgcggtaatattccttctggaactcctcggagaacatttccggcacgctctcgtggatacccgcaaccgcatccgcgccgtattctgtaatcatcaccggtttgttctgtttttcccagaaatccagttccatatttaatgcatagcatgccgcgtcaagatcgccggacagattgtaccagccatagtaacggttcacacacaccacgtccatcgtcctcgtcacgagatctctctcgtagttgttctggcagcacacgaaagtcacaggacggtctgccggatcaaggctgtgcgtcagctcatagagcgagtgccagtaatcgtacgccgactccggaaaatgctcggtgtccggttcatttcccatcgaccacatgactacgcaaggatgattcttgtcccttgcaatcatctcgcgcagcacctgctcgtggtgctctctgatgtgaaaggtcttgtacgggtcgatcttatctcccgcgccgattccgaccgcaggcgtctcatcgatcacgacgataccctctctgtcgcacagctgatacatctcctccgcatacggatagtggctggtgcggaaagaattggcattcagccagtggatcagattgatatccttgacatccaggcacacatcgagtcctcttccacggaaagccgcatcctcgtgttttccaaagcccttaaaatagaacggttttccattgatcaaaaactgcgttccctctaccgccaccgtgcggatgccgaatgtctcctcgtagagatcctccccgtaagtgacactcgccgtatagaggtacggctcccccggccacggccaccacagtctggcatccgggattctgactgttccgcccgctccatccgccgctgccacctcattgccgtccgcgtccagaatacggatgcgcacctcatcctcacatacgctgcccgccgtcttaatctcataatttaccactccggtatcgccgtcaatgtctggcaccagcgtaatgtcatcaatataagccgccggcgtcgtatagatgcggaccggacggttgattcccgcataattaaagaaatcaaaattcggcagattctgcggttttctccatatcttcgccgcttcaacactcggcacgcccggattgtccgatccgaaaaatgccgtgctgccctcatttccgaccggaagcgtgctgtgatttacccggttgtccgccgcaacgacgagttccgccgtctctcccggcacaagctgatctgtcacatccacctcaaacggaagaaagccgcctttatgcgcagtcagaaatctgccatttaagtacacctttgcagcatgtgtaaccgcgtcaaagcggagcacgagacgctgtcccttcagataggacggaaccgtgatcttgcgctcgtaatacgcccagccgtaatggttccggtatttcgggtcgtccttctgatcgttgtacgatgccggcaccgccatcagctctgtgtcctcccccatcactaaggaatctcccggctccttctcatctcccagtttaaaattccatactccgccgagatctatcaccccgcgtactctgttctctcttggatacaacatcttttcttcctccattctttctactgatttcttcccgatagcttttgtctgggatttcttttattttacatttcttttgactgctctatgccgtctatcgcagcatggatttccccatcctgtttcgtgacagtatacatttttccacgcacccgcacggacgcatggaagtaatccacttcctttggaatatgcggtgcaaaatcgcagccgccttccggcgacagatggattccagcgatctcctctaagatcacaggcacgggcgcactcgcccacggatgacacaggctcgtgttccacttctgatctttcccccacgcctcaaagcaggtcgtcgctccctcccgcagcatgttgcaccacccgtgatcgctgtcgtttagcagcagcctgtacacactttcataccgcccccgccgtgccagtgcaagcaacaggtaataacttaacatcacgccgcaggaaaatccccgtttttccagaaactcaatgacaggtgcttcctctgcctcctccagaagcccgaaatacagggcatacacgttggagtgaagcgatatgtggctgcttgtttcactgtccgcaagaagccccgtctccttccggtaaaacgccctgcgatacgcgaaaaccggttcttccagctcatacggctcctctctgcccagcacacgggcaagcccgttgagcgtttttttcgcaccgagatacagggcattgatgacgttgtggcaccccgcccccacaacgggtcttgtcagcgcaaaatcataatcatcccgcagattttcgggccagtcgaccagattccacttgtctgccacctgcacaagcagcccgtccgcgcgctcgtactgcgcaaaatgccggatcatgccaagcgccgtcttatagtatggaagcagcgcagccgcgttgccggtgtaacggtagtatagtgccagcagctgcggatacatcagggaataatcggcgatctcctgcatcagtcctcccggtgcaaccgccagaagccccgggcagactgcccttgtctgcgcaaactgatcaatgcatttcaaaagcatctgcgtctccccggtcagcagtacctgcgcatgcgccgtcacaacggcatccccgagatattgtcctttttctctggtcgggcaatccacatagccctcctgcgttccgtattttaccgcgttcttacagatggaaaaaatctgctccagccgcttttcggaggacgtcacctctgcgccctcctccatcggatagtggcgtgtctgcacaaaaatcccacaaatgttcacgcccttccccggaagcagctttgcgtagcggaatcccttgtaatcatacggttccagactgcagcagccgtctgagagcgtccagatctcgtggtaggagcagttgcagcgcatctcgtagcggacgctgccgctctcatccagttcctctccgcagaagatttccacggtatcccccgcgcttccctccgccgtcaggcacaggcttccggcgacttcctctcccacatcgatccggatgctgccatcctcatagatctcgactttttccggcttgatgcgctccccgcaaagcatccgcgtcggctgtaaatacaaccggtaatccgcccactctgccgcagccggcgtcttccatccggcatcctcaaattccgcactgctccatccttccgggaattttctgctgtcaaagttttccagaaactgcgtatcatatccgattgttccgccgctgtacgcatccgtcctctcatagcaaaaacgaagcggtatccgacagccctgcgcatccatcaactctgcggcaaacgcaaagcgcaggtcgccactgttgtatacacggttgattaacccctgataatataaatgcagtccgaagcagtgctctccggcctccatcttccccagtggaatctcgttgtaatagtagtgatccggataaccgggcgcaggtccctccgccacaaatccggactccacgtacagcttgtagtgatcgtccgccgtcagtcttaacgtcaggttctcctgcgccgtctcaagcgtaaaacgcgcacgcaccagaacatgcagattccgccggaattccgctgtcagctgttgctctgcctccggttgtttttccccttcctcctgctccttgtggaacagattaaccggtgtgatatgtataaattcgcggatcgtaagccactctggactccattccgctttttctctgctcattttttctgtcatcccgccatcctttccgggcgtttgttcttctgtctgcagctttcctgattccttcttcttggcagccgtactgcacagattcccttacagacagcttcctgattttttattatggtataaaaaaatagtgcatttttccatagactttcttatgaaaaaatacactatttctatgtcatttttatgctgcctgaaattacttactgcggctgttttccgatgtaagcaaggataccgccgtccacatacagtacgtggccgttgacaaaatcagatgcatccgaagccaggaatactgccggtccctgtaaatcctcggcgtttccccatcttgctgccggagtctttgcgatgatgaactggtcaaacggatgtctgcttccgtccggctggatctcgcggagcggtgcggtctgcggagtcgcgatatagcccggtccgataccgttgcactggatgttgtactcgccgtactccgatgcaatgtttctggtcagcatctttaagccgccctttgccgctgcataagcggatacagtctcacggccaagctcggacatcatggagcagatgttgatgatcttgccgtgtccttttttgatcatggacggaatcaccgccttggaaacgataaacggtgcgttcagatccacatcgatgacctgtctgaactctgctgcggacatctcgcacatcggaatacgcttgatgatgccggcattgtttaccagaatgtcgatcacgccgacctctttttcgatctttgcaaccagtgcgtttacctgctcctcatctgtgacatcgcagacatatccgtgcgccttgatgcccagctcctcataagcggcaagtcccttgtcgacaagctcctgcttgatgtcgttgaatacgatcgttgcacccgcctgcgcatatgcagatgcgattgcgaatccgatgccgtaggatgcgcctgttacaagcgctacttttccctctaatgaaaaattaaccatagttttccgtcctttctttttccctcttattactctggtactgctcattgcttacacctagtatatcatgtgcaaaaccagcacatgatcaacattcgccgttcgtcaatcatgcaagcatgttgactcacttgcgctcattatatcatgtatgttattccatttcctgcaatattgtattataaatcttgcaaatattgaacttttgtcctatgctgtgtaaagagacatgcgctacagaacacataacaccacaaggcacatagcgccactggcgcattaaaaaacggcggcactgccgcctggaatcgtaagaacggagaacctatgaatagctgtataacctgcaaagaagccatcgaacactgcatgagcacccacacattcgcgttcgcccatctctacggcgatgagaagatcatggacatgcacattcacaactgctgcgaagtctattactcgatttccggcggaaaacagtttctgatcgaccactgcctgtacgacatccgccccggcgatcttttcttaatcaaccagtttgaaagccaccacctgacacagatcgatcagcagacacacgagcggatcatcctctccatcgacccggaatacttatcgaagctctccaccggcgtgacagatcttggtcattgtttttctttccgtgacaccagaatgccgcaccagatccatctctcccccaaggagcagaaccgctttatgtactttatccacgagctgcatgacgatggcggcatgggggaagacctcttagatcaggcaatctttctggaactgatggtctttttaaacagagccttcgcagcccgctgcacagacgccgcagcccccgcccaggctccatcttccaattaccacgcccaggtggatgccattttatcctacatcaactccaatatcggcgagccgctgacgctcgccggtctgtccgcgcatttttttatgagcacgtcctatctgtgccgtattttcaaggaggccaccggcaccaccatcaacaaatacatcaccgcaaaacgcatcaccctgtccaaatcactgcttgatcagggctgttccgtctcggaagcctgcgaggcctgcggcttcaacgactacagcaattatctgcgtgccttcacaaaagcagtcggcatctctccgaaaaagtacgcacagtttcactcctgaggttatgcacgtttcctttgtcttctcacatatgaaacgccgtgcccagcaagcacgatgagcatgctgacgcaaaacggcacatagaaatccatgccgcgcaccagcaccatggacgccttcacatactgtgcgccaaacactccgccgaacaccgccgcatacataagctccgtgattccctgcgcacccggaaccggaagcatgtccaccgcaatgtacaccgccgcctgcactgccagaatgtgaaaaagactgctccccgaaagtccgaagccaaggtacaccatccccgtgatcagaaacaccgtgcttctctgtaaaaatgtcaccgctccaatcacaaccagttcccctttgtgctctcttaaaaaatgcgtggtctcacggtaccgccctgcaaaagccgccgcgtcctgccgcagtttttccccgttttttacgatgccgcacctctctcccgccgccagtacgccgcacatgatattaaggatcagccccggcgaaaacatcacgccgcacagcagcgccacgagcacgacattcaacacgattccgaccacgtacagtccgagccaggagccgagatactccctcatatgtcccagccagaccaccgggagcatcaggccgatcacaaccagaaccagcttgtaaaacagcgccaccaccatgagaacgaccgtgctgtcggaggcattgtttccgtccttgcacatctcgtagagttgcgcgggctgcccgccggtcgcggacggtgtaatgcccgaataaaaatatccgataaacgaataccggatgcaccccggcagggtggcgtcattgcccgaaagccgcaaaagccgccagatcatataaccttccaggcagacaaaaagcaatcccagaaacactgcagaaagcagacagacgggattgctttttcttatcagtaaaagaagatcggaccagttctgtccccggaagagaaccgagagcgccagcaccgtgaccgtgataaaaaacactgcctcaaatatcttttttctatccttcatacactgtctccgttcctgcaagcagcatcgcgcgctcccgcacgggctcctcctccacaagttctctcaattttccgcggaaaatgcaggtatatccatcccactcataaaaatccttcggcgtcacaagcgattcatccttcgcaaacgatgtgatcccggcgtccgaaagaaactttgccgcgaaggaagaacaggtaaaatgccggctccggtgtacggcacgtcccatggcgataaacggaagctccatcaccgcatagtgataccgccaccgatgctcataccaaagccgcattttttccctgatctgttccttctgctccgcggtacagtctatcgctccgatcatgtaatccgcatccgggaaagagcgcaggatccgctccttatcctcccgctcataccctgccacaagcggaaccgccgggttgcgcctgccaaaactgtacgcctcatccagattttcatcgagcgagagtaaaacatgaatatatttctgcttcaaatatccgtgcagcgccgacgcaaacagtcccggcgtgtccacgaatgcaatgtatatcttttccatgtaatcctctcccgtctattgaaactgatagagttttctggcgatgcgatacccctgcacggtaatcttccctccgacttttcccggaagataggtaaatccgctcagcgtcgtgtacttcaatctgaggtagagcattttgtcctcctcacggatggtattccacagaagcttccgcttctccaacgcggcgcggtcgttgatcagaaggagatggatggaggaaattgccatcatgatggaaatatttctgcacatatagacggcaagcttcggatatttctgccgcacctcgtcgagatcgacgcaggacgccacaatcttcgtcaccttaatctgctggtcaatgcggcgcatcatcacttcctcgttcaccgactgatccgctcttcccagaaaatactggtacagatcgatgtccatatagtaaatctttttcacatacggcagcggctgatacgcaaaaatattatccacataaaacgtgtgctccggcaggcagactcccgtctcgcgcagcaccgatgtacggtagatgagcgcatgcataatcagatactgggacggtctgaaatgtccgatgtcattccaggtacagggcgtttccgccgggaatacattccggtacgccatcgtgtgcgccgttccctcctccaggtgattgtaagtataattgcacacgatcagatccggctgatccataagttctgccaccgctcccgtgcagaactccttcacgcgcgcaagcagtctgcggtacgcatcctccgaaagccagtcatccgaatccaccactttaaaataacagcccgtcgcaaggtgcagtcccgcgttgacgccggagccgtgtccgccgttcgacttgtgtaccgcacgcacgattcccggatagtttcgctcatattcgtccgcgatctcccccgtccggtcggtcgatccgtcatcaatcagcagaatctccacatcctccccgccgatcagcagggaatccacacagcgctccatatatgcagccgaattgtaacacggcaccgtaaatgtaatatatttcattttgtcaaaccgtcctttctctttcgcttcatcatctgctctctacgatactgcctgcagttaaacatttcgtgcagaaatttccaaagtttttccaaagaatccttaagtttttctctgttctcttaacataagggataaccttaaacgaagcgcacacaatttctaaacaatttctaaacggttcggtcgatcgggaaacacaaaatcgggaaacgcaaaaaccccggcggcgatgtacatctctgccatccccgtcggggtcttttcattatttcatttctatcattttcgcatctgcggaaactttgcgtgctatttcatattgaggcggtaccctgcaccccacacggtctctatgatcttcgggttcttgggatcttcctcaatcttctcacggatacggttgatatgcacggtcaccgttgcactgtccgacatataatcatacccccagatccgctcaaacaggtgctccttggaaaatacaatgttggggttcatcgccagatacttgagcagttcaaattcccggttcggaaaatggatctcctcaccgtcacgaatgaccttccagcttttggtcagaatcttcagaccgccgacctcaatgcagtagtcatcggcatcgtactcttttccttcctgtgccatctcatgcttgccggtcaaacgctcataccggagcagatggctttttacgcgcgcaaccagttccatagggtcaaacggctttacaatatagtcgtccgctcccagaccgagcccccggatcttgtccacagattccgtctttgccgtcaccatgagaatcggaatgtcaatctgctcccggatctcacggcagatatcatatccgctctttttcggcatcatgatgtcaagaatcagaaggtcaaacttctcctcattgatccgcttcattgcctcttctccgtccggtgcgatcaccacctcatgcccgctcatctccagataatcccgctccagatttgcgatttccctgtcatcttccgccagcaaaatgcgtgccatcatcgtttcctccccgcgtcatccgccatctgtcttctcacgccctgccaacttccagcatggccttttcttttcactccctgccctcttccggcatggcttttcttctcacgccctgccctcttccggcatggccttttcttttcactccctgccctcttccggcatggccttttccttctcgtgctccgccgcctccggcagacacatctccacatgaaatccgtctttcgtgtaggcacggatctttccgccgtgctcctttatgatatatctgcatacataaagtcccagcccgtttccgtcgcacccgctgcttctggactcatccccgcggtaaaactcgtcaaagaccgcgcccagtttttcctgctccataccgtcgccattatcgccaaaatccacgacaatccatccgtcattttccgcaatatgaatggaaatccgcagatcatcgggccggttggcatatttgcaggcattctccatcagattgtcaaatacccggatcatctgctccgtgtcaaggctgccgtatactggagcctttaagtcactgacaacctccgccgcaatccgccgctccgtaaattccggctctttttcctccacatagtcccgcaagaacctctcgacatcacactcgcggaagaagaacggcatattcccggtctcgagctttgaaaaataaaaaagctttgagagcaggacatccatatcgcaggatttccggtaggcaatctttaaatattccgtcctcttttcctcggtgttggcaatcccgtcaagcattcccttcacgtaacccttgattgacgtgagcggtgtccgaaggtcatgtgaaatcccgcttaccatttccgtccttgccttctcgtaggcggcatttttctccatctcttccctcagatgctcctgcatcaggtcaaaactgtcacacacgcccttaaattcatcctcgtaaggatagccgatcggtgtggtgagttctccgtccatgactcgctttgcggcgacgtcgagtgcttccgccggcgagaggatatgccggataagtctgcgcgagaaaatctggctgagcagcagaattccgccgattgccagaattcccaccaccaggaagacgacaataaacatctcaaacattccgcggtccatcccccggaatgacagttcactcggacagttgaccgcgtagatgtcataaaagttgtcgtccactgtcaccctggttgcaagcacggtcgtgctctccacaaggtaggttgtaatctttccggcatcgttcggcgtataaaaaagagcctccgttccctcctcctcactgtgctttgcgttattgtagacaaaattcctgtcctcatcgatcacaataaggcggaagccataatcggtcagttgttccgccatgccatcccagctgtcactctctaacacctccgggaacccggcatacacttccgtgtatctgtccgcaagctgtgagtggctgccgtaccatcttagaaattcatccttgaacaagcagatcatcgatccgccgattccaagcagcaccagcatggcaagaagcaccataaatgtgtttgtccaaaacagttttttcctgatcgtcattcgtgtgccgtctcccttttcttacaaaacctgtgttttttcacaatctcttctgccgcaagccagaatacttccgccgcatagctgattccggtgccaagcagcgctcccgcaagcacatcactcggataatgcacgcccagatacagtctggaaaatccgatcagtgcagcaagtacgagtgccggtattccatagcgcttcggcagtttccggaacagaagcactcccacggcaaacgatgccgccgtgtgccccgacggaaacgagtaatccgtcggaggcgtaatcaacggaatcagaccgcggatgcagtcataaggtctgcttctggcaatcagatgtttcaacagcatattgttgaaaagcagcgacagcacaagcgccagcagccccatgcagccgatccgccttgttttcttcggtaccagaaggagcagtgaaattgcaatccagaccgcccccgcatttcccagcgttgtgattccgcggaaagtccgggttgccgcatcatttctcataaactcctgtatgtacatcaaaaatccactgtccagatccatcagctgttctaacatgttttcctcttttctgcgccgtctcgtaactttcggcaccatgcacctatcccggtgcgatacgtttattctaggagccacgcctaaacagcatctcgaaaaaagttaaacattttctaaacaaccgttacagaatcatgagaagtgttcccgccacaatcagcacaagaccaaacgccgcctttttcgtcagcttctcatggaataccagataggaaaaagcgattgtgacaaggatactcaatttatcaatcggcactaccacgctcgcaagtccgtcctgcagcgctttgtaatagcagagccaggaaccgccggttgcaagtcccgacagacagataaatcccagttccctcctgtcaatcctgccaatctccttctgcttgcccttcgcaaataccatgatccatgccatcaagagcaccaccgctgtccggattgccgttccgagattggaattgagtccctcgatgccgatcttgccgagaatcgaagtaagacttgcaaaaacggcggataggcaggcgtacaaaagccagctctttttctcctgctccgcgctcttttccgtctccttcttctggatcataaggaaggtaccggcgccaattaagatgacacacacaatcttaagtgcgctgacttcctctcccaaaaaaagaaacgccagcacaatggtcagaattgtactggacttatcaatcggaaccaccttattcacgtcacctgcctgcaaggcatgaaagtagcacaaccaagatgctcccgtcgcaacccctgagagaatcagaaacagccatgtcttgccggatacagccgcaatgccgtcctgtgcccccacgacgaacaccataatccatgaaaaaacaagaaccacgatcgtgcggatcgccgtcgccacatccgagtctgtatggcggataccgcattttgccagaatcgacgtaagtcccgcaaacagcgcagaaccaaacgcatagaaaatccacatacgaatgcctcctttacgatacaccttttctcccgcgtatcacaataatgtcatttaactttaagagtgtgtccttctgcggcaggatggataaatcgtcgcgcagaattaaaaacaccgtcagctgctgctcatcctgcacttctcccacggtctttcccgcatatcttctgtccacaaaaatctccgcaatctccttgatgtccgcatcctggatatttgagatgctgctctttctctgatactgctccacgaatccggcgctgatgataccggtcgggatcgctaccacgccaacgccgagatacgcaatacagatcgccatcagacgccccagcgtcgtgatcggataaatatcgccgtatccgaccgtaagaagcgttgacatgctccaccagacgccgctgaatgcattgcggaacacttccggctgcgcgtcatgctccacactgtacatgcacagactgctcgcaagcatcaggatcaccacgataaacaccgaggaaatgatctgattccgcttctcgtacagtaccgtcgtgatgacattaaatgaatcatatcttgcattcaagcggaagagatgaaagattcttgccacccggagcatccgaaagatcacaaatccggacaaaaagaacaccggaacaatggtcagaatgtccaccacgccgtcaaaagacaccataaagcgcagtctggcgcggcatttgcgcattcccggatataaaagatccgccgtccagatgcggagcacatactccacacaaaaaataaacagcgtgatgacctccaccacgaaaaagaaaccggacagaaagtccagttcctcaaacgtctgtaaaaatgtaaccagaatatttgagacaatcgtaattgtgataaaaatatcgaacgcacggctgatccggttactcttatctccaatctggataatgttaaatattttttctctcaccttatgaatccatctcccagcgtaactctgatattttcggtgtccgacggatcctaccggtcatggacggctccgatcagttcccggatatcctccacctgatagcgctccatgtaggcgcggattccgtcaacgatctcctccgtcgcatgcggatgatagaagttcgccgtaccgaccgagactgcggtcgcaccggcaagaatcatctcgatggcatcctccgccgtctggattccgcccattccgataatcggaatctttaccgcctgcgcactctggtagaccatgcgcaccgcgaccggatgcactgccggaccagacataccacccgtgcggtttgccagcgcaaagcatcttctgtgaatatcaatcttcattcctgtgatcgtattgatcatggaaagcgcatccgcaccgcccgcttccgccgcgcgcgccatctccgtgatgtcggtgacattcggggaaagcttcatgatgaccggctgctttgcatggcgtttcatctcttttgtgacttcttcgaccatcttcggattctgtccgaacgcaataccgccttcctttacattcgggcaggaaatattgatctcgagcagatctaccggctggtcggaaagccgctccaccacatcaatgtattcttccgtcgtatgtccgcagacattgacgatgatcttcgtgtcatattttttgaggaacgggatgtccctgtcaatgaacaggtcaatgcccggattctgtaaaccgatcgcattgagcatgccgccatagacctcagccacacgcggcgtcggatttccttcccacggcacatttgcgacgcccttagtcacaactgctcccagcttattcaaatcgacaaactccgaatactcctccccggaaccgaacgtgccggatgccgtcataaccggattcttcagtgcgacaccgcacagatcaatgccaagattcatcagaaatccacctcctctgcccgaaataccggtccttccttacagactctcttgttcttcacattggaatgcgcatccttctctgtggacttgcagacgcaggcaaggcaggcgccgatgccgcacgccatgcgctcctccatggagatccaacattcgatgtcttcctttgcggcatactcctttaaggcgcggagcatcggaagcggtccgcaggcgtagatcacatccgcggtcagcccgttctcgcggatggcgtcgagcacattgccctccgttcccacactgccgtcctccgttgcgatatagacctctccctgtttgcggaactcatccagcagaaacagctcatcccggtatccaagcacaatctgtttctcgcagtttaactcttttgcgagctctaacatcggcggaatcccaatgccgccgccgattaaaaacgcctttttctcctgcttcggaaagccgttgccaagtggtcctatcaccttaagctgcataccggtgtgcatggaagaaaactcttcggttccctttcccgccacgcggtataccagacggagcgcgccgtcctttctgtcgatctcacagatactgatcggtctcgggagcagcctgctgccttccttacagtagaccgatacaaactgccctgcctttgcatgcgccgcgatctgctcggtgtgcagccacatgctgtaaatatcgtccgcaatctcttcctgtttgattatgattgccgtctcttcaaatttctgttgtgttgtatgcatgatcttttatttttccttatcttcatataccacttgtccgtccacaagtgtcattcgcactttaccggtgacttttctgccgtcaaacggggtattcctgcccttgctgaaaaacgtattcttgtcaatcacgtacgtctcgtccgggtcaaaaataacgatgtctgcgacctttccaggctcaatatctcccttgtcgattccgatgatcttcgccggattgtagctcatcttctccgccatctgcatcggcgtcagatacccgccgagtacaagctccgtgtacgttaagcatgcggcggtctcaagacccacaataccgaacggtgcggatttcatggaggtattcttgtcctcaaacgtgtgcggcgcatggtcggttgcgatcacatccatcacgtcatcccgcagtccctcttttaacgcctgtacatcctccttcgtgcgcagcggcggattcatcttgtaattcgtgtccgcatccgcctcgatcgccacttttttctccgtatccacggtcggctcgatcttcctgatgtcatcggaagtcagtgtaaaatgatgcgggcacacctctgccgtcacatggattccctccatcttagcatgcttgaccatgctgacagaatccttcgtggagcagtggcacaagtgcagtctcgccccggtatcccggcttaacatgatgtccctggcaatgatgatgtcctccacggaattcgtgatgccgccaagtccaagttctctggcgttgacatccgcattcatgacaccgccgttgacaagattgatgtcctcgcagtgagcgagcaccgcaatgttgtacttcgcagcaagttccatcgcctctctgtaaagctgtgcattcatgacggatttgccgtcctcactgatggcaggaattccagctttcaccatgccctcgatgtcggaaagctcctttccctgctgtcccttcgtcaccgcaccgacctgtagcacgttggcagcgccgacggtctttgctttgttgtgcacatagttcacaacatccggattatccacgaccggcttggtgttcggcatggcaagaatcgtcgtaaatccgccgtgcactgctgcccttgcgcctgtctcgatcgtctccttctgttcaaatcccggatctcttaaatgcacatgcatgtcgataaaccccggcatgacaaagcagcccttcgcatcgatcacgcggtcgcatttttccttgatactcttctcggttctggccacaaccccgttctccaccagcacatccagtgtctcatccgttccggtggcaggattgattacgcgtccatttttgatcaatatggtcatctttttttcctccattgtatgagttcatcttatcatatccgcctacagttttccatacaattccagcggcacatacgccttcacatagatcccctccgggcggtaatcctcctctaaaagctctccctgctttctgatctgctgcaggattccggcatccgcataggcgatggttcgctcaatcagaactttgttctcgcgcagaagttccgcaagcagttcttttaactcgtcgagccccgttccctctcttgccgagactgccagggtatgatctgccctcagatcatgcagcggctcccgctccgtcaccgcatcctgcttgttaaagagcgtgatgaccgtcttttcccggatatccagctgatagagcgtgtcatagacaatgtgcatctgcttctcgtgctgcgggttggaagcatccaccacatgcagaatgtagtccgcatattttgcctcctcgagcgtactcttaaacgcctcgatcagatggtgcggcagcttccttataaaaccgaccgtatcggtcagaagaatctcctgtctgcccggaagttctaagacgcgcgttgtcgggtcaagtgtggcaaacagcttgtcctcctccaacaccccggcgtcggtaagccggttcaacagtgtggactttccggcattcgtgtagccgacgatcgccgccacaggcatcccgtttctcgtgcgcttcgcgcgtgtgatctcgcggtgctggcgcacctcctttaattcccggttcagctgtgcgatgcggtctttgatgagacgtctgtccatctccagctttttctcacccggccctctcgttccgattccgccgccgagtctggacatggaacgcccgaggccggtcagacggctgaggcggtattttaactgcgccagttccacctgtatttttccctcgctcgtcgtggcgcgtgccgcaaagatatccaggataatcagcgtgcggtccatcaccttggtgtctaacatctgctctaagttcttaagctgtgccggtgaaagttcatcgtcacagacgatgccggtcgcgccccgctctgcgatcatcgccgcgatctccgccacttttccggtgcccacataggtgcccgggtgcatcagttccctcttctggatcagtgtgccgaccacgacagctcccgctgtcctgacaagctccgccagctctgccacagagtcctcggcatcatccccatcctgctcgctcacgccgaccagaatcaccttttcgatctgatcttccaattcaataatttctgccatgctgctccttttctactgtccgctgtctccgcttccgtctgttccgacatcggctccgctgtcggttccatctgcaccgtctgttccgtccgttccgctatcggttccgtccgttccgctgtctgcttctgctgttccgatatcctccgtcacgaccacttccccctgcacttctgtgcccgccggcgtatccacccggcttttaagaaatgtgtattcacgcagtgcctccgcatcatcagggtacgcggctgtataagcggtcatcacctcataagctcccgcaaaatctccggtatactccatgcagataatctgattctgcagcagcgcgcgcctgttcggaacactctccatcgaaagcccctgctcgatgtaggaaagcgcaccgctataattcagcttgcccatctcgatctgtgccaatgcattcatcgcttccgaatccgcgacacccgcatccacataagcctgataatacatctgcgcgttcgccgtgtcctgctgtgcctcatatacctgcgcaagcgtcaggttcgccgctgcactgcctgcatcgatcgcggacgtcaattctttgattgcgttgtcatactgccccagcaggtagtaaatctcccctctgtatgcaagactttccgcatcatttcccttgatggaaaacgcgtcgtttaaatatgcttcgccctcctctgacagatcgtaggcggcaaggttcttgtaaatattgatataaagttcataatccgaatggttatacttgaccgcatccgcaaaatcctgcttcgccccatccgtatccccggtgccaagctttaaacatccgcgcagatagtaagcgttggcgttcttcccgtcataatcaatcatggcgttgtacgtctcaagtgctccctcagtgtcctgtgcggcatactgggctgccgccttgtaatagcagatgtcgatctccagatcggtaatttttccggtgcagcacgcaagcgctccgtcaaatgccgccagtgccccctcataatccccgctctgcatgctctctatgccaatcttgcggtaggaaagctcatcctccgtgcgctcattcgcacatccggcaagaagcgcggctgtcacaagcaaaaacaccgccgcttttcccctgtatgttctatggtgattgatttccattcgtcttctcatcttaattcctctttttactataatgaagccaccaaaaagtataaacgatattttccttccccgcaaggtgatttcccgctgcaacaagcgatatcttccaggtacatgacttttctatctcatgccgtcccgaatcacgcgcgccgtgttttgataggcaatctgctccacggcgtcttcggagagtcctctctttcgcagcgcatcgaaaagcagcggcagcttcgtgcagtcactgatctcaaattcgcctgagattccgtcaaaatccgtaccgagtcccacacattcgataccgcccctgtcaatcagatgcattgcgtgatcgcagatgcgttcgatacggctcactttatccatctcgtcctcattcagaaaagtcggttccagattcagtcccgccactccgccgcactctgccaattcgcggatcatcgcgtcggtaagattgcgcgttgccggcgccagtgcccggcagttggaatgtgatgccacgaatggcacgccgcttcgccgggacgcttctgcgacatcccggaaacctccgtcggataaatgggagacgtcgactaagattcccagttcctgcatatagcgcactgcctcttttccaaatccggtcagcccacggctcatctcctccggcttttgggaatggcagtgtcccagacagttgtcgtcattccaggtcagtgtcacaagtcttacgccgagatcgtaaatttcccggattttgtccattttcccatcaatcagagaaccgttctcaatcgtgagaaacgccgatattttcccagcatcctgattctgcttcaattcctccgcgttgtgcgccgcggcaaaccggtcgctgcactgctccatggtatggcggaaaatgtcatacattttcctcatgagtgcttccgccggcggcatctcttctaagccgaaccagtccggatcatttctctgcggcagaaacatcgcaaaaaactgcgcacctgcctctgcctgctgcaggcgcagtccatctaccatcgtgtgatcaagttccagaaacgtctctgttttctgcgctaacgcgcttcccaatgtatcacaatgcatatcaatataacgcatcattttctccatttccgggcagagttccttcttgttttccggactgctgccctgtctttttcttattataaagaacccgcggactttatacaatatgccggtcgctggattttgtacagcattttctctgtttccactgttttcataatcgagtaggaggaatttctcttaaataagaaattccgacctctcacaccaccgtgcgtaccgttcggtacacggcggttcaatcaacttaacaagttgtacacctttcggtgtagtaatctaacat

(The sequence listing continues in the following parts.)

What is claimed is:

1. A pharmaceutical composition comprising an effective amount of a bacterial mixture, the mixture comprising an isolated *Bacteroides thetaiotaomicron* strain, an isolated *Eubacterium hallii* strain, and an isolated *Roseburia hominis* strain, and a pharmaceutically acceptable excipient, wherein the bacterial mixture is capable of one or more of
    (a) increasing production of IL-10;
    (b) increasing production of CCL-18;
    (c) increasing gut barrier integrity;
    (d) increasing autophagy; and
    (e) reducing or attenuating production of plasma Lipocalin-2/NGAL; and
wherein the *Bacteroides thetaiotaomicron* strain is the live BTH01 (P118-A12a) strain comprising the 16s rRNA sequence of SEQ ID NO: 2; the *Eubacterium hallii* strain is the live EHA01 (P168-F1a) strain comprising the 16s rRNA sequence of SEQ ID NO: 3; and the *Roseburia hominis* strain is the live RHO01 (P127-H9a) strain comprising the 16s rRNA sequence of SEQ ID NO: 1, wherein the BTH01 strain is deposited at the DSMZ with the accession number DSM-32919, the EHA01 strain is deposited at the DSMZ with the accession number DSM 32920, and the RHO01 strain is deposited at the DSMZ with the accession number of DSM 32921.

2. The pharmaceutical composition of claim 1, wherein the bacterial mixture is capable of increasing production of IL-10 and/or CCL-18 in a human THP-1 macrophage and/or peripheral blood mononuclear cell.

3. The pharmaceutical composition of claim 1, wherein the bacterial mixture is capable of increasing gut barrier integrity of HT29MTX-E12 cell monolayer.

4. The pharmaceutical composition of claim 1, wherein the bacterial mixture is capable of increasing gut barrier integrity of a HT29MTX-E12 cell monolayer treated with TNF-alpha.

5. The pharmaceutical composition of claim 1, wherein the bacterial mixture is capable of increasing autophagy in a human THP-1 macrophage.

6. The pharmaceutical composition of claim 1, wherein the bacterial mixture is capable of reducing or attenuating the production of Lipocalin-2/NGAL in a cell or a tissue.

7. The pharmaceutical composition of claim 1, wherein the bacterial strains of the bacterial mixture are capable of acting synergistically compared to each of the bacterial strains acting individually.

8. The pharmaceutical composition of claim 1, wherein each of the bacterial strains of the bacterial mixture is in lyophilized form and wherein the pharmaceutical composition has at least $1 \times 10^8$ viable colony forming units of each of the bacterial strains.

9. The pharmaceutical composition of claim 1, wherein the bacterial mixture comprises at least about $1 \times 10^9$ viable colony forming units of the *Bacteroides thetaiotaomicron* strain, at least about $1 \times 10^9$ viable colony forming units of the *Eubacterium hallii* strain, and at least about $1 \times 10^9$ viable colony forming units of the *Roseburia hominis* strain.

10. The pharmaceutical composition of claim 1, wherein the bacterial mixture further comprises a cryoprotectant selected from the group consisting of a fructooligosaccharide, trehalose, and a mixture thereof.

11. The pharmaceutical composition of claim 1, wherein the composition is comprised in a capsule.

12. The pharmaceutical composition of claim 11, wherein the capsule is a dual component capsule.

13. The pharmaceutical composition of claim 12, wherein the dual component capsule is a capsule-in-capsule.

14. The pharmaceutical composition of claim 12, wherein the capsule-in-capsule comprises:
an inner capsule comprising the bacterial mixture in a lyophilized form, wherein the inner capsule further comprises a reverse enteric polymeric coating; and
an outer capsule encapsulating the inner capsule, the outer capsule comprising the bacterial mixture in a lyophilized form, wherein the outer capsule further comprises an enteric polymeric coating.

15. The pharmaceutical composition of claim 1, wherein upon storage for 6 months at 4° C., the pharmaceutical composition loses at most 3 log colony forming units of each of the bacterial strains.

16. The pharmaceutical composition of claim 15, wherein upon storage for 12 months at 4° C., the pharmaceutical composition loses at most 3 log colony forming units of each of the bacterial strains.

17. The pharmaceutical composition of claim 16, wherein upon storage for 24 months at 4° C., the pharmaceutical composition loses at most 3 log colony forming units of each of the bacterial strains.

18. A method of treating an immune mediated inflammatory gastrointestinal disorder in a mammalian subject in need thereof, the method comprising orally administering to the subject an effective amount of the pharmaceutical composition of claim 1.

19. The method of claim 18, wherein the inflammatory gastrointestinal disorder is ulcerative colitis or Crohn's disease.

20. The method of claim 19, wherein the inflammatory gastrointestinal disorder is ulcerative colitis.

21. The method of claim 20, wherein the subject has had an inadequate response to prior oral administration of ≥2.4 g/day of mesalamine for at least 8 weeks.

22. The method of claim 18, wherein the mammalian subject is selected from a human, a companion animal, or a livestock animal.

23. The method of claim 22, wherein the mammalian subject is a human.

24. A method of treating dysbiosis in a mammalian subject in need thereof, the method comprising orally administering to the subject an effective amount of the pharmaceutical composition of claim 1.

* * * * *